United States Patent 10,221,454 (METHODS AND COMPOSITIONS FOR SCREENING AND TREATING DEVELOPMENTAL DISORDERS) - sequence listing, part 8

SEQ ID NO: 99 - DNA, 79780 bp, Homo sapiens
cggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 100 - DNA, 8055 bp, Homo sapiens
cagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaa

SEQ ID NO: 101 - DNA, 8055 bp, Homo sapiens; identical to SEQ ID NO: 100

SEQ ID NO: 102 - DNA, 54554 bp, Homo sapiens
cgagggcgccgcggccccgtgctcgccgccccgccccgccccgccctgcccggagcagctcggcagatgctctgtgctgcggcccggaggtgagtgagccgacccgcggccggccgcgcgccgctgagcctcaggggtcgggggcacggccggggcatccaccttgcccccacttgggactcttcccaggcctttgtgccccggatccgccaggacgcagcgtcagggatgcccctcaggggtgggggacaccaagggcggggacgcctgcgaggtgggcagggggcggcctctggtcgggcaggtgctgggggagggatgcgccgccaagccgatgaccccgcgggagggggcggttgaggacccgggagggtggacagagggcgccggggatgccgcgcggggccgccgggcgcccccaagcagcggctgatgcggagcccgggcgggccaggcgagctgcgggagcggcgctgaggcgggtctccctagggggaggatcagggaggggcggccggagccgatgcagggccttgcctgaaaccgaggagagggccccagaggcctgggcccgaggacctgggcccgcagacggacagctagcagttctcggtcactgctcttgcagcgagcaggttcctcacaggcatttagaggaagagatgagtatcgacctgctgcgattgtaatacgttcccggctcaatattttttcccttaaaaggcggtgggggtgtttgggggaggggagtgagggcctcagggctggcgctccgtatcctgcgggcgatccgagggggctctgcctttagggcggtgctgagccttcctgggtgatgatggcaggattcggcctaggccgagaatgggggctcctgttaactgagacaagaggatgatgccaagcgagaccagcgttccgcgtagtccgtgttggggtggagggacccgcctggtagagaggtctgtcttgcttggggagacagctgagcccctgaccggctcctttctgcccaagtgatttccctgccctggggattgagctctctggagaaggctccttggccaaattcaattaagcaaatatttattgagtggtcactcccccagagcttgacgctggggtgcaccgggtgggagtggactgggcctgccctcccaggactgattgaccaccgcataggggaaaacgtctctactcgaccaaccccgcttgagtgcaggtgcaggggcctcgggagggacctcagagtggtgtcctgggctggggggtcaggtgagctcgtgggcaacatgacatttgaactggagcttgaaggacatgggcacagctaagctgggcattgtgggcagagaggagagaatagaccgaggcacttgggcagttaggtctgatgggagcacttagcatgcctggggagtaggaggaggtatggcgggaaaggccggtgggggctgcacggggctgagggagctgggaagtggaatgaccccactgctggttaactgtggctatggtggagaccacggcttcctcatctgtaaaagcgaagcagttccatgaccccatgagctggggtgggcctggagaagagctagctttaaagactggggaaggctccttgcagtctgagactgtgcttccaggcacttctccctcgggcacagccagggcactgggtaaccacccaggcaacccccttgttaggattgagttgcctgtttcggggatgatgcttagctagtgactctgtgcctctgggatgtggatgtttgagagcagtaatcgtggcagcctgggagcatccatctacggggtgcagtgggggtgtggatggcctggcggtgcttggataaaatatgcgccttgagcaagcctcattctctaggaatgaggagatgctggcatctggtttaaaagtcttcctgtgtgttcctctaactgacgttgattttctgagacaggaggtgaataagacataatttctccccctcggaaattggtgtcactttcccccctaagtcagctccctcatttctggggatgtttttgctctccctctgaaggggctgtttgttactcatctttgtagtgtgcctaccctccccacccaacacacacttggctttggccaaggcccaggttgatgcagcgagaacagggcctgccctcgtggggtgtgcagtctgtgctgagcagggtgagctgctgtgctctgtgcctgtcgcctggactgttgcagggacctggcatgtgactgtgggtttgggacacagggaatggattcttccctctgtccccagcctctcagtccttttgttttctagaatctcaggaggaacctcagagacctggaggccccaccagagtggccagaacctggtgcaggagtatgggtggggtctcagtctggccctcaggagcttctagaacaattccaggaatttgcaggtaactggattgacttcacaagggctgcccagggcccccgcagagaggccagtgggacaggaatgctgaatatagcaattcaggaatgctgaatttagtcatcttgtgtgtgaacacatgtgtgcggcttcctcccctggaggcaaggaaggcagccctgtgctgtctgtcccacgctagcctcagaatacttaagacggtgtgtggtggcaaaggcactctcactgctgctgaccatggcaggtgcacgggcacactggaggaggcaggtcagcatgctgctctcccgaaccctccagcaaggaaacctggggtagccaagcctctgagcacctgtgagcactgtgcttggctggaaggagcacaaagcgaaatgaacagaggcgtcagtgcagatgccaagggtcagccccaggcagaatcccagagcagaggctatgctgcggcctgggcagaatgaagagggacgtgggagcacccagactgttgtggctccggggtggtgaggtgagcattccagtctaggtggcagaagacctggagtcaggtcctggtcccaccatcctaggtccagcccctttttctctgaacctcattatcctcatccatacccaaagccaagagtgccctgccctgtccccacaccagcccctgccacacattttggccctttcgtgcgaacaccgccaggggaggcgcttcacaggattgaaccaacagggaccgcttgacagatcctagagcacataggaggagacatcagccctctggactgagccggaggagcagaacctcacgcgattcatccattcatttgttcagctaacatttaccagcgcctgctgcatgccaggcactgtgccaggtgcaggggtacagcagggacgtagcatccactcacagtgctcacaccagacgggcaggggttgacagtaacacatgttactaagtgctgcactgtggagaacactaaagcagaaggtgggggacacgagatgggggtgggggactgacacagtgccatgcagaagtgctgggtgagtggtgtggctgagcaggggagagacagcaggtgcaaaggcgctgagcagacactccctggcccctggaggccccaccagagtggctggaacctggtgcaggagtgtgggtggggtgtcagggccaggtcctgcaggactcagtgggccccaatgaggcaggaagaccttggcagggttggagcagagaagagactggagctgccctcccaggaggagctaatctacactttgaaaagatctctctgctgaggtgggaaaataggctagggtggggtaaggctgggggccatgaggggctactgcaacatcccaggcagagaggctgctgacccaggggtgggagctctggaggccctgagaaatgcaggtgggagatttgtttttttaaagctgcagcttttaaaggacagctgcagttttggtctgaaccagtagaaagatggagctggtattggctgagaagcaagatacagaaaaacccattctggagaggtggggaattaggaggtgggtctgagacctggagagccattgatgggcacatgtggccagagggagagcaaggctggaggtggcaacctggagcccctggcactgaggtgtgtggcaggccggggaccacgtgaggtcacttagggatcaagggtaggtaggatcagaagaggctgagctgggctcctgggcctccactgtggggaggatgagttgagaagcatcgagaaagagagattgaggattgacgggcaagtgaggtggaagcacagtcacagtggcgcctcgggaggctggagaagagcgggtcccagagagcaggtcccctgtgtcaagcaggcagggcatgcccagggactgagcaatgcaggcacagctggccacatgattttgggggcccccatttgaaaattattaagggcctgacatgatggcgcacacctgtaatcctatactatgggagactgaggtaggaggatcacttgaagtcaggagtttgagaccagcctgagcaacatgtaagagcctgtctctacaaaagtaaaactaaaattatgcattccagaacagcaacagcagagcattaaaactgtatggatgcccaagtgagtgcccaggaagctggctggtcacagggacctcaaggataatattggggatgtagtggcccctgtggagaaggaaggcctggagggtgggcccgcaacctgcctgctgcccagtccccacagcatttctcctcccttccctgagtgggcgggtgggttgcgttggactttcagggccgctggagtcagtcacacccagcctgtgagcttcaccttggcaccatggcccagggaacccaaagtgaaaactgcagcaggcaattgcctgctgcaattcttcactaaatgtcttgcttcttgccccttggtctgtggacccttgggcaagaggcagcaggaggcacatcttgaggttgaggtttagatggtcccatcagcaggccctggacctacatggccacagcttcacacagcaatggcttctttgcgttcatctcttttccaaaggaagctgccacatcacagagttttgagttatttgcttctaaattaaggtgtaactctcttttagagacgtccctggagaatccatcaaaaagtgctaagaagcgagactgttaaaagccacagtgcagggaggggccttacacatagtgtcaagcccgggggtgttccttctagcagcctccaaccagaaacacaccccgtccccgagggctcagccaggcctctcatggccatgggggaccgtggttgtggttagagcaaacctttcaggagacccttggcccctgggatggagagctgccaggacagaggtccctttgtgaggtctgcccctgtgagtcacggaggccaaggtcctttgtgaggtctgcccctgtgaggtctgctcctttgtgaggtctgcccctgtgagtcatggaggccaaggtcctctgaggtgtggagagtggacctcatgtgcccagtgccttagtaggtctgggcagccccgcatctgggcagcatggtccctctcaccctggttggtcataggaagggtggctgaggaggaggctgtgctggaggctggcatggcagtgagggctggctcttaggctgtggccctgctccagacagggctggtggggcctctatgtagaacagcgccatgttcctgaccatgtttcctatgccctttcctgctgctatttttttccccttagcactcgccacagcgtgacctgctccctatttgattcattcatcgtatgtgtttgtgtaagctccatgagggcagggacgttgcggagtcaccattgagaatcgccacccagggagtcgctgtggagggactgaatattcgcagacagtcatgcctcagtggccctgtccagccccttttgccctagggctgagctgtgtgctcgtgcgctgcagaacccctgctccagctcaaccctctgctcctaagaggttgtacctttgggtccccagagatgtgtctctgggcctcaggtttggccaccaaacacaaaccaccctcaggtggatgctaccagctgggccccgtcaggcccaactgtgggttactctcaagccagaggcaggtggacagatgcctcgggctgacgccgggccactcagtgatgcaatgtgactcagtggggcctttgtcagacacggggattcacagagtgatgaccttcagaggcatgtctatggaaaactgtcctaaggggatgagccaagaccctgaaggtagtaaaggaacatgatgatggtagagtggcctttccaggtggcccctgtgccccaagatcaaggagtggcctctcaggccagtagaggagctcagggcaggggaaggcaccaggcctgggtagaagtccagctctgcctgtgatggtgaccctgcgaatgctttccactctctgggccttccttgcctttgagttggaagctctgggctgggtcaagtgtacagatagtttccttccttatctcaactctggagtgaccgtccaaagcatgctgtgctgaagaggattctaaggctgtgctgcagcccagagggaaagagtcatggtcgattagtgatgtctgcagcgggcacgggaggcaggatttagatgagcttgccagtgactggtgaacctcaccactgtaccccctcctatctagcagctttaacccaccctatctctccttacatgccccttccttagtgacactgatgctaaccccttattgggaaggactggcctccgtcttcctgagtcccatgagcagctcaggtcattgcttgctgactgtctcttctctcatttgatgcctcactccctgtagtgacctcagggtccaaccccatgcttcgttcatggcagcctctttctgtacactgaagaatgaataagtgaatgagtggtagagactcaaccactctacaaggccgggagcctcctcttggatgtacacctgatgttgatctctgttccagcaaggagcccctagaagccttcttggaattgggaggctggatggccacggaaacaaggtgctaaaccgtgtggtttcagctccaggtgttgcaggagtggggtcagcaagggaggagggggcaaggtgactaaggagggctgaggcatgtaaagtaccaggctctgtgtttgtggggcccggtggtcctgtctgaccttggctatggagcagctaatcaggcttccccagaggcaaagctgggaaaaccttccaagctgccaagaggggccttctgaagacccttctgactatgggtgggagaacttggcacctacagccttcaccctgaccccagcaggccctgaccccctgtgaactggtggtacctcacccctactcctcttgcacccccacactagtggccctacccctaactgtggccaggccaggggaggagcaactccaccatgagggcttggccctcatgcctcctcctgcccagctctgcatggcatgtccctctggccttagctgccccagctgcatgtggcctcaggccagccccacccagccctcttgcttcctgtggccctgtagagtggctaccaggacccctgctggtgagggcgggtgcgggtggcctgtctccgagctgggctttcctccagcatggtcaccccctcacccgctcagttacctctgatatgctgtgcaaacatatttctcgatgaaatgctgggaagaaaaataattagagtgttgcctccattatccaatttcggattaatcaaactctctttgtcctcggccaaaatctattcatttcccttaaacactgggccagtgccaggcattgatttcctctatgataacaccacgcacgcaagcacagccatgcccagccttgccccaccccgtggctgggacacagaggcactggtggggctgcccttgtccccccaacactgcccacctcctccaaggagtctcctggccacactgacacccccatctctgtcgtggctcctggagtgcttggcctcagtctccagtgtgtttgtcttgccacgctggctgttctggggctctccctcctcccaggatggtgtggaatggatagaggaggtgtggagggtgtggccactgcggtccccagggaccacagggaatgggctgcagccccaggctctgggtgggccagggtttgggggattatccccatcactggcacaggaagaaggccaagggggagggccagggcttctaagggggctgaggggccatgcaatgtatgtggggtgggagcacacttgcaggggtagcaacagaagcccagccccaaagggcttacaagatgaggggacatcctggctcccgggcctgagggcttagtagtggggcagcatcaggatcggccaagtccaggtgggcgggggctgtgcgtctacccgtgtccacccagggaaggccacgggcctttccagaagacctcccagaagtccccaactatcccctccgtgagccacgttgaccgattcctcactcagtcactacgagggcctgggattgatttattggcacctgcttggtgctaggtccttgtgggcacatgggatacatcaatgaacaaacagaccaacagtccctgccctatggcacagtgggaaagaggtgggcgataaacactctaagtaaattatacagtgtgctagaaagggaccatgcttggggcaaggcagcacacgtggtgtggctgtgtgcgaatatgggggtcattttccatcgtaaataggatgggcagggaggcctcctaaggaagggacatctgagccattggatggggagagggcgcggaagcgaagtccacttggctttctggacaaagagttttccaggaggaaggaacagccagtgcacaggccctgagttaagagtgagggatggtgctagagaggcagctagaggcagcatggcaggagtgggggagggggagcatgggcgtgggagtcagagaggccaggcattgcacagccctggtgccctggctggactttgactcggggtctgcccatgtcaagcaagcgtcgggagcaaacatgagaaggtttcaagcacaagtgagacatactctgcctcatttttacaaggatgcccctggctgctggtggagcacagggcacagggggctggagacagcaagaccagagaagtcatactgctgcaaaacagatgagaggctggggctggctagcgggagtgagtggtagaattctggacagtcagggcaattaagggttcccctgaggctggctgggtccagccacaacctgtggtgccagcctcagttctcaaggaaagggacgcagggaaggcgtgctgggcatgtagtggacaccactcatgcccctaggtccccaaggtaggggatgggattgtgggatgccacacatggaggcagagggcaggaggttgcagggcctcaaagacccagaaggtgaaatcagattccccactcaagtgagggtttgatggagtcagcagtttccttccctggggaaactggggagccaggagcctggggctacggctctctccaaggcagcaacctctttgatttggctcttaatgaaggccccacttcttctctgctgtcatggccaccctctcctccataggtggaacctttgcatattgatttatttatttactcctggcccagagaaatatctggcttgatttcctcctgagtcagtgttcctcaggcgacactatcaccctttgtctggtcagccgtggtggctgtgggccaaaagacaggacaggtggctgagggtgtccagagccaggacagcacagggttacagggaagggcctccctgttcatctcatctccccggtcatctcatctccccttcctttagcagaaggacactgggaggcccagccggggcatagcctggggttgtctgtaggatggggacactgtgttcactaaccgtagtccttcctcccatctgctcggactatggcttcaggataggcagagagctttgaggaggcaaagaaaggaggacctgtttctaaggtgagacccgttgcggatctgcaggtgcaaggcccatcaggcaggttgtggggagagtgtagagaagccaacccagtggcctgggccctggttactgtggagtggctgcaaagagcccacaaacacggagtcacatgtcctcaagccatgaatcagtgatgtctttcatgtgcgtatgctctcatttttcaaacactgcaaaagctattgtgataaatgaaatgcagagtcatttacaagccttgaggaaatcttggcgcgcaaaaaccctttttacctctgtcatcagcactcactggattaatgggtgctctcccttctcactgtaaagcatgctggcttgtgtcagtacagggttggccctccagggcagcgggcactctctagaacccccttgcccttccacatgtatccctttgagtccgttgtgattgtcccaaacctatttgtgccagttgtactcattgtaatcacagcctggaatactgtgtaaactggtgggctgtgactgtatagagggcttctgtggaaatgaaagtggttgctttggaaaagcctcagtaaaagccgtggttaggtttggtgtgggcaagccaaccacgagtttggggacaaggagtataacagcctaaagttcagattccgggtcctttgccacctcacttgtgttggaaaaagtaaacgagatgtcacgcaaggtgtgctgtggtttaagcaagaagtggcataaccccagaaccggaaactctgatttaggaagagtttgtgtctctgaaaattgacagatatatgaatgtatgtttatctgagttaagtgaaaataaagtacacgtgtgtcatttcttaggtcttcctgctttaattcacttttcagtagatcagccagccagcagtctcaggtttgattgcaacttttagccatcaacagttattagaaatatatgttataggccaatcaggttataggccaatatgttataggccaatcaggttcatgcctgtaatcccagcactttgggaaggagacgcaggtggatcatttgaggtcaggagtttgagaccaatgtggccaacatggcaaaaccctgtctctactaaaaatacaaaaattagccagccatggtggtggacacctgtaatcccagctacttgggaggctgaggcaggagaatcacttgaacccagcagatggaagttgcagtgagccgagatcgtgccactgcattccagcctgggcaacagagtgagattccatctcaaaaaaaaaaaaaaaaaaaaaaaggccaggcgcagtggctcacgcctgtaatcccagcactttggggggccgaggcgggcggatcacgaggtcaggagatcgagaccatcctggctaacacagtgaaacctcatctctactaaaaatacaaaaaattagctgggtgtggtggcgggcacctgtagtcctagctacttgggaggctgaggcaggagaatggcatgaacccaggacgcggagcttgcagtgagccgagatcgtgccgctgcactccagcctgggcgacagagcaagactccgcctcaaaaaaaaaacaaaaaaaaaaaacaccccagaaatatatgtgtaataatgtcggaatctgcaggttggtctttttcgttgtgtttttttgtttttgtttgtttgtttatttgttttgagtctcgccctgttgaccaggctggagtgtaatggcgcgatctcggctcactgcaacctccgcctcccaggttcaagctcctgtctcagcctcgaaagtagctgggattacaggcgcacaccaccacacctggctattttttttttttttttttgtatctttagtagagacagggtttcaccatgttggccaggctggtcttgaactgacttcgtgatccacctgcctcagcctcccaaagtgctgggattacaggcatgagccaccgcgcccggcctcgttgtgtttttttgtttatttttgttttgcatgtgaaggatcattccataatacttggaaaggttgtaaaccaggagtctacaacagagccaaggccacaggggccaagtatgaggaggaggctgcttgatgacactgcagaactcccacggcaggccagcctggaagcccctctttccccaggactaggattcacaaggcccttggagccccagcccacccaagcggaagagtccagggacaacctgcagggaagtgtgaggttttctagcataagaggacatgggggatgggcctgaggaccaggagatgctggtttcacagagctgaggctagctgggctctcagcctggggtgtgcagagtccacagtgtcttccccccaaaccttgcccccagaaactcccattttaattcaataaggtgtgaagtggtcaagatcatattaaggtggggcgtgagctggctgggatgggaaagggcacgtgggagactgggagaccaggcaggaggctccagggaagttgggagagtgaaggaggagggtgggcaggagaagtttcaggaagaggactctccacacagacagaaggaactggaaaccataccaaaggaggggtccttaggggctagcctgcagctcggagaggggcaggtgtgatgcacatttgagaaatatttgtggaaagcagaagcaagagggctgtgggaggcctggggtattgggggtagtaggggagggtagacccaggcagaggggtcccaggggaatccagtagagctggcccacagagtcccagggatatcacgggctccaggaggaggccatgggtcagcagcgacctcaggtcctgaggcctgtggactgcagggtgacccctttgcaggctgctgggaaaggtcattttaggtaatgctctcaaaagggagtgctggggaagcttccgagctctgtacaaatattttttggtgttcctccatctatccatccatctgttctgcgaatctttcacagagcacctgcttcgagggaagcagagctggtgcttgggggagggagggtagagcaggagcccagaccaacctgcggtgggtaccctggggaaaccacacacaagccattggaggcgaaggtgggaggaggggatatgggccagatgtggtcagggaaggtgcctgcaggaggagccggcagccctgaggctgaaaaaggaccagtttgtggggcatcccttccatttcttccccaggggaagtccagtcccactgccgaaccagcggcacaccacacctgttcaaggtcgcgcgggccaggtggcaggcccagactgagtccactggggttccagggatcctgatgctgcagtagtcaggggtcctcatcagagaaggaggttctccctgggcttcacagggctgtgttttcagccaggtggggtggaacagggcactgtgagtgtggtgggtgggagatgcagccagagaggcaggaaccttgcttcttgtggagttaacaaggagggaggggtgagctatgcaggcgatctttccccagagggcagttcctgggagggtagcttgtccctacccatgtccagtgtcactggcattaaggcaagtggggtttttatcttccccggaagatgtggctttttagtccaaaaatacaagcagtccccaacttaggatggtttgacttgcagtttttcaggttatggtgcaaaagcaataaacattgagtagaagccttactttgagtactcatacaaccattcattctgattctccctgtcagtacggtattcagtaaattccacaagatacgggttagattcttttgtctacctgcaggctaatgtaagtgttctgagcacatttaaggtaggctaggctaagctgtgaggttcagcaggttgggggaagtcaacacattttcaacttaggatgggtttatcaggacataaccccatcctaagtcaaggagcatctgtaggtgttgtatcaaaagccttaaaccatcaggccttcttgcagacagccacactggccaggatgaagcagcatggggaagccttgagcactggatgtgaacatatccttgctcatttttgccttcatccccacctggtcctgagcacctgcgcttcgtggcccatgatgcaatgcagccttgagagctgcagccccgcccttcactaccccaaggcccagtggggagctggacagagagccattcagtggggatgccacagacagtgtcgtgctgggaaggcagggaagtcaggtccctgctctcccagatgagtgtgggcgtggacaccaaccctggctcacttgccagaggacgcactgtctgcggttttgtggtcaccctaccatcgcatgtccaggtgacatcgcacgtccaggtgccattgcacactggaggttatgatgcagaagtgctgctccaggaggccataccaacccccatcctgtcctgggtcccttggggccacctgccactaggtggggagcctcatctggagcccctgagttttctggaggcagctctcaggctggaacccccacctcagataggtggacatggtttccaggcagcttctccccaggctaagcccgtctgctgcatctgcggggtcagctctgggaatcaccccaccccttgatgtcctcagcgattcctcactgctgccattctacatttttctctgtgtcctcttctccatggtgctgagctttatttgaaatggcctggctgccttatgtgctcaccatctccccagcgagaatacaagctccttgacacacagactcagcttgttccccaccatgtccccctgtccccaagcagggccacacacagtggggctggattctgggagagcaaagtattgatcatagcaggttgagtgactgatcagttgcccatacagatctgagggtggaaggcctcaggcctgggcgcacgtgctgggtgatttaggagcaacgggagaagcagtggaggatgctctgctgagcagacaaatggaactgagccagggagagggtgacccactttgctgagataagagatgggctccagcctgaggacaaggggtgcagtgtttataccacagcccaacagcctccatcccttcaacaccagtaccagtgcctccgccctggttgtcccagcttgtcccagcagagagggcctctggccctggttccccatgtaccccacttgtgtccccaggaggcacgggcagtggggacagagcagggggctgcaacaccatcgaaccctaggaggtggcctaaggccacagctatgagtggcactaacccttccccagaggaaggtaatcctttttgtttctctctcaatccttctccttcaaggagaaaatcccagtttggtgccaacgtggctctcacaccctccagcaggcgctaatccccgctgtttaagcaacagccagtggccttgcctggcccctcggcagggtcccgcccctggctagtggcagaagcggttcctctacactgttttgtatttagattacttctgtctacggcgggtgaccctggctttccactgaaagtaggactatgaagtcattatgaagtacattttttaagtaaaaaaggcagtcaatttaaagaaaaatgctgagtaaaaacagcaagtgatacccaggtgtggccaggttaggcaggctgcagtcccgtggggcccagttggagggcttggtgggagcagaggcctgcagactcccagccaggccaccccgggaaatcacctccatctttgcgctttgatttctacagccgtaaagccgaggccacctcccaggcctgcttttagcatgagatgacgtgtgtgagcaaagcactcggcccagcagtggcagcagacggggtggcacggaggtgcagctgtcccctgcgtgtctccagccacgggcctctggacctaggttccctgggcaccttcctctcctcccagtggcctcagccacccgagcaggcacactatagttgaggaaagcacagcagagccacagctgggacccagagtcccctccctgaccccaccatgcccagcttccctgagaaagaccctccccggggcccagcccacagttgcccctgacctcccatgaagatgtgtggaaatggctccatgaagagcctgtgaggacactggaccatgaccagaccactggagagaggggaaatgcagtcatggggctgcagcatctgtggagcccacttcccactgggtggggccagcatgacaggattgaaggcagtgggacagaagaactgggcaacacaaaggacacctggctcctcagcaacagagagctgccaccgaggaggcccctacaggtccaggccaggccctgggaaacccatgatgggacacatggctggggcaggacagggagtgtgcagcttgtcagctggaagcacatgcggctccgataagtcgggcgtaaaagggcagtggaaagtgcttcctcattcggcgaggaggaaacctggtaatctgcaatggccacaggcacaggcttttccagaccttcggtttctaaaatagtatcatggtgggagctgatgtagggacggcggctccagagttgggggcagcacccactctttaagagatgatagaatgagcatggtggctcacacctataaccccagcactttgggaggctgaggcaggaggattgcttgagcccaggagttcgagaccagtctgagcaacatagtgagacccccatttctccaaaattaaaaagattagctgggcgtggtggcgcgtgcctgcagtcccagctactcgaggctcaggtgggaggatcgcttgagcccggggggttgaggctgcagtgaactgtgatggtgcactgcagctgggtgacagttaaaataagataaaaatgcctcaattgagcttataaccgcccaaggggttcaccttgcccgctgcctagacagagccgattcttcaagacgagaattgcaatagagaaagagtaattcatgaagagctggctgtgcaggagaccggagtgttattattactcaaatcagtctcctggagcattcaggaagcaaagtttttaaggataacttggtggatggggggtagccagtgagccaggagtgctgattggtcagagatgaaatcatagggaattgaaactgtcttcttgttcagtctgttcctgctcagtcagttcctgggtgggggccacaagatcagatgagccagtttattgatctgggtggggccagttgatccatcaagtgcagggtctgcaatatttctcaagcactgatctcaagagcagtttagggagggtcagaatctttagccttcagctgcatgactcctaaaccataatttctaatcttgtggctaatgtgagtcctacaaaggcagtctagtgcccaggcaagaaggaggtctgctttgggagagggctgttaccgtctttgtttaaactataaactaagtttctctccaagttagttcagcctacacccaggaatgaacaaggacaacttggaagttagaagcaagatggagtcagttaaatctctttcactgtctcagtcataattttgtaaaggcggtttcaagcttggcctgcaggttcccatactcacgcagcaagtcaagtgatctgagttatatgaaccatctacacgcccaaaatgtgggttcagggtaccccagtgcgtttcctcctgctggtccctgcatgctctgagctgtgggctggcttggggttggagccttacccactctgccccacatccttgtgtgaggaagggcctgtggtcacaggcatcagtgagcctggagatctgtcactgcgcgggcctcctccctccccagaccagctgctgggtgccaaggtggagctggcaggtacaggagccgcggctgcctggataaaaggcgtctcagcaaactggggtcaggatgggggtggggcagtgctgagtcatagccccgcttggggcatgccaggcagctcagcctccacaggggactccaggacagggtgagtggcaggtaggcgcaggcagccctggggtcagctccggtagggtggaaaggacttgttggtctgaaatgggttccatgactcctgttgccaccccaagcctgggacagtggacaccactggtccccacattgaggctagagagtcctgcaggttcagggtgtgtggtaggtatctggggagggctgggagcccatcgggcattaggggtgtggccttgctctcccttgctggccctgtggcctgggctgcctgccacctcttggggtcctagcttctgttaccagcaaaggtggccatctgagtggcttctattgggcctcaggcatgactgcctgtgcctctcccccagtcacagtctgggtacagttccgtctcctcaacaagcctaaactatctccctgggggcagggtctgtgtgttgaaccatcacttcgtcttggctcactctttccgtcgcccaagctcagcatggggcaggctttcctgggaggtgaggagggagggaggcaggtagctagggacctggagagtgaggggctggactgccgtctctgaggaagtcaggcacagtgatgagggagctggtctataagctgataagtcttcccgcccctggcttagccggcttgggcagtgagaccttcggtgaccttggctgtgggctgtcttcttctgcctcagccgggggcactgactctgtgctgtgctggctgttgtggaggaggccttgagcaaagctttggggacagcctggaggttacgggcagggcaggctggctcccatggcctggtgtggtcctggcgagctcaggctatggtgggtgtgaccatgggtattatgttgccccagctctatgcctagcagcaggctgagcctccagggattgtgcctggggagggaagtggttcctagagtggagggcatccaggatgcaaaggtcccaagagaggtggcagcactttccctccatgaccatgtacccatcctgactcagggctatcactcaacatctgttacaggaacagacttgagagggccacgtctggaaggagggtgatgagggcaggccgggcctgctggacggtgggtgagaagggagggtcttgagggggatgtccatgtgtgggctgaaggatctgtcccgaaaccacaggaagcaagcggccctcagcagagggttcctgagtgggctcagggcttggagatcgtgccttaggaatctttgggtaggtgagtcaaggaccaggatggagctccttaagagcctacagccaagagatgctagtttcctgaggctgctggggaggaggcaggcaggtgcagactctggcctgagcacagcccactagggcttcttggcctctggctgccagcatgtcgaacctggtgcctggccctatgtcgcactaagtcctaagcgacctcctggtgaatttgccacacccttcacgctgcaaacactacacatctgctgggggcgggggccagggactggatactagctggtgttcactgatacagtccactcatctgtactgagccctggccataagcacagcagggtcctgtaccacagggacagctgacagtccccctttcccagtacctgccactttctcctaatatgtcccctctccaagagcagcccctgcttcagcctactggctggtccctggagttccctgatcgtctccctgttcccacccagccgccactccatcaccaggcactgtgcaccgtacagctcacacatcttgcagagcctcactgcatccacttcccccagccctcacctgtgttgctccccttttatcacctggatgtttgcatccaggagcctcctctggtctggcttcagcgcagcagccagagggatgctggtcacacagggcaggtcatggcacttctcacccaaaccctggctggctcctgactcgcccttaagtgacctcctaccctcttggcaccagccacatggcctccttcctgcccctcagactggtcaggcatgctcccacttcagggcctttgtgccggtggttccctcatccctgatgcctgcttgcctccctccttcaccacctgttcatactcatctcttaccaggaggccagccccacccacctttgctgacttgcagcccgcatgtgccacccccaaccctgcccacctggagctccatttccactgtagcactgggcaccttctgccacttgctgcttatttactgcctgtagtctgactcctgccctcccacctgagcaaaaatagggaatagatcttcatctgcctcattcagcagccccagcccaagtgccagaatcaaagccatggtttagcaagtaagtgtgggatgctggagagcccctgacccatctcccttctgccccagtcgcctcagcctagctccacaccacagctggttcctcctctccagggcatctctgctcccaggatgccacatgcaaccacatgcagatgcccacatgcaccagtacacatgcagctgcacacacgcacaaccacatgcagacagaggcatggacctgtgcatgcacacccaaagatgtgtacatggacctgctcacagacatgtacatggatctgcgcgtgcacatgaacagacacatgcacacactggcatacaagcaaccagacacagacacatccatgcacctgcactctcacagacacaaacagggacctatgcatacacgcacacataccgcaatggacctgcatacacataggcacctatgcatacacgcacacataccacaatggacctgcatacacacaggcacctatgcatacatgcacacgcaccacaatggatttgcacacacacagggtcctatgcatacacacacacaccgcaatggacctgcacacacacagggacctatgcatacatgcacacacaccgcaatagacctacacacacacagggagctatgcatacatgcacacgcaccgcagtggatttgcacacacacaggcacctatgcatacacgcatatgcaccgcaatggacctgcatacacactggcacctatgcatacatgcacacacaccacagtggacctgcatacacacacacgcaccgcaatggacctgcacacaggcaccacatactgccacaaacatgcaggtacacacatggcttaaaacctttcagtggcgtcctgtttctcttcagtgaagaccaagggctcagttggacttctggtgagccctgccccttcctcttgcctggtacctctctcctcctctccctcagtccagccactctgaccttccttcagttcccctttgtgttagggatggtttgtccctttcatccctaacacacatccccacacaccgcagggccttacagcatgttcctcctctgcctggcacactcttttcctggcccattcctctggtatttctagccatgcccagaggcactgtggtggggggtcctgggtgttgagctctagtgatccatcagtggtttctgggccagggaacaatgtggtcatcaactcttggcctttgtctcttggccaaccatcatcaggttccatcctgggacttggggagtcctagcatgtccagtaaagcccgggttagactcagagagagggctggctagagccttgtgtaagagccaagaagtcaagcctcagaataggtgggactgtcataaggtcccatttgaaccacagccaggctcccaacgcaaggcttccttacatccgtgcacagccctgtcccatgcgtggtgcccctgcacagggcgctcatacccccaaacacaacacagccccacagagccgcagggagaattctgggtggggccttctgcttgtttggttcaggtgatctgaaagacgagggtcctcaagcaggggacctccccttggttgtgactgttcgtcactgccccatgcaggtgacagacttggccctgatgcatgtgattgctacctggcctcagtttcccctttccttgcacattgccctgtcgttgccggcgcacactgatcgaagactgcatgagcagcccttagctccaggcttccagacaacagcagttcagggcccaggctgccagcccagtgtccccaacctgctctcctgattccccagccttggagccagggagcacatacatcccaaagcacaaatcacacatccttggacagagcagcttctctgcccaccactggggacagaaggggcgcctggctgtacctcagattttcaaacgtggaattgagaagaacagtcatgacaacagaggacacctcccactgggttggacactgccttctgaaaggagcatgttggcttcctgctggaatgatggtgctggtagggagaaccctgggtccccaggcagtgggctgagggctttggacacctttccacacctaaggggctgtcaggtcgtcagcagggacaagggagcagccacagggtctccatcctccatgcgctcatggttcgtgtgcatattacacatatcatgtacatgtcatctttaagcagatgttctgcccactgtgtgctggagtgggagggtcatctcaaggcttccattctcagatgtaattttcagcctcactgggattgggctgagtgactgtttaatcactgccctcttggcagagatgtttctagggcgttccctggtgcacttctcatcggtggctgcctggtgaagcgggaaagttcctcagcctctccattgattccttccctccctccctccttccaccaaccagtgcttactgaacacccactgtgcactgggcactgctctgttcccagtggggaacgaggccaggacgggccctcctcacccgcactctggctgggggtaggggcgacggcagcacacaaggtcatgtaggtcacacattagctgagggctgctatggaggaggaggacagagggcaaggtgacgctcacagcgacaagcacagcagggcagtgactgctactggctgtcactctctgaggaccaggcttgtgctggacgctttactcttcacagatacctgtggccagtgagggacaggctctgagatgggagtaagtcgccagaggccacacaacctgggagaggcaagcaaggcatgaaggatgagaccaccctgagagtggtgggggtaatatcagggtctgaccaagggaaagaggcggcattagagcctctggctgtcagaggctggcagggctagggagcaggtgtgagaggccaccaccactgccaggagagaccagaacctctgcccagggagaggacagcccaccaggggcctgcttcaaagcaggatcgccaggactagtggtcaaggtctgtgaggggcaagggacagtgaggggcacggatggctgctgggaggatgaagtgccatttgctgagggtttagcaggttgagtttcagatgctggtcacacccaggagttgagggtggggccttggctgttggggtctctctgcctcgggccttcccaccccagggcctgtcacagagttgatgggtggtattaaaggggcgaatgctgcctgtggcaggatggggaggctgcgtgggtctccggacagggacataggtcagggaaggagcaagaggggtgcgtgtgagttgggtggggcctggtgccaccctgggctcacagccggggaagaagcctgagctttgagctgcccctcgtgtggggaggcctggcctaagcacccggcaaagtcacaggggcatcctagggtgtgcccctccctgctggcaggaaaggtggatggggaggccctgactcgcggggttggtgaaagattctgcctgaggcctctaggccaccctgccttgccctggcctcggtgattactactacccttgggagccactgtgacatctggtctcccaggtggatttccccgcagcaccacgtgcagcccccagctccttggtctcagcccaagcccccctctacctccttctgcaggagtgaggcagcccctgcccactgtgcttaggcacctcacggtgctcccacagcctgaagcctccaccttgctctggtccctgcctatctgctggctcctgggctggcccatcagagtgccctcaagggaaagcaggggccaggtctccctcctggtgcttttcctccctgtgatcagaagtgacccagctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccatggtgtgggccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacagtaagtggggccgggggttttcctctgcttgttcctgctgtcgtgggttcctggaagcaagaggactcgtgaggtccaggacagtctgcagccagaaagggaaccaggcgcaggcctggccctgctgcacgataactgaggcagctccagcaaggtgggggcagagggaacagggtgtggagtgcaggtgtcatgtcccatgcctgaagtactcagggtgtggaggccacagggcaagagagtgtgaggctccgccgggcatccatgatcaatccatgtgatagtttggcaaatccatgaagctcctgccagcaccagtctcctaccagcatataggtccaggaacagcagccacccctgcaaccccatcttgagtctgcaaatctggcagagatggggttaagagctgtttagaagggataatcccaggtcctggtggaaaggggacgacgtaaaagcaggtgttgggattctttcacagtggcatgggcgcagcccgagggagacctggacccagtgtgaagcggtgggggcttgagagtggagttgctggagagggtggggagccgggtgaagcagcagggcagtgtgctgaggcccagccaggacagaaggtctagcacacgaagggggccacagccaggagtggcagcggtggaggccgtggcaggcaagggaggggctgtcttgcccagcaggattccctgagcacagatttcaagtctgcccttaagagagaggcctttgaccctggggatgggggagtgggggcaaacaaggagtcacgaagttgtgggtaccctggggctaggggagggtgatgctgggagacaagggctcagcctctccacttgggagcactggcctccgaggtcactccttgcttcacccagtcctaaggcaagctttattctttaggttcagcggagagcaacaatggttctagctttggacctgtgccccagccagggaacctggacagctctaggcagtggccatggtgctaggagcctgagtgttctgagagagaggatctttggctttcctcaggcagctggggaggcgggcttgcctccctcccctcctcgcatcaggggtctccctggaactgtgcctaggtgttgatggtgtgcctgggggaaacgaatgacggacgggcaggcaggtgtgtacgcaggcggctgcgtccaccctgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcctcacccatcaccacagtggcaggcgtggcaaattccccgggcaccaggcctggctcccagttgcatcctttgacaggccgtgcccacaggtgtgctggacacaggaggcaggatacctgggtcctgagtcagtccagtttttcatggagggctttggctgtcatgtttgctttctgaacttgtcagtgaggagatgacccaggtgtcttcacagatgggcccaaggctaggcctttgcctgcctgcagccctcttggctcttactggcctgtgcctgccaccttgctgcctctctctcctctccttctgctctagccgtggtcagcttgttttgctccagcagtactgctctgtccagccttaagcttgtaatgatcctgatccctgcctctcgtacccctgcccttatcctccaggtctcatcccaagtggcgcctcctgggaggccttttctgacctagcccggcacctgcttactcctccatctagtgatgtgtgagtgagctcctcggggcaggccctagatgggctgggtggcccctgtggggcctcacatctctagctttccctctcccaggcctgtccctggggagagccatggtgggcagccatgggcagggacagcagccactggcctggtctcagggatccctgtgaggttccaggcattcaaggcactttctaaagggaggggctggcagccaggctggcacacccaccaccatcaccctggtttctgcaggcctggggaagtggttgttcaccagaaaaggaaattcttgatgagaaacccaagcgaggctggaaattcactggattccaaatgattctgacctttcatgctctaccagtaatatctggagatggaaaacaaacaggctgcagaggaaagacaatcccctcccgcgattcctcccgcaggctgggctggccccggaggtgagctggcccccagagtggtgccggcagtgaggacagcccgtctccagccgggccagggccagagccagtgctggcacgggctggcacagggctgccactctgctctctccttttggaacgtgctgaactgtcctccctgggccctgtcaaaggcaaggcagccaagaacaggccatgctcgttttcacaaaagccgaatgaaccttggggcccagtgccagggctctggacacggctcctccatagccctccttccgtgctcagcttccaaggcctcatcttccctgatgctggcagtgcctccccacccccacgcctggcgaaggagccacagccccccggcccacccgctggcttctgcgtcagcacgttgccaaggagaacgtcagtgtctctgggctcccgggtgtgagggctgcagtgagtgcagggcagcacctcagagcagggaaggcagatttccgggtgtctgtggagcatggcagcgagccacatggggagccacgcccctccatgcccacggttcccaccctcgtccgaaggaattggcagtcccttgccctgactagggccaagtcctgcaggtgtgtcaggcaccccagtgcccccaagcccaacacccagctggggcttcctcaggcagcacaggaggcctgaacacagcccagcaacacaagggggtttttctggcgcacctgtcccctgaatgatcctgtggggcagcagcgcctgttatttttgtcacagatcgaggcactgaggctcaggcacacagctggcgctggcgggcccccagccctcaagtccacaaggacagctcctgagaggccatgtgtcacaggacccaccacgggcctcccacttagccagagccatggcagaggctctgcccctcgtctttagtacattcacacaagggtcagtcagcaaagacagtcactctgctgccctaggagggaaaggcaaagtggagaagctggcacctaccagcccacactgagggacagacacaggtggctgtgaccagcagagcctgggtcttcactcggccccactggaggcacctgagggggtaggtgggcacttgttgcccaacctctgcccttgcggatcagctaatggactctgctggccaccaaatggtgtgggatccttcagaaggcaagattaaaaggtctagttgtaaagcatcaaatgttctcatgtggaaacccacagggagctcactgcccatttcccgacggagctgtcagcattcccagccctgtggcgggtctgttttgcacctgtgatggacctgctgtgcaggctcaaggctcaggctggggccaagtatgagggtgagcacaactctcccagcagcacagggaactgggggacaaggaggaggcagtcacaccagcccagctacagcttcatttccacaaagcctctgctaccagggatacctgccctgtctttctagagctggcaggcagcagttcccagcagtgtccccattgtgctttcatctaggacccacagtagtcacttgggccccacaggcaggctgggtcacagcagggttcaccgtgggaggcctggtgtctctgccacttatctgagagacagctggtcaacatgttatcagtgagggtatccaggggacgggggacataagaacatgccttttgtggggcaagttctgcaggtggcaagtgcttgagcagccagcctccaggcaggtggtctatgcctggccctggatagtggtcccttgtcctggggccattggcttcctgaggaacccctccccactccagggcaggtcagcagcctcagcacaccacgagggcaggtccacacccacccggcacagcctgtgctctgagcagagggcctggcacacagtgggtgctctgcagactttgtggagcgggcgggaggcggtaggcttgggaagagctggagctccagagccctggcttctgggtgcagagcagctgggacactcagcccttcccaaggagaccctatgggtgctggtccataacaggagtgtatgcagtaccctgaggaggggctgcccaaggccgtcctgtgaacacagcgtgttcctgccaccctagcgctgtggtttatcatttagcccaaaaagggtgcttgttttagtgcttttaaaatggagtttaaacatttgtgccataaaatggcgtgttgtgggtgaaacaaggtgtttccagtaagacaggcttatacctattgatgacagagctggttatatttgcccaaggagggaattacaaatgggcaatagccagacacagatgataccctctccccagcataccagggcttagattgagaagggaccttatatatcctttagtgttcctaaccagccggctttgcagatgaggaaactgagcctcagagaggttccttcacataccgcagggctgagactctggctctcagggagggtcctggcactggcccctgggaattccagtggcccccctcttcaccatactggtcccacatcctgtgggtgctggggttctccagcaagggccttgggggtatagactgggttccacccttggagctgctgtgtagccagccttccctcaggagagtggaggacagtgacacctgggcttgggagaggtgagtggctgtgaaggttgacactcccctcgtccccttgtctcctggcctagtcagtggcaggaccacagggagccctagcagaacatggcctcactctgcctcctgttcctgacctggtcaagggcatagctccaagccagaaggcctgccgcccttttcccgacacacacaggtctcccaagcagttccttctgatcttgcaatgtgccagggccacatgcagtttgtctgcagcatcctcaagttatcatgaccctggaacagcagagcctcctgaccagatccagaggcagggccaggctggcacactgggctcccaaggactggacagcccccatggcagtgcagcttgagaggctccacaggggtgggagacacagaggaccaagcccacagcagcaccctgatggcacctcgcatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccaggactcagccttaactggggctgcggccacctcagtgggccttcagccgctctgagcctgtggccagtgctcagtgaatgatgggtatctgctcgcctagggtcccaggctttatgcgtgaccccatgggatgctggctcaagcccaagatgggagggggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgctcctttcctgtcacactgggagcttccaagggtggggccatttcttagcccgccttgtgcagtggctccttgccctgggtaggtccttggtcagaggtcagccacaaggcaagaggcggcagggccctgggctcaagccctgctgcttgggctgcccccacacctgctctgcctgcagggccttttcctttggcccccaactcctcatcatcatgaacctggtggctctgtcgttcagtgcatcagccacccctccatgatggtcacctcctgctgtgtcactagaggccattcccagggcacaagctgtcactgaacacagcagtgcagcagccaggaggccaaccccatcactctgtctcttccaccatgatgacgttgtcaggtgccttggcagaacctccatggggatgcccatggtgttcctcagatctctcagacaagtgttcctgccacaacaggaggtcagccagcgtgggctctgctggggcctcctttatgggaaggcaggagtcagtctcttgccctagtgctggtaagccttgagggaggagggaggagagaacaagagagttctcttcggcaccatgccaggcagggctgcttcctgcagaggagagtgctgagacccagggctagtggtggcagagcctccctctctgcatgccagggcagtgaggggctagagctggctcatactggctcacaagagctaatttttcaattttcaggatgtttgtgagctgtttgacattatatttgtggcttcaaagcagccaggtaggagtaatcacaccccaggaactggcaaatactacaaaacagttctactcctccccagcccccgcctccatgccagttgttagacctttaccagtgcaccacagccagtgactcccaagcatggcggggagagtctgccagccaggctcagtcactggtgtatggcaggattgatccgctactgccatcttactgaagaacccgacagtgtccttgcctgtcagtctcccactgtgcttccccagtgactcccagctctgaccctgtggccgcgtgggttgcatctgttcgtgtttaccccgctggagaaagggaatttgccagagcggctcttcacttgcctgcctccctcccgctcttcctcggcagatttaagagaatcctactccacagagagcaaccttgcattggctaacacgagaccacaagctgggggccatctgatgttctccatctgagaacaagccctgtggcatccttgcaggaagcagtccttgttcacccagtatgtgtgggccctgggcctgacaaactcagtctagggacagaggcagtcctatcccttcctccctcaggtcagctggggatggcatcaagcaggccctggaggacctgtgtagccagggctggcctcaggctggcttccccagtgcctacaaatgctggccgcatgctctctgtgactggccctgagcctgccctaggaaacagttttctaggtgcagagaagccaggaacaggtgcctcctctgtcccaaagaccaacatttgcaggagagacgggggcctagacgttgggagcaggcctgcacagattgggatgaacgtgggggtggtgatctgatctggaccttgcagaatccagtcaaggctgtgggggagcagtggggacagtcaacaaaggcaggactgagggggctgtcgggggccatggagagcacagagctatgcacagtgccctgcagcgggatgacggaggaccaggcggtgtaaggtctaagcaggcagggcaaggtcgcaggcacagtgtccagtccccagtgtggcccagggtgggtgtcgctgcctgagcgccctgtgatgacggagccagggttcagccccaggactgtgtccctcccagtttatacacctcctgctctgcctcgtgatcaggctggatgctcacaatgataccctgtctgaactgttccaagagcttcagggcagagctgcttcccaccccacatcccctcaacctgcatcggctaggcttgcccaggccagtgggtaattaatttcctgagcgcattagctctgctcagtacacacacatgagaacagctctgggttttaagacacagattactattgttttaagggatttgtataatccagtaactgaaaaacaattttccactatctagaacagactccaaggtggaggctaagagtgctgggggccttgctgacttggggatccctagtaaccagtgtagatggggggatctgccactcaggggagtcctgtgactggccatgaacaagacaagcagtgaggacaggatgcagcagcaaggctctgtgctgaccggatgcatagccctcttcacctgaggccccactggctcagtctagtttctggagggattggaatgacagtcagctagggtgcatggccctgggcatctcaggggggacacccagtgttggccagggcagagtgaaaggtgtttcttctctctgcatgtggctcccgtctggatagtggacaagcttaggccagcccaggagcctggctgcagctcaccctaatccctgcttcatcacacctcgtggtggacatgtcctcagctcaggtactttctctaatttcattaataatgaaaccagagtcgactgggggccctgggccttgtatcctaaggttcccagcccaggccggccagggccacagccccacacaccttttcctggcctgtggtgaccaggggagaagcacagcagcatcctgaccaagggggcccagagcctcgaaggcaacttggctcagctggaggagtgactatgggcaaggtcctgccccacagggccacccagctcaagcagtaacaacccaaatatgtttttttaaaggatgaatatttttgaaaaccatctttttggccataggcagaggttccccactgggatctctccccactacccccagtttctcatgtccctcccaggaaagagcctgagcctgctgcagaggggttcacaagcccttgagcctacaggtgtgggtccgaggctgcagtgccagcggctaggagtgcagagtgcacccaccttgctgaacaaagcaaaggcaaaccaggcaagggtgtcggccttgggttcctggggatcctctggagctgaaactaggaggggtttctcacactgtgctttcttcgcatggtgatggcgtgcaagctcctggccaggcctgtgtctgtgttgacagcttccaatctacaacacacctgtatcatgctgtttgttaatttcccttcagcgactgacactggctggtggggagcaggggtgcaggttacttaaaagcagcaagatttaacacaaaaacaaataggagacagttctcagctgaaacagaagtggactggggctttggaagaggccagtcctcccagttgggcaggagagcttatggggtcaaggtgagagcaggtgggacccaggtgctgagggtgcccacggcctccctttctgggtctgggtgtgaagccagggagcaggacacaggagctccaggccctttcggagcaaatgctcccaccatcttggaattttctgtcccaggactgggagtctttgagcattgttaaggcaccacctccagtcacgtgactcccgccacatatcacacttaccctggggctctgcctcctcagcaactttgaccaacacccttgggaatacagaggctcccatttggacctaagaccctgcaagtcagtgatggttgagatctggtgagagcaaaaaagcaaaacagagtgacatgagggtaaggggggtggcgccttgggcctgtgctggagaacagcagccacccacctgcagggctggacaggggtgccaacatcctggaggctgcacacagacttctgggagagctctgcccagtgggtgaagcccagctgaggcatgagaaagtgctctgtgtacagcaccgtctccatctcacactgggccctggcactgtgggtggggccctggcctggctgtggcccagggtagtcatgtggacttgtgtccatctggactgcccaggtgaagactggcccagcagcacagttcctgagctcctgcccctcccctggctagtgaggaggtagggcagttctggaagtactctgaaggctcaggctgtaggataacatgtgtgtgctggctgacaacagaatagtggaaatggaaggcccagagacgtgagcggttggcagagcctggcgcagggcatgctggtgcactgcatgcacaacctctaagcctcccagcccgaaggggctccccaccacacagatgaggaaactcgggtttcaggaaaagttgtccctgtggcaaagtgggggccttctgacctggacatcccgctgctgcccaggggaatgggcagggctgggaagcagccacccttgccattactacgggtcaccccaccccctccacactgcacacacagggaaaccagggagggcagacaggactgcccaggcaaggtggcaaagccgaactgctgcggaaggcagggagcagcacgctcagctgtttctggcaggttcagagcaagggcttttcaggccattagggcctgagctagggctttagcggcagcctgttatcttgtttaaacagcccttgctgtttgaggtgccaggcttagctggtgctgttactatgagcactacagttgtcaccaggcatagttgcaggggggagggggccaccggcaagcagaggctctgacttctggactcggctggaacacacccctgccctggcccccatcccagaggagccccatctgtcgctggcctgggacctacaggcctgagtactctgtaaaatgggcccctcccaagctgcctgtgccctcctgagctgcctacatgggcagctgagcagccctgtgcgggtgggcaggagcggtggcctttcttatccccagggaaaagtcgagggcctcatgaaaacccagggcctgagagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcaccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtctgggtgtgaggcctgtgccccccgccctgatccagcccatctgtgggccaggagcaggtgcatctgtgcagaagggtggggccaggggcacacaggtggggagcagccaggcaatcccaacccctgcccctgtacacagctgccacaccaaacgcctgcagcatgtgccatctggccttgcctgccatccaccccgtgctgggcagagcaggggagagcggtccccaagcagacagcactgctcataggcaggccatgggcaatgagaacaggggccaatggtgctaaaagctgtgcagcaaattaaaagggttggggttgtgactagggcttacttcaagtgaaggagtctgatagctgaccagctacacaaacccaaaagagcagcccatgcagggtagcacagcaaaggcctcgaggtgacagagacggaagcaggagtcaggagacagccgggagaggcctggattacacagcctgccatggaaggcactggagggtttgcacagggggcaaccccagagcagaagcaggtagatggatcctgaggagacatgaccatggtagaatgggaaggagattgtccaggaggtgccctcatggggcagaactcagagccatagcccaaaactggaccctgcatgcaatgtcccagggccccagcttcctgcctcataagctgtgtcatggcctaggacctttcttcccaggcaggagtcagctccacctgctctctggctggcacagcctggtgctggccaccccaagtgttagcatcctctgcctgctggagaggtggtgtccctatttggggactcagtactctgaagtcagggttttgccatgctcttctctgtccttcgaggcaggagacatgctgtgcatgctacaggagcttaggaattgtctgagggtgaccagtgggggtccagaggaaaggtgctaggaagacatggaggcttccaggggaggctgggcctgaagctcagctccatatccgatgtgtcatcgtgggaagagcagtgtcttcatgaggcctggacagtgcctgggtgggagatagctccagcctccttggaagacctattgaccacgtttctcttgtgacgcacttcactgtcacccagaataactgctgtctcacagctaccaggacccgagcctctggggtaaggtagagttcaaggagaaccaaggcagcccaagtgagcctggcagcagagccgagggcagccccaccaaagccacggagccagccctgctggcatccagaggccagggtgggcctgccctcccatggccccgagctctgcccccaccctttaggattgcaccctgccttgttaagggatcagctgctgctcctctcaggtctttttgggagtcctgaatctgaagtgagcctgggagaaagggagtcagacaggagaggggtgggtgctgagccaagtgagggtctcaagaccaaggggaccccagagcatgggtacccagggcctacacttgggaggcctgtggctgggccaggaggatgaaccagtgtggagttgagagccatggagtggcagagaatgggtgccaggagctgaggtgttcaagctggaacagagccctccgtgcaggcagggccgagcctgtctccctcagcatctcagatgctcacagaaccacgggggcagcagggttcagtgttaaaggccaggctagaggaatggaaacagctgccccagccctggaagctgtgggagtggtggttgccctgcaagagaaggctcagagcataggcaggccttctgctgggaggcaggacccagcagttgagcaggtaccagccccccacctctcagttcctgaggctggccgtcagcaccatgtgccctgtgctgtccccgcagactggctccagggacagacaggagctcactgagtcattaaccctcaatccaattctccaatctgtcaaggtagcattgaggtttgcgggaggaagagggaagcactaaccagattggactgtaagtgaccctggtcatccagctctgtccccagacacctccccatttcctgaggctagtagcagtgggaggatgaccaggcctgaggggtggttcgggctgtctggtgctttccttggggcaagggtagtgggccaggcaaaggggcctaggcaagccaggtaacccctctgagcaccactttccacatctagaatggaaatgttttgagcctcgtgagcccaggagcctctcacagtcacttctcggaggtgaacagaactggagggcatcacggcagcccccacacaagaggaagtccagactgacgaggccacagggtgacaagagcgagccacgttctggggccctcccaccaggaggcccaccccacccatggtgctccagccaggaacaggtcaccagaggtcctcccctctcccctgcccactgccctgtctctcagggcacagcaaggcaggtccttaaagagacagagggagagcagggtaccctcgctaccagagaccctctcccaccacctgagcagatgggcagtagacagtgtttggccaaccaggctgtgtgcccctgtgggcacctgccccagctcaagggtcagcagcttcacctgccactggtctgctgtggtgtgagactctgagggtgagggtgtccaccctggttgtcatagaaacagcagtgcgtctgcagagagttcatgccaagctcagcagagggaggaagcagctggcctgggaggcagctgttgtcattgactcctgagagctcagtgttgggaaggacccaagggcccaccacactctgaggctggcgagcacacggggcaactcaggcctccctgcccaccatctttctttgggcagctgcaccatgttgtctgtcctcttgtccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtgggagaattaggtttcagaacacaagacagccagtacctcccaggccccttcctcagggagccagcagggtcgtgggcaagcggccaggctccacagggcaagcccctttggacttaaccctgtttgtgacagccctggtccctgacagtcctcagatcccggtggcagtgggcagtgggctgtctgaaaccaaggtgctccttatttccaaaccagaggtgtctgatcacagagtgtgtcactaggagcatgttctgagaagccagggagcctggtgcccaggttcccatccttagaccagtcctctgtcccttgcagccttagtctcatccacagcaagactggagccttgggggtaaccaggaaaggacaggcactgcccctggcattcatgcagggaccaggagggccagaacacaggcaccctcagcctcctgtcttcaccccgcagcccaaaggagggctgcctgacctccgggcctcacttctctcccagcaccaagaaagaggttcccagctgcatttctggtttctgaggggcccttctgcttccccagctgccacagccccaggccctgcctgggggtctctggaggaagcagaagaggcatccttcggccccgccccaagcacaccaggctctagggcccagtgctcaccaggccgtttgctctttgcctcccaagaccgtgggaggtccagggacctggtcagtggcaatgccttccaccaggtacatggttgaagaggtgcggggagcatgccagggtgcagccaggaggccagatgaccacaaccaggggtatgacagccctggacacagcaggtctgtggccacggcaggagggcgagatggacacttagcaggaggctgggctgagctcctggtggagtcagggtgggactgtggcagggagacccccttctccagcaaggacagggccacttcctgagaaatggagcatcggacaaacaccagcggggtgggaatggcaagtgctcaaggtgagcacgatgcagctgcgacctgtagactggctgcaatggggagcctggccaggagaagccagagacggacaccaaggtcagatcctgaagcacagaagaccctcagtggggatagggacctggctgcagggagcaaggtggccagtgtggacccatcaggaaggcaggggcctggtctggggaccccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagttgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctgagggtagatgtaggccaagagcttgcacctacaagcttccccaaaagggaagtgaactcaggaattcctgatgaggattccaggactggctggggaagcacggggttgcaagcgaataagctatttcctttgcgactgataccatccttggagtggatttcctctggtgccttccctgttccacagctgcagaggcatctagcacagggggccaacaccacaggcccctccactcggtacacctgccaggacctcggcgcatcatcagatggtggggcccactcgccctctccccactagagaagtctgggaatgcctgtgtcccagaccccctcggcagcactcaggatggcccaggcaggttgcagaggctcctgcccaccaggcctgtcacacagagctctgggaaatggagatgggcagtcagtgccagccaagggcaggcacccgctaccgatggaggcatgttggtcactgtgtcagcagtgccccatgtccctccagccacaccctgcccagcagacaggcagccccaccaaggtgtccccaagcttccaccacaaagggaggcccagaggggtgagaggcttggccggtactttgtgaaaggtgacagcatgaagctcatctctgtatgaaacctctgcctcggcccctcagtcagggtgctgccctcagagcctggtactcggtggccctggtcaggcctggtggctcagctgcaggctgggtggccgcagggctggcctgtccatggtgaatggagcgcattcatgtctacaaccccgccccacagctctgctctcggcgtgaaaaagctgaattcacggttcggatgaacactcccagcttttctacagtgggctgacttgagcttctcagtctgtaacagaactgaggacttgctctacagatgaggaaactgaggcccagggtgggacagaccggccccggccccacccttcccagcaatgcggctgcatccccatgcctctgtgcctctgccagcccctcctgcaatgccttcccttcccctcagcccccagaggtccagtcaaaacgtcctgctcttgtattacccctcgccccctgcattcctgtggtgtgtcacctgtcagagttgtagctggccagcactatctgcagcagtgccagctgctcacagtcacttgtgcctgggtgtggggactaagctgtccatgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaaagggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtacgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgcagggtggcctcccacacctcagtgatgcctcggtgacccctaaggcagaagatgcgtgaagcaggcatgaggccctgagcactgctggccacccctgcaaatggaggggccccacctgaagttgggggccggggctcatgtttgagccattttgactgggtctttttcagtttattttctaaacctcagtttatttgaagcacagtacatgattgctcacttcaggaaattctgttcaagttttcctagcagagttactcattccttcatctgtgcaaggggagggtggtggtcataatcaccaccctgatccccctaccccctgggccctgtgtgaagatgacaaggcagtgcggttggctgagggcctgggccaggccaagcacaccaggaaggtgccgcgcatgtgccagatgggccctgaggccgctggggtcccacagcaaacaacaaaacagtcaaacaggtgccagcctctgtcatgtgctcaccacgtgcccaggaccacgtctgtgtgtgcgtttgcctgggtaagccttgcttcgtgaagctgccatgacctccgtctcctcactgaggggcacagggcaacaggctgccaggtgaggggctgaggggccttctgggggccactggcctactcgaggcacagtgagttgtgggaacgaggagtaacttggaggtggagctgcgggtgcagagggaaaaagacacctgggtcatgaagggctggcctgtccgcctgaggggcccagaagtgcagtgaggggatgacgtggctacgcgcctgtgacagggcacctgaggacatttgcagtgcaggagggagagcgcttcagagcaggccagtgtccctcccacccggcccagtccctggtccctgggtagtcactgagctacctcatgcaggaccatggtcttagcaggacacctgtggtggcctgtgaggcagggacaggaaggatgccccactctgggctcctcagggagctgcaactacagtgcaggatgggctgtgatactcagcactgtggatgtctgtcaaggcagggtgtaatggactggaggtcagaacgtgtgaggccctggatgagcctctcacctccccacccccagcccaggcgcttgtcccacacagctgccttggatgtcattagctggaaagccgtgagtgcctgatggggaaggagtggggtgtggggaggtgtttaggctgtgacaaagggatgctaactccaaaaacaggcccccagtccagaggcctcttaaaatgcaaatatgccgcacctgggagggggacaggcccctggctgagatgaggaagcctggaggatgcctctgttccctctcccaccgcaggcccatgagctctcagaccagcaggaggctgatgctggaatatgcgcgcacctgctgggggatctgtgcgcctcagctccaaagtacaggagctagactccagtgtccatgtcaggtcccatccagctgggatgcaggaaaccaaaggcagccctcccatgacccagcactgagggccagacctgttaccaggaacgttggtaactggaagagcctggtacttggggctgttctgtgccccacaaacagagggaccggctgtaaggagactggcctgatggggaatgagaggggctgagccagaggtgccgacacggtatgttttaagtaaggtccaggtggctgcaggcgggatggaaacacatccaccattcatcacatcggccattgcatctccaggctaaggggccacaggagcctcccaaagagccaggctgacctgggccctgtggccagcaaagaagtgttgctggctgaatccccatctgcagcatcgagacctctcccactccgtccggctgagctggccctgcatttgggtagccttccctcagctgcctcatgctgggacagagggaagcaggtcttccgatgagacctcgcaggtgagaggacgtcccagtgccaaggcgaatcacagtgggtgtggcgtggagagggcccactggggtgccagtggtagccacagggcaaggcccagcagcttggggttcttcccgtgtcagcacctttgtgccttctcacaacagtcccagcattgtacagatgaggaaactgaggcccagagaaaggaaatgacttgtccaaggtgcagcatgcaccggcagtgagtaaaccccagaccctgtgttcatggccagggacatctgcccctttgtgtcaccaggagaaccttggtggagaatcaggagtgagaggcctcaccacccccacaactaaccaggcgcaggctcctctccactccctaccttgccccggccgctgacctgggaatgtccttccaggtgccggacctggtctggccagcagtctggcagccacgttcaggggaaataccccagacccgcaggccagcaagctggaagccccttagggatgggctgtcagctcccctgctgtagtgagaaagccacggcctggggcagagtcccttccacaatggcaagtctatttggacctgtctgagcaggagctctcttctcacaaatggccaggaaatgacttccacaccaccccagggactgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccaccccccgcggctgccttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggggcagggccacatgactccaaagctgcatccagctctaccccagtggcccacaggtgggctgcagcaggacaatgtttaaccctgccaggccagggagggcaaaaccccatgcaggccaggccaggccaggaaggagaacagagccacatccaccaagggcaggaggacccaggggagcccacaaaggccagatgggtgcaggaggcacagccagtcatgttttgcagggtgagcagagcatggacaggtcagagggctatgaggccaggccctggaggccagcagaaggcatgctggggcttcttgcttcccatatgcatgcttgagtcacagtttccagagctacagcttcaaatagacggctctgttttcagtggtggtgatttgagtgtcaggatgccgctttgcccacctgtctgcactccaggctgcaagagtgcaggcaccgctgtgacacaggctcccgaggtcaccaggcaagcaccagggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccagcaccacactgtcccatgctgggccctctgaccttctttatagccttcctgttctataaagattacaggatgggcacccaccatctcctaagcttcacctcctactagggtggagcccatgtgcagtgaaggctcagcctgcgtcagggacgctgggatggagtgaggcggcaagctcaggtgcttcccacgctctgaagcttcctgtctgagcccggaagtgaggtatgtggttggtgcctcctgcaggctttcctgactcctgccagacagggcccagccaagaaacaagaccaggaaaccaggcgtctacacagagattttgttattatttgaggcccatcatctcctcggtgcccactaaatattagtcagtgtggttcccatggtttgtctcaaggaatagaggaaaccaggaagcctgagcctgaaatgcctgcaaagcaaggggagtcctgggcacaagcaggggcctgagctgagggaagggcccacactcgggagatgtttgtctgtcctgatgaggctgccgcagtggcggaatcctgataagagtgtactgtgaggcaccgtgcccacctccagctgccttgtgagataagtacctgagtttccatgacctctaagtcaggaacaggaggctcaaagaggtgtccagggtccccaaggtccactgagaggcatcagcagggaagcagtttagacaccatggaaggggctcctagtgcattgggacagcttgactcaccccaggactcacgggggccacagtcaggagtgtttcatggcgttggacaagaagagtggctgccttggccttggagagagggggtccacgtggtctatcggcccctcccactgctgccagctgagctctccctacacacaggtgccctgcagaggaccagtctggtttagatctgaggcttcagatgaccagtacacgtgaactgtttccgcatcagtgaggtggccctcctgctcctcctcttacctaaattccactgcctgcccaggaggtgatgggctaagctgggtattaaaaccatctcaactgtcatccccaagtgacccatcagggctcagagaggcagacccaggcctagcacccactctgtgcttgtcccctcacccttgaacccccaggtccataccctgctggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcagtaaattaataatacgtgctaatggtcatatctgttatttaactgatgcaaaatttggggtcagaagcatagcccccaattacagcatcatttctatgagaaatgacagctctgttaccacagtcctctatgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgcagaaaggccagcacccccatccccagacctgaggctgctcactcctcaggactcctgttattccgaagctcattctaaagaaagagcaagattggtttggaaaaacagtcttccaggtggagtgcagggttccagggtaatgacgggtacctctgggtatccttcctttctctgcacagatgctgccagagctgttcctcagagaactcaggggctctggagagcagggtttctatgcagcatcctcctgggcacccctgccctcaggcagcctcctttgggcccaccctgtaggagcagcaagccagagcacctggttgtggggcttggagcacatatcctgcctctctgtgcctcagtttcttcatctgtaaaacaggagtgggcagatgtgagaacagactggcagctcgtgtccagctgtggttaccagcgtcattgtcactgcagtcattggtgatgctgttgcttcgtgcctgagtcatcactaccagctgcagttaccacttgcattaccacggtcactggtgatgtagtctagtcagaaaagttcctttttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactgtgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtgaactggggagtcagacaagagcatcatgcttcttaaaagcccagacccctggctataacacatcgaagattctcagaagagaattgaggagcggacaggcgccacactccgttgtggtcactgcctcttcctggcccaccacactcctgtcctctgcatgtactgagagctctgtccaggatgccagggtcctgcctcggcagagaggcggtgccagatgccccacagcagctggtgggagtgcccacagctggagggcaggggaggagcctggcctctggctggtgtttccttcccagctctcaagaactggagactttggttacagaagtgaaggctgctccctcacagacttcctagtgtccgatggtaccacatggaaggatcagagttttgaaggactgggccagaacccagatagggcacaaggctgccagcgcctgcattgagggagctatgatgtgacgggggctcctgcagaagatggccttccttgtacaggtgtggggcagcctgtggatgggcagtgggaagatggggggtcctcggagctggaggtgcccagcggtttaggaggctgtgcttggcacatctgtagccccaaagctatatgttgagatcactggcacccagaggagagacccaaaaggggcaagagaacatcttccaagcacttgccactggcaaggagggtgctgccggctatttccgtgggaggtgggtgaagacatttaacctgggcttccccagcagaaggaggtgccattgcagggaccagtcttgggctgagaccctagcaaaggcttcctctggcagggctgcaggtctagggtctgtctctgcctgctgcgggcctgattaacgccagtactttcctttccccagagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacattttttttttgttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagc

SEQ ID NO: 103 - DNA, 137674 bp, Homo sapiens
cggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcaggtgagttcctcacgccacgtgcgtgggcacacctgcacgggggaggaaaaccatagacgagtaggggatacaaaacagaagttgggagggaggagtggatagttttgagtgtatcaggtgcacttgtggttcacgcggatcctgcacccgaacaaactccatcccctcctccttcctgaatgcatactgttagtgtttggaatggaattgggttgaggatggtcttgtgagggatgggaggtggtttgttcctttggttctagagcaatgtgtttgtgaagtacagcttgtgagttgaaggaagatgcttcaggcagtaacctccttgctatgtgctctctccatgccgggcagtgaggatggcataaaagccggagtcatctctagcgcccacatcggatgctgttagcagggactgatttatgtcttgggcattccccgccaccccactgatcctgttctggaggggttatatgacacgtttgtgaaacctgagatatgctagctgctcctaggccatagaagtgtcaggtttgcttgctaaccagcagtcctgaacacaagtcacagcaggtgagaataggaattagaaggaagtgaggcgacaggcagttgtgactcagtgggccaccgaaaatcaactgcatggagattttatctgggggtgaagcagagccacacccgttctgatctgcctggctttgatgggaggcttcacccatgattattcaccaccaggctcctccatggtggtaacccagccccatttgctgaccctccagtgtgctcctgctgcctcatcttgccaaggataagcacccacaggtgcttatttggggctcccaatctgtggtcagattctagcactaagattaaaactatgggattgtacgcctaacttctgtgctagatgcaaataccatcaggcattttgggtcatgggactatgttttgagatccagacacagtttgccattggggtaaggaaagggtgggctggggtgtgtgtgtgaggctgtcgggaatcttttggagtcctggtccctgttaagctcatctggttttctgcttcattgatttttctttttctgctgatggaggagttgaatgtgcttggtttgtcaaaatcctcttcaaacgagtgaggctatttttggctcttagagctgctgcctttttgtggtgggcactctgtcctgtttgtgttaggtacttccagttactgatcttccatttgcagctggggtttcctgtggtgcacggctccgacctgccgtctggccgggctgcattccctaagtccctatgtgggggcggggtggaaggctgtactattcagaagcctgctttgcaggcacatcagctcgttcggggtctggaggattgccttgtggttactgggcaccagccttgtctggccagctgttggtcaggcgagccagcttgaactggccctcagtgccatggtgcaggagagttattaataaagaagaaaatgagaggtttttagggagatgtgcaaattgaaattgatagtctttgctggtggagaattctgggtttccagaaccttgggcccagcctttcctacagctcctgtagacttggccatgttggccacatcactagacgccgaatgcaagtcagtaaatgaatataggaattattatagagggatggaaagcccagtgccttgagtcagacagggcaggtcctcaggaaatggctgaggaggtaattttaccacttggacccacttttaggacttgctggattcttctccgaatgtcctcaaggtcccacagtctctttcccattaggttttattttttcccccttaaatgttttgtttgttttttgtttttaagagacagcgtctggctctgccatccaggttggaatgcagtagtatgatcatagctcactgcaacctcaaaactcttgggctcaggtgatccaccacagccttttcagcagctgggactgcaggctcaaaccactatactgggctaatttttaattttttttttttgtaaatacagggtcttgctgtgttgcccaggctggtatcaaactcctgggctcaagcattcctctagcttcagcctcctgagtagctggggttacagggatgagacacctcaccaggcctcttagacgtttttagtaactaaggtcacttaaacatttttaaaagggattattttccctcagacagtttttcttttttaagacttaatttttttagagctattaggttcacagcaaaattgatcgggaaatatagcaatttcccacatactccctacccctacacccccacagcctccccagttaacatctcccaccagaggggcatgtttgttacagtccatgaacctacctgcattggtgcctcattattacccaaagtccagagtttacatttgggttcactcttggtgttgtacagtctatgagtttggatcctgttatgttttaaaactcctgcttcttttagccctgggcaccttgacactctgcctagcagtttcccctgacgtgggtccatgtatggcaggcatggaaagaggaatcctcactggctcagccatctgtctctgcctgtttactgatgttctttagagggctgtggagcctgctggtctgaaaaggaacaatgaggaaaatcactcatgggggtgggtggggggaggaagtcaccctaatgctccgcagtggcagatgtggtgacccagatctaataacctcggaatcagtctgtttggatgaatggaccgtcccatttccaagttgagggcccctcaagggagggggctgaagccatccctgggcacggtgacaaagtgcttcccatagggcccctcatgggctcatctgtcgccctggggtggggctgcccatttacaggtaaagacacaactgggaagcggcaaggctgggattctgggtctctgtgtgaatgcagagctgttccgtttggcacgtggtggccctgcggtgttcttcccactaccccacactgctacctgcaaagcacaactggggaggttcagggcgtccttccagtctttgcaccctgggcccgcctgtgggggtaatgatagacggctgtgagccctgctgtaaaactatgcagaacccggccgggcgcggtggctcaagcctgtaatcccagcacttagggagtccaaggcgggtggatcacaagggcaggagatggagaccatcctggctaacacggtgaaaccccgtctctactaaaaatacaaaaaattagccgggtgtggtggccggcgcctgtagtcccagctactcgggaggctgaggcaggagaatggcgtgaactaggggaggcggagcttgcagtgagccgagatcgctgggctgcactccagcctgggcgacagagcgagacacagtctcaaaaaacaaacaaaaaactatgcggaactcacagaaggagagtgtggttctctctgttttttttgttgttgttgtttttttgaggcggagcctcgctctgtcgcccaggctggagtgcagcccagcgatctcggctcactgcaagctccgcctctcggcttcacaccattctcctgcctcagcctcctgggtagctgggaccacaggcgcccaccaccacacccagctaatttttttgtatttttagtagagacggggtttcactgtgttagccagtatggcctcgatcttctgacctcgggttccgcccgcctcagcctccgaaagtgctgggattacaggcgtgagccacccgcgcaaggcggatagtgtggttcttgcgatctgggaacttacaagttaccggaagagagggagaggcacacatgtatgtgctcaagggaagtgagatcagagaagcttccggaaatggcaggactgaagaggacttgatcagtcaccagaagttggagggcagagagtagccgtttgccctaaggaaaaatggcagcaaaggcctggggccacccacgtctgccttgtgattctaggctgtgtgcttttctttaaatggtaaaatatgcttaacttaaaatttaccatttttgtaacttttaaaaagtttggtaaaatgcacataacaaaagttactgtcttaacccttttaaattgtttctttgggtaaggccagtcaagtgaagcaggggaacattttaaccatttttatccatacagttctgtggtgttgactacattcacattgttgtacgaccatcactactgtccatcttgaactttttcatcttcccgactgaagctctgtacccagtgaataataactccccattccctgcccccagcccctggcactgccattctccatctgtgtctctgaattcagctattatagatacctcatgtaagtccagtcctgtggcattcgtctttttgtgattggcttatttcactgagtgtaatgttaccaatgttcatccatgtgatggcagaaattgtgtggattttttttttaatggagtttcactctaggctggagtgcagtggcgtgatctctgcttactgcagcctctgcctccccagttcaagcttcaagagtctcctgcttcaggagttcaggattctcctgcttcagcctcccgagtagctgggattacaggtgtgcaccaccacacccagctaatttttgtattttcagtagagacggggtttcgccatgttggccaggctggtctggaactcctgacctcaagtgatccacccgtcttggcctcccagagtgctgggattataggcatgagccactgctctgggccaactgtgctttttgaaggcaggaataactggttcatttctgggtgtcccagggagcctggttctgagctttacacatagcacatactggaagagcccttcctccttttcatagcccatggggtcaggactggggacttttactgatcattggaaagtgacttatcaattactcggtctttttctcatttcatccctgtagtttactttctgaggatcttttttttttaagtggcttaaaatactttttttttttttttttttcacagttctctggttggctaggcagttttcctgttgtgggcccactgggctgaaataggacggtctagttagcctcacccacacattctgtgattgcaggctgattgacattggggaggaggggctgtcttatttgtgttgcagctggctcgatatcagttgggacagcagacgtttctccttctctttctctctctctctcttttttttttttttaatagagattggatctccctatgttgcccaggctggcctcgaactcctgggcttaagcaatctacccacctcagcctcccaaagtgctggaattacaggcgtgagccaccacacccagcctcctcctttttctttttttcccccattgagacataataattgtacctatttagagggtgtgatattttgatacatatctgcaatgcataatgatcagattgaagtgattagcatattcatcacctcaaacacatttattatttgtttatgctgggaggtctgaggaattcttgattcaaacacccagcccaatgtgcctgtcaactttcttccaggtgtcagttgtgagacgggacagatcttgtgtttcttcatggacttcatgtgagtggctgccctgtgttttcacatttttattaagcagcttaatttgccctttgaattccggtgatgagttggcgccagagtgaccactgcattgtttttcccttgggtgatgggctggactggcaaccagtttgagtgagtaactgtggggcagagaaaggtcacctgggcctggagttggctccatcgtcatctcttaaggccagagcctcgtggccacctctcagttgagtacaggctcctttccatggatggagacagagtgggcagatctgggtggagtctgaggccgctaaaggcatcagcagcacagaagcagagtctagatcaaattttacaagcgttctctggttcaggaaggctgacttgttttgggaacagaatggagcattctgaaacatttcactgaagaaggagctgggagtgctgttgatttgactgggttcaggggagcatgccttatccatgactcccttttgcttagtttgttgcttctagctttatagcctccttccttccttggttggaagtcctgtggctgggagggcttgtgtttgtgactgctaacctcaccaggacaaagagcccaggtgagctatgtgcttgagcacacttgggagaggacacagcagtgcatgaggcccaggctgcagctcacccctgtggtttgagagggtcccctgtttagagtgaatgaatgggcatcttggaagctttctcaggttaccaaagagtaggtctgagttttggctgaggctgctgctttttgggtcaagactcggggtggtggtggattaaattaactatgaaccccagggaatatcttgaccctgactggaatacaactgttgtggctcaagtaggttttttttttccccttttgaaaagtgtagttattttaattaaaatacaatatccatgtaacatgttagaagtttgttatttttattattgtaaaattcatgttatattttttattttttcaagacggggtctcactctgtcacctaggctggagtgcagtggcacgatctaggctcactacaacccccgccacccaggttcaagcgattcttctgccacagcctcccgagtagctgggattacagctaattagcctagctaatttttgtatttttagtagagacagggtttcaccatgttggccaggctggtcttgaactcctgacctcaggtgatctgcccccctcagcctcccaaaatgttgggattacaggcctgagccactgcgcccggctaaaatttatattataagatgcaccattttctccatttttaagtgtacagttcagtggcattaagtacatcaccttgttttgcaaccatcaccacttgtcaatttctagaactttttcatcttcccaaactgaaacttcatatccatcagactttaactccccattccccctcatccccagctcccggaagccaccgttctactctgtctccatgattttgcctctcctagatgcctcgtgtaagtggagtcttataatatttgtcctgtgtctggctgatttcactcaagcagggctttgaagttccccagggcgacactctcagtcttttcttttttttctttctttcttttcttgagacggagtttcgctcttattttgcccaggctggagtgcaatggcacgatctcggctcactgcaacctctccctcccaggttcaagtaattctcctgcctcagccacccaagtagctgggattacaggcgcctgccatcacacccggctaattttttgtatttttagtagagatggggtttcaccatgttggccaggctggtctcaatcgtttgaccccgtgatccacccgcctcggcctcccaaagtgctgggattataggcatgagccaccgctcctagcctagccctctcagtcttaagactgagttaactcccagctctgatccgtcacaagggtgttctcttccggaaaacacccgttagcaatggcgatcttccctgggccttcacgcccttagctttgaagtggcccagagtattagtttgccaaggctgtcccataacaagataccaagactgggtggcttaaataacagaaatatattttctcacacttctggatgccaaaagtccaagatcaaggtgccagcagggttggttccctggagggctctcattggcttgcaggtgccatggtcttgctgcctctgcacatggtctttttctctgtgcatgaactcccctggcatctctctgtgtccaaatttcccttctttttttgtttttgagacggagtttcactcttgtcacccagactggagtgcaatggcacagtctcagctcactgcaacctccacctcccaggttcaggcaattctcccgcctcagccttccgagtagctgggattacaggtgcctgccaacacacctgggtaatttttgtatttttagtagagacggggtttcaccatgttagccagcctggtctcgaacttctgaccttaggtgatccgccctcctcggcctccaaaagtgctgggattataggcatgagccactgcacccggcccaaatttcccttcttaaaaggacaccagtaagactggattaaggtgggcagtaaagacccctgctttaacttaatcagttcttgaaaggccttatttccaaatacagtcacattctgaggtactgggagttagaacgtcaacatatggggagtgaggcatggtttagttcgtaacacttggtgagtccgttactgggcagcagaggaaagggctgccaggcagagggagatggtgtttgtgccggctccctcagacgtgttaggaggagtgtgagccaagcgtcatgtggttttaggcagcctagaggggcctagaggacactgagccaggcatcaggagggctgcgtgctaaaacttcgtgtgctgccatctctctccacatccaaaaagtaggggtgggaacaggtcattgctaaggttctttcgttagcttctttaatttttttctttaaatttaaaatttattacctttttttttaatagataaagggtctcgctctgttgcccaggctggagtatagtggcatgatcatagctcactgtagccacaaactctcgggctcaagcgatcctctctcctcagcctcctgaatacctggtactacaggcgcgtgccaccatgcctggctaatttttaatttttgttgagacagggtcttgctttgttgcccaggctggtctcaaactcctggcctcaaacgatccttcccgcctcggcctcccgaagtgctgggaataattatagatgtgagttactgcacacagcctgaatgtattattaacacaactttttccatctcttttctgtttatcttggtttatgtctcccttattaaaaacgaaggcaaccacctctccctatccaatcgctcaaaggtatttattgagcatctactttgtgcctggcactatcttcatggaaatcctttcttccttattcattgatttatggaaaggctgatctccaagggccttgtctttaaaacaacaacaaacaaacaaaacctttctaatgtcaaagcattttcccctgcgtatctttctttaacggtatatttgcagctgtttcctgttaatcctttgtctatctggcttcctttttagggtgatgggatccttaagcacagagtatgccctgctgtagtgtcctgcaggatgggccacactctggccctttaacagtgtttgatgtgacgatgcacctgagcccatggaggtctgtgtctcgggccccgtgggtgtttgcagattgaagatggaatgatacacaccatctctgagatttttatttgctcagaccttcccctgttctggcccaaccccgcttaatcatgtctaataagtggtggtgggtttttgggggcctagtgatacaggtggcccggcgatgaaacgttggctttggagattatcccgctggttctgtttccttctttgctggtgattggtactccctggctcacccttagagaacttcccgaatcctcagactggggcctgctaattagctgtcttgggttctagctctcactgccacgactttgcaaaatgactatagatgtggatggtggctggtgcccatgggcagagcaatcagcacattcatagacccaccttcctggggctggggtgtgaagaccggacaccccactgaagtagtaaatatgactttcatggaggctgcttcatgggccctcgaaagtttcttgtaaagtggctggagcaggattataattatactccctccactgattgagtctgagggggtatgagacactctggcctggagtaacctgcccaaggtcaagtggttggtggaggggctggcgctgcctctctcctcagactgagtggttgtgttaatcacatgagagcagacacagaatgactttgcggaggtggaggagacctggatcatttgctcagcaaaccggttttgggcacctgctgtgttgggcacagatggtgctcagtacagtcaggcaggccttccagcaggtcggctttggtctggtgggaagacagcctcattaacctaagtgccatgatagaaatcaactgaccccagcctttagtctgggtcttgaaggtgtcagctgtctaggaacatgtttcccctctcattttgcaaatctccaagatagggatttcctgactcttgatagctccttctgggacactttggtaaggcttctccagcaagttgtgtggcaaggggcccaagaagacagaactgttggaagggcgctgcccatccatctgcttttcccaccaacagtcaagggctgtgaatgctgacctgctgctgacagtggtctgttgtgcaggttctgggaggggcagagggacgaggtctggctgggaagatgtagcggagatacacagaggtagccggctgtgtgtgcacagggccaggtgcagggcccagagagccaggtgagtgaccagggagcactgggaaggaaccatctccaggcaaagccaggacacagccaaggggaccccagaagaagagaggggagccttgtgcagcagccacagagagagagagccaggcagagcaaggaattgagcagcccggggagatcctctactcaagtgccactgttggctcaagaagagtttttgaagattcacttcactttaaaggcctgacatgcttccgtgtttaaagtgctgctggggtcagtttgtatgcccgtagagtagggagagattttctgcacatgacgaggtattgatgagcattcgaagcaacctacaggcaacatatgttgacagtgcagactttgaagggaaaagatctggacttgcccagagacctggcacttgccactgtgtggtcttgcacagggacttaattctcccttgacttctgtcagctggagagggtgacccttccccttgggggcttcgtgggagtagcgggtgcagaccatctggcctcctgtctggtctcatagagtctcctgttcatgtatctgatgtcagttgattgaacatcacttagcaaaaaatcttaagaagaaatgcataatttagtatggacatttcactcacttggctcagccattgtataaccagtatgagctccggggggaccctggggtgtgtcagggccctcattctcctcctataatcctcctgggctgagtggagttcttacattttgaaggttatgcaatggactgcatgtttggatccatctgcaaattccccttttggggagaggctgagttgccctgtgcttgagggagctgggcagatggtactttgtgtagcctgctgcattttgcagaatgtcttctctcacaggggtccctgtggaggagtgacaggaaccctcttagctgagtgttgggaggttttaggtggagggctcaggtcacccgcaggggtcatttgactcctaccttatctgggtagataggatcatctttgtcccacagtccttcccagtattgtgaagtgatgcattggcgtgagcccaggggtgccaagggtgggctggcaatgcccacatccagttctctgtccctgaggcacggaggtggttgtgctgggctcagagccgccgtctgactggttggaagccctgctctgattttgtgaatcaccctagttaagtggaagctcagcgtagcctgttccctctgtgggggtgtgcagaagcactgtttatttttgcccacatcttagagtgataaatggaactcatttatgaattttgacttccaaaagctttccactttctcccttaggaacatggataaaaattgtccacatttgtttttggagacatggattgttacctgaaacctacttttcagatggtcttgatgtgaaaactgttgccaggctgggcgtggtggctcatgcttgtaattccagcatcttgggaggctgaggtgggtgggtctccattttttttttctttttttttttctttcttttttctttgagatggggtctcgctctgtcgcccaggctggagtgcagtggagcaatctcggctcactgcaaactccgcctcccaggttcacgccattctcctgcctcagcctcccgagtagctggaactgcaggcgcctgccacaacgcccagctaattttttttgtatttttagtagagacggggtttcaccgtgttagccaggatggtctcgatctcctgacctcgtgatccacccacctcggcctcccaaagtgctgggattacaggcatgagccactgtgcccggccgggtggatctcttattcccaggaatttgagatcagcctgggcaacatagcaagaccccatctctacaaaaaatttaaaagtgagctgggcatggtggcatgtgcccgtaatctcagctcttctgggggctgaggcgataggatggcttgagcccaggaattcagggctggagcaaactatgattgcaccactgcactccatccagcctgggcgacagagcaagcaagaccctatctctaaaaaggaaataaataaatacacataaaaaccattgcttttttttggccgggagtggtggctcatgcctgtaatcccaacactttgggaggccgaggcaggcagaacatctgaggtcaggagttcaagaccagcctggccaacatggtgaaatgtcgtctctaccaaaaatacaaaaatgagctgagcaggctgagagcagtggttcacgcctgtaatcctagcactttgggaggccgaggcaggcggatcacctgaggtcgggagtttgagaccagcctgaccaacatggagaaaccccgtctctactaaaaatacaaaattagctgggcatggtggcacatgcctgtaatcccagctacttgggaggctgaggcgggaaaatcgcttgaactcaggaggcagaggttgcaatcatccaagatcgcgccattgcacttgagcctgggctacaagagcgaaactccgtctcaaaaaaaaaaaaaaaaaaaatatcagctgggcatgttggtgcacgcctgtaatcccagctactcaaggaggctgtggcaggagaattgtttgaacccgagaggcaggggttgcagtgagccaagatcttgccactgcactccagcctgggtgacagagcgagactgtctcaaaaaataaaaaccggccgggcgcggtggctcgcgcctgtaatcccagcactttgggaggccgaggtgggtggatcacctaaggtcaggagttcaagaccagcctggccaacatggtgacactccatctctactaaaaatacaaaaaattaattgggcattgtggcaggcgcctgtaatcccagctactcgggaggctgaggtaggagaatggcttgaacccgggaggcggaggttgcagtgaaccgagatcgtgccattgcactctggcctgggcaacaagagtgaaactctcaaaattaaaaacaaattaaataaataaataaataccactgcttttttaataacaggtacaaattttaaagagaaataaaaaaacattgccatcttcaaatctccacaaaaatggaaagacaggacagtgccagtcagccactttctgcagtcaccatgatcccttctctctccttcatttttaatgtgtgtttttttaaattgtagtaaaatacacatactctaaaatgtaccatctcaaccacttctcagtgtgcagtttagtagtgttaagcctctagtgttttataagtggcagagttgatgggaaaacactgatcttcaggaggggttttttcagtgccagcgtccctctggatgtgtaggcagataagaaggtggctcggacacagtccttaaataagtgccaggagccagcaggccagggtgggagccgggacaagcaggcacctaaagtaacggtaacataaggcaggtggcgagactctgtggatggatcagtgccaggggctgtgcgggaagggaaaccttacatctgtcctgtttcttaggggacgaggttgtggaggggagggtattccaggcagggaatgtgggcaagaactcggaggcttgaagcattcagtatagtcgtctctcgatatccgcaggaaattggttccaggattcccttgggcagcagtccccagcctcctttttgacaccagtgaccagtttcatggaagaaatttttccacagactgggggttaggggatggtttcaggatgggactgttaacagctcagatcatcaggtattagattctcatgaggagcctgcacagcctagatccctcgcatacataagccacaatagggcttctgctcctatgagaatctaatactgctgccggcctgacaggaggtagagcttaggcagtaatggagcaatgaggagcagctgtaaatacagatgaagcgtcactctccgcctaccgctcacctccagctctgcggcccagttcctaacaggccacggactgataccagttcatggcccgggggttggggacccctgcccttggggatcccagaatccttggatgctcaagtccttatgtaaaatgccatagctagcttttgcatataacctatacacatcttcctgtacactttaaatcatcttgagattacttataatacagtcatgcaccacataacgacattttggttattgatggtggtcccataagattataatactgtgtttttactgtaccttttctacatttggtatgtttagaaacagataccactgtgtcacaattgcttacggtattcagtacggtaacatgctgcacaggtttgtagcctaggagcaataggctgtgccacgtagcctaggtgtgtagtaggctctgtcgtgtaggtttgtgtaggtacactctatgatgtttgcatgaagatgacattgcctaatgatgcatttctcaacatatccccttttaagcaaggtatggctttatctaataaaatataaatgctttgtaaatagttgttacagtgtattgttattacatttatattattcttattgttggttatttctttccaaatagtttcattctgaggttgcttgaatctgcagatgtggaacttgaggctgtggagggccaactgtatgctcagaaagtagcaggctctggttggagagttggtataaaatgtggacaacagggaaggtgagggataggagagttggggtcatcctatgtgggtctccgaagccaggctgagggtgttgtgctttctttgaggatgatagggagccactgaaggttgttaagctggagaggggatgcctttggagctttgccttgggaaggtgagtttggcaaaagtgtgtgtgatggtccagtgggagtcaggtacctggagctgttgtcttgaggggcggtggggaggaatggggagggatggagaggacaaggaatatgagctgattctggggagggggtgacagaaagggaggctgtatgagcctggggatggtgagcgctgtgctggcaggtttcagggcctttcggagagaggaccaggccaggaatgaagaggaaggacagaagcgtgggttgcggagggtgtgtggagtggagggccggagcaggcccttgggccttgcgtcctgggggaggtcacgtgagagaaagaagtgggggagtttatgttgcggaaaggctaaaaggaagtgactgttaggaggttatgggataaaggacagaagccaggctccaagtgagtataggagagaccagagcactaaattggaccacagtgtccagcattctggcagcagggaggaggtgggtggggattcaggattagggtccgagtgctccccgagtgtccaccgtcggcctgctctgttccggggcagggccacatctttgtccgtgtgccgaggaggggactggtgggctggagtcccagggggagattattccaagtaggggctccagaaaggtgagtgatgtgtttgggtctatgggaaggttggtgacccccaaagagaggtggctgggttactgctgaacagctatcagggtgatatggctttgcaggggtccagtccatgggcctgacatgttgtagctatgctttgaaggcattttcctggtgggaggccaccgcaggtaaggggagtgaaagggtggctgtggcggctgttccctgtggctggtggccatggataagtgaagaggaacgtgatgctgggcaccatgctggtggtgcctggggcagagcctggccttgtggggctgtggagcagggtgaggatctgggatctaggactgctatgcaccgggccgaatcgtgatacccaagggaggcatcttgtcgtggagcagttgcatgggcccgcccttgttccctggagcagctggtgaggtactgttagaatttggccctaacaggactgggcacagtaggtcacacctgtaatcccagcactttgggaggccgaggctggtgtatcacctgaggtcaggagttcaagaccaggctggccaacatggcgaaacccggtctctattacaaatacacaaaaattagctggacgtgggggtgcacacctgtgatcccagctactcaggaggctgaggctaaagaatcacttgaacctgggaggcagaggttgcagtaagccaagatcacaccattgcacgccagccaaggcgacaagaacgaaactccgtctcaaaaaaaaaaaaaagaatttggccctaacaaatgcaggttgtgattattaacataagtctggtttcctctctcatggcatttctttagtggccagatggtgtgagtggctccagaagactcttctcttctctgtgcaagagccaggaaggctctagaaaggaatgtctgaggaagcatcggagactgggtcccgccatgcctgtgtcatctcctggcttccccggcccttgtgagccccgcggttgcttatttatcctgctaaggccacagtctcaggttccagaaactctggcaaggaagtctgggaaggttgatggggatgggctggcgggctgggagaggtgctttgttttcactcctcaggaagcttgaggcttcttgtggaagcgtctgctgctttgggctgggcagctgcgcccccagaaagccagctaggggtctgccgcctaataccatgggtggaaactattgcagtcagctgttgggatgcaggggaaggtattggtaggactggggtgccctgtctcctttgtccccatgagtgcaggggatagatctgaaaggagaggggaaaatggatgttttcttctttgtctctcctttctccctgctttcaagtctgtgaattaattggagtcattcccaagggaggagggtcactttattgaattttaagacaaggcggggccaggcgcgatggctcacgcctgtaatcccagcactttgggaggccaaggcgggcagatcatgaggtcaagagaccatcctggctaacacagtgaaaccccgtctctactaaaaatacaaaaaaaaaattagccgggcgtggtggcgggcgcctgtagtcccagccactcaggaggctgaggcatgagaatggcatgaactcgggaggcagagcttgcagtgagccaagatccaccactgcactccagcctgggtgacagagcaagactgcgtctcaaaaaaaaaaaaaaagcaagacaaggcatatgacagggcatgatactgacgagaccttggacatcaaaggctggagcaggacttcctcctagggaacatcctcagatatgtagatgtcaccgtgtgggctcagacatccagggtggaccagagccggtggcttaggtctggtggtctgtccctgactgcacttttttcagagctgttttggtttgaagctcaaagcgggctttttatttatttatttagagacagggtcttactccgctgcccaggctggtgcagtggcacactcacaactcactgcagcctcaacctcctgggctcaaacagtcccctcatctcagcatctcaagtagctgggactacaggcatgcaccaccatccccccaggtaatttttaaattttttgtagagacaaggtttcactatgttgcccaggctacaagaggactttaacttttttttaattaaaaaaaaattttttttgaaacaaggtctcactctgtcgcccaggctggagtgcagtggtgcgatcatggctcaccgcagccttgacctctccaggctcaggcgattctcccacctcagccttctgagtagctgggacggcaggcacatgccaccatgcccagctaatttttgtatttttttgtagagatgaggtgtcttcatgttgcccgtgccagtctcaaactcctgggctcaagcgatccacccgccttggcctcccaaagtgctgggactccaggcatgagccaccatgcctggccaagggggcttttcaaaggctgggctgggctgttcatttggaaaaaaggttggggatgttttcacttcaccaggacttctgccagtcagcaggctggtacattaggagcccaagttttgcctggtgctggtggacgggtctaggcctgagaagccgtagtctcctagtgcttggtgctgctaagcccaaagaacagagtggttacaggaaatggaacatttagtctggcagaggccaagggcagcaggtccctactctggctgcccatgtagttaaaaagtcacacacgtgcgcagctggtctgattaatgagtttgttttttgatgtcacagtttctgggcacagcagagctggctcctctgcttggggtctcctcaggctgcagttgaggtgttggccggggctgcattccctgctggggcttggggttctcttctaagctcacctgggttgctggcagtgcttacctcctggcagttgtaggactgagtccccatttccttgctggcattggctggaggccccttctagagcccaccctgttcataggcagttcacacacagctgtttgcttttctcttctcagtgaatctggtttttttgttttttcgtttttgagacggagtcttgctctgttccccaggctggagtgcagtggggcgatcttggctcactgcaagctccgcctcctgggttcatgccattctcctgcctccgcctcctgagtagctgggactacaggcacccaccaccatgcccggctaattttttgtatttttagtagaggtggtttcaccatgttagccaggatggtctcgatctcctgaccttgtgatccgccctcctcggcctcccaaagtgctgggattacaggtgtgagccaccgcgcccggccaagtctgggttttttgaaaagctccctgggtgacttgactctagccctcagggttcagacccttcggtttctgggagtccgtggacattggctgcaggttttgaaaggctggcatctcaagaggggagcagatgaagagtcatggggaaggttcctgtgcagtatgaggaaggtttaattttcttgccaacttttgagataattatgtgtaaatcttttttatatagttaagatgttgctgtgtagttgggtgtccggccttagttaatgtgaacgtttccatgtattagtaaatcttgtgtaaatattatttttaagggccatattattactttgtagtggagttatggtttaatttatctaattttaatgaatttttgttggacatttcgagtggttctttatgcagctggttagtataatgtttcagtgaacttctctctctttttttaaatagcttcactgaggtaattcatgtaccatacaattcaaccctttaaagcagccaatttaatgggttttggtatattacattattactttttaaaaattatggtgaaatatatatacaaatttgacattttaaccactaaaaattaaaattatggtaaaataacataaaatttaccatttttagccgcacagctaaatggtgttaagtatattcctgtcatgcacccatcactatcatccatctccagaactctttccaccttgcaaaactgaaaatctgtactcatttccacccattaaagaacagtgcttcttcccccacgcccagtccctgtaaccaccattctactttctatctctaggaatctgacgactctagaaactttatttaagtggaatcatgcagtatttgtctttttgtgacttatttcacatcatgtcctcaaagttcatctgtgttttactgtgtttcagaaccccttcctttttaagcttgagtaataattcaattgtttgtgtgtgtgtgtgtgtgtgtgtgtgtatatatatatatatttaatctatcattcattgatgggcacttgggtcattttaaccatttttaaatgtacagttcagtggcattaattacattcagtgaatttttttgtggggttttttttttgtttgtttttgaaacaggatctcgctctgccatctcactctgcatctgcactggtgcagtaagagctcactgcagccttgacctcctgtgatcctcccacctcagcctcctgagtagctgggactacagatgcacatcactacactcatctgtcgttttttttctttttgtagagacagggtcttgctgtgttgcccaggctggtcttaaactcctgggctcaaatgatctgcccgccttggcttctcctgaagtgctgggattacaggtgtgagccaccatacttggccaagtgaatacctttttatatgagtttctgcccatgatggggtgggcctctgtcactggatttaccaggtcagagaggtggatggtcttaagacccttgatggctgctgccaggtcaccttccagaaatcctgccccagtttacccttggctttatggttaactgcctgctcttttttgacttttttcttgcctccttctgttcacaggattgtactgaagcagttccatcaggtgctaaaacgtctgagctgtgtggggccttaccctccaaaaatccaaaattgtgatgtgggattttcattccagagaagcagaatctgagattaaggtttgctttgggtcagaggagtctgtgctagactgggctccacggtaattcccgattccttgatgaccctcgaaacagtccagctttgatagggaggagccctgagctggggtcacactggtccactctctcattcaggaagtttcctgaggccactggctgtgtgacactcagttctttgtcagcgctgtggttcttggtagggaaagaacttactgtccccttgtctgttgtgaagtttgctagtttattgctgttgtgggctacttgtaactgaatctgaaaagcattttggcttctcttctgtgcatcgtgagttaggtctgccagatagcattgtccagttaattctggctcatggagttcctgcttggctttcattgaagctccaaggaagcagaaggccatggcagaaaaggatttctacaaagggaaagggacttgcatggctgcacttggctggcagaagctgggctgggacgggaggacaaacacctccctgtgcaggcagtgggttcagatggtcttggctggaaggagggcagataatggtgagaccacgtttggagggagggcagcatggtgtcatgggcttggggaggaaaggagaggaatggccccttcttcagcactgactagtcgtcctgcaccgtggagggtgttccgtcttattttccagcgctcacaactaggagccagcagttcagttttagccatcccagctcatggattatggagctgggacccacgcttgctcctcctcttgctctgcgttgcccatcttagctgtgcccttggccgccactctgactccagtgaatcacgtagactccttgggcctctgaattcctgtccgtaaatgatgaagctgaatggcagcatttttaagatccgttagttttgtgattctaaataaaattaagtcatgttgctctgagttcccagaaaattattttaagatccgttagttttgtgattctaaataaaattaagtcatgttgctctgagttcccagcaaattatttggaaatccctcttggtggatgtcccaaagcagccttcctgtaggatcctggttgtgtctggcttcctgcagtaatgtggattggggtggattggcctctgtgtgcacccttaatgggaaccaggacactgctttgctggctgatttgttgtcctcccttactgcccactggccagtctacaggtcaccaccaggactggaacagatttcagaggccgtgcaggtttcatctggggcaacgtgccaaagtgcagagcgtgggcagcgggaggccctgccgtccgcgtggatgggggagacggcagcatgggggtgtctgccagggcggaggtgatgatgtgcaagcaggtggttggcagcaggaggcctggtagtgccagctggtgtcttgccagccagagcacagccccgcttggtcaggaatgcatgtgctgaggccagcactgagatgagcaggcatgcgtgtgtggccacccctatttctgtgctatagtgggaggagcacattaggtactttgaggccataatttacctttgttacagatgaccaattccccaacagcctcccagccttttgcaggccccacctgggatcagaaggcaaggtatccttcctgcagggaaagcctgttagtctttcctgagcattcttagtgccagttggagtaggggctgtcttggtactgagctggccggtgctggagatgggctggtcagtctggagggcataaggacaggaaggataccggcactgaacgttgtcactcctgtgggggtacagatgcctcagtggaagccacgctttccttcagaatattgcatttggtgggcctgtctcaaggtgcactttgactcctgaagaccctccttctcctcctctcacggatctgccggtgttccctctctggaaggcttgcaggagagacaggatccctccctttactggaactttgcacttgggtttggctttgtgctttgtaaggggatcccattcagcgtccaggatccgagccttgctctatttctgcaaggagctggtggttgctgctcgccaaggggatactcagacagccaaagcctaggcaggatcagaagctcaggcagcagagccaagatttgaaccaataatttttttttttttttttttactttactctacagtattgggattggctgaactttccttaaatgaccagatagtaactaattttatgtttgtggctgagaggcaaaatcgatgctactttgtggatacttacataaccatttggaatgtgagcatgtgaaactataaagagcattcttaaggcctaggtcacatgaaaacaggtggcagtgggctggatttggcctgtgggctgcagtttgccaacctgtgtttcacagcgagctgcctccaaatgcctggtggtgatgcaatcgatgacagagccaggtgtgggcgtctcacatctgtgctcaggagctcacaggagcttctctcctatagaacctgtgaggcaggtagggtagtcttccaaaccccatgaggattctttcctcagagaagttgccggaggaggaaaagctggatgagagatggtcacttggtttctaacttccctttctcttccctgtttcctgctgcttcccagggctgaatgaatattccctgaaacaaggctggccatgagctaataatcgttgaagccaaatgatggggtaatgggcattcatgatgctgtgctcttacttttgtatttgtttgaaattttccaggataaaaagctaagaaaataggctgggggcggtggctcacgcctgtaatcccagcactttgggaggccaaggtgggcggatcacgaggtcaggagatcgggaccatcctggcttacacggtgaaaccatgtctctactaaaaatacaaaaaaaaagtagccgggcgtggtggcgggcacctgtaatcccagctactcgggaggctgaggcaggagaatggcatgaacccaggaggcggagcttgcagtgagccgagattgtgccactgcactccagcctgggcaacatagcgagactccgtctcaaaaaaaaaaaaaaaagttaagaaaatagtcattcattgattaaagttaccaaaaaacccttccacattgagagaacagggtgttaaaactcagaaaccttttcaagccccaagatgagcaaacttgctcctcttatttcctagcagcagatgttcctgagaaaggggtagctgtgcttgagccattccatcattcatccaagccatccatctatccatctattcatcatcaatccaagatccaaacatttatctatttatctatccacccatccatccaaccagtcatacaaccatccatttaactattctttattcatcatccatccaactaaatctattcatccctctgtcatccattcattcctccctccctccctccctccctccctccctccatccatccatccatcatctgtctaacatccagccaaccatccatccattcaacattgaactatccattattcactcatccatccaaacatgcatccattcagtcatcacctattcatccatccattcatcctccaaccattcatctgttcatttgaagttgatgtgacacctactggggtccaagcacaatgcttaggccttgactttgtccttgacctcaaggaacccatagacatatattaaaaacagctgataaaggggtgctgggatggaagtgagtaccaaccaggcactgagaagtgactgactctgctgggttagcagaaggaagacattaaggagaggatggcccattagttggatcttgaatggactcaaaaggagtatattgtaatcccagtactttgggaggctgagttgggagggtcgcttgagcccaggagttcaaaaccagcctaagcaacatagcaagacgctgtctttacaaaaaattaaaaattagccaggtgttttggtgcacacctgtagttccagctactctggaggctgagttgggaggatcgcttgagcccaggagtttgaggctacattgagctgtgattgcaccactgcactctagcctgggcgacagagacagaccctgtctctgaaaaacaaaacaaacaaaaggagtatgttaggccattgtaggggaggaggagaggccttctaagcagggactgtcacaaaggaatgaaagagcctaacagcctggcctgccacaggtttctcagacacttgggatagctggcatatggtgttggggtgagagaccagctagtgatgatgtggggtggtctggtgttgacccccagaggccagagaagacttctgcatggaggatggagtgagcatggagtgtgcgactgccataggccctgctcagtgccctacaccccgtgtgtgcctgtgacacctgatggcctatgcaccccatacacacagctggacagcagaccccggctgccctggctgaggcaggtgtgcccatctgtacccacctttgctttggctcattggctcctggtctcctgttgccgagcacctgtctagacagaatgatgttttgtgtctgtgcaaaacagacacgctggagcttcgtgtttgcagagcttcatgcttcagttggtaccccgtgaggcttgtgtgggcagctgttcagaaacctcaattgggccctctggcatttgtgagaaccttgggctggaacccacccggctggcagtgcaggagagcagcccttccccctcgagggccttgtccctttcacctgtgccgtgtctgtgtgacactgaagctctgtctggtgcgggttgaagtttgtgacccccacttaccaggcccagagcatgcatggtggactgtgggagatagtcattgggatttttcatttgattttatgttttttttttaatcaaggtaaaatacatgtaacatttaccatcttaaccatttaaaaataacacagttcagtggtgttgagtatgttcatgttgttcagccatcaccatctgtcactgaatgtttttgtcttgtacaacaaaaactctggactcagccaggcactgtggctcatgcctataatcccagcactttgggagttcgaggcgggcagaccacctgaagtcaggagttcaagaccagtctggccaacgtggtgaaaccccgtctctactaaaaatacaaaataattagccaggcatggtagcgggcgcctgtaatcccagctcctcaggaggctgaggcaggagaatcgcttgaacccgggaggcggaggttgcagcgaactgagatcggtccactgcactccagcctgggcaacagagcgagactccgtctaaaaacaaaccaaaaaaagcttctggactcattaaatataggctttccatttcccctccccgcggcaaccactgttctactttctgtatggatttggctaatcgaggtacttcatatgagtggattcatatagccttcgtcttttgttcctggcttatttcacgtaacgtcatgtcctcaaggttcatcggtgttgtagcatgcattagaatctcctttcttttagccgggcgcggtggctcacgcctgtaatcccagcactttggtaggccgaagtgtggatcacctgagctcaggagttcaagaccacccaggacaacatcatgagaccccatctctactaaaaatacaaaaaaatgaaccgggtgtggtggcacacgcctctagtctcagctacttgggaggctgaggcaggagaatcgcttgagccccagaggtgaaggttgcagtgagccgagatcacgccactgcactccagcttgggctacagagtgagactctgtctcaaaaaaaaagaatctcttttctttttaaagctgaataatattccattggtagacacacattttgtttatccatctctctgccagtagacacttgggttgcctccaccttttggctgttgtgaataatgttggcaggaacatgggtgtacaaatttcgtggcttgtttgctaatttatttattcatttttattttatttttttgagatggagtctcgctctgttgcccaggctggagtgcagtggcgcgatctcggctcactgcaacctcccctgcctcccgggttcacaccattctgcctcagcctcccaagtagctgggactacaggcacccgccaccacacctggctaattttttgtattttcagtagaaacggggtttcaccgtgttagccaggatggtcttgatctcctgaccttgtgatccgcgcccagcctattttttaatttttttagagatggggtcttgctgtgttgcccaggctggtctcaacctcctggcctcaggccatcctcctgccttagccccctgagtaactgtgattacagacatgcaccactgcgcccctactcaatggtatttttcacatatcagatttttacattatttgcccctcacccacttaacagctatttgtttttcaactaacttcctttactgtttcaacaaatttccaattatagtaatttttaccctagaaaaaagaaattatgggttgaaggtaaaacaaaaatacatatcttgtgaattatctgttctttttcaaacatcttaaagacttaggctgggcacagcagctcacacctgtattaccgggaggctgaggcaggaggattgcttgagcccaggaatttgagagcagcctgggcaacaaagtgagaccccatctctacaaaaaaatttgaaaattagctgggcatggtggcatggacctatagtcctggccgcttgagaaactgaggtgggaagatagcttgagcccgggaggtcgaggttgcggtgagccacaattgtgccactgtactccagcctgggtgacagagtaagaccctgtctcaaaaagaaaaaaaaaaaaaaaattaaaggcttgaaagatgtcatgatgtcatttgatggttgtatatgtgcacgtatgtgcattcaggtgtaatttacagacaatgaaagtcactcttggtatactgttctgtgaggtgtgacagcgttctgtagccattaccttcatcaagatacacagcaggcctatcaccccagaaacttgcattaccccttgttccttgtaggcatttctcctacttgcagcccacgacaccactgatgtgctttctccccttacagtttagcacttttccgaatgtcatataaatagaattgtacagtgtgtaaccttttggctctggcttttttcactttgataatgcatttgaaattcatgcaagttgtgtgtaccaatagggcattcctttttattaccgaggattatttcatcccacagatgggtcagtactgttcttcccctttctatcccactaacatctttattcagatgtaacatacataccatagagttcacccgtttaaaatggaccattcagtggtggttagtattatctcagagttgtgcagtcatcatcactgtctgattgcagatcattttcatcacccccaaaagaaaccctatacctattagcactctctccccatccccttcttctgttagtcctggcaaccaccagtctgctttctgcctctgtggatttgtcttttctgggcttttcataaatgggatcacatggtacatagcttttggtgacagagttcttagagcttctttttttatttgtttgttttttgttgagacggagtcttgctctgtcgcccaggctggagtgcagtggcgcgatctcggctcactgcaagctccgcctcccgggttcacaccattctcctgcctcagcctcccaagtagctgggactacaggcgcccgccactacacccagctaatttttttgtatttttagtaaagacagggtttcactgtgttagccaggatggtctcgatttcctgacctcgtgatccgcctgccttggcctcctaaagtgctgggattacagacgtgaccactgcgcccggcccttttttttgagacagtctcactctgttgcccaggctggagtgcagtggtacaatcttggctcactgcagcctccgcctgccgggttcaaggattctcctgcctcagcctcccgagcagctgggattacaggcgcccaccaccacgcctggctagttttttttgttttgttttgttttgttttttgtatttttaatagagacagggtttcatcatgttgtccaggctggttgtaaactcctaacctcaggtgatccacccgccttggcctcccagagtgctgggattatcttagagcttctcaatagaagtcctatcttccaggccacatctcaccctccaggggtaggggctggtggagctgttctcactcagtttgtcctcagttccttcttgagcctggacccttccctctagatttggggctgctcctctcagagtgccccagaacaaaaccccctccctgttcccacttcccactgtctgcaggactcccctaccccataaccagggtcctgccagccctaccctcagcctcccataagggtctgaagtggcaggtggatgggaaactgcactctctgacctctgcaaggggactgctgctttcccatgagcttctcctctttccgttgctggtttcttctttgttatctttgctgctggagtggccagaccctgggaagcgggctggagagaggagagaagccatcgagccacatggacccctacagcccggaatctgagctgtggtaggattggctgcgattgggattggcagacacactgggtttgtacaggaggggaccctgaaggatgggctgtggtcaaagtgggatcccttcactgtccatagtccttggatctgaaactgctgacaggtgcccctgggaactgctgtggtatttggagtctatagagacacccattgctcaggaccccagggccttaacagggagtacactggcttctgggaagcttgatggagttgttgctgcataggtgcagaaaatcccagcagtggagtaaggcctgaagtaagcccccactgggctctgtggggcctggggcagcctcctctgttgcagggccgccagcatctccagcagaagtgcagtgcttgctctggggacacaggggccttttggaatgagcatgtggacttggcttatggattgtgcctaccccagagcgttgctgtgtctctcaacacacacagcttccatgggctgctcactccaattctgatggagagggcatttatgactctgtccgttggtttgttttctcactgaagaggaacatagatgcacctgctctctgggcaagagatgtggcagctgcaagctgcacaccctgttctgaatattgcccagaccagaatatgaattacttggtcataaatcagtgtcttgtctgcagaaaacttggcaatgtgagggacggcagctttaacttgattcctgggaggctgccggcctcaaaaaggacaaggactggcaatcagatgggcattctctctaatttgggaggctttcgggcttcctcacggagtgctgctcctggggacgtaccacaagaacctcccttgtctagttttgttctgacgcttgggctcattcacctgactgtctccttgcttgtctggctctcaggaaagccttcccggagaggatgtggctgacccctgcagccatctctccacagacaatcatggccctgagcttggctgtccttggttgggtacatccaaggctctgcctgccagggtaggcactggccaggctgtgggatggcagcgttgctgacttgtgctcctgagtcctgggggccctgagtgagcctccgtgcaggagtcgggctgggctgagaggtgtggagagtcgttcccttaatggatggtcaggcacagcagctatgggctcaaattccggagggacgctgagccaggtcccagcctgtgcactgagcatgtcattcactttgagatcccctctagggtaaggcacaccgtgagtggatgtgccactaagaaggaggcagcaggctgagcgtggtggctcacgcctgtaatcccagctctttgggaggccaaggtgggaagattgcttgaagccagaagtttgagaccagcctgggcaagaaagtgagagctcgtctctccaaaaaaacgtaaaaatattaattgctggggcgtggtggtgcatgcctgtagtcctagctactcaggaggctgaggcaggagaatcgcctgaatgacccaggagttcaaggctatagtgagctatgattgcaccactgtacttcagcctgggcaacagagcaagacccctgtctcttaaaaaaaaaaaaaaagaagaagaaggaggaggaagacagtactcccagttatcattgcgagaggcagagatgcgagattccactttgaattatgttgaaatttggggaaaatgcatgcctgataatgggtaaaatacagtaagtttcctcatctgtgaaatagaaatcccactagtcgttgactcaggaacttgctgtgaagattagagatgaggtgtgcaaaaaaaagcacctagcgtggctgctggcatgccctgagtgcttaataacatttgttattctcattttattgttgttatcgtagttgctgttatgacagatagcgggagaggatgttggctgctttatcagctggctggatgtttggtttgtttttttttttttgtgagggttaaagtgggagatgggaagctgtctttttccatcagagttggaaaggcccggagtgttcatttctcagcaataattgttttcaaatggttttattttagggatagatcccttctttgccaatggtatttcagatgaccccccagtatatgaaaaagatgaaagaggagccacaggtcctgaaggctgcccagctcagcctccccacccaacctgggctctgaggacctggcttgggaggtgctgctcttggcagccccagccttccacctctgtggcctgtgccatggccaggaggacctgcatttccttcggactgtctctctgctcaggcggattatttcgtgcttcgtgtgccctcccagggtagggacggggaagctgtgaggatgctctgtggggatcggctccctgtgttgtccatgtcttcttttaggtggagttggctaggcagggaacctggcaccatttccttctcagagcagagaaacagagtcggcgtttgtgagcgtgcattgtccaaacctgcatttggaaggggtcaaagtaggctgggctttgtttttactttttctttttaaattatgatgaactatacataatgtaaaatttaccacttcagccatttttaagcatacgatcgatgcatgacattaactacattgatggtgttgggcaaccatcaccactatccatctccagaactttttcatcttccccagactgaaggtctgtacccatttatagccagtaaacaactctctactccctcctccctcagcccctggccaccaccatcctactctatgtctatgaatttgactactctagagacctcatatgagtggagtcctacagcgtttgtccatttgcatctggtttatttcacttaacataatgtcctcaagtttcatccttgccttggcatgtattagaattttcttcctttttaaggctgaataatattccattatatgtctgcaccgcattttgcttatgcatccattggtggatggacacctggcttgtttctgccttttgtaaagcatgctgctgtgaacacgggtatacatgcttttactcttgaccccttgcaaacaggtctgtcttgcacatgtgccccaggtaccactcagccatctgctcattaatgggagaggggagaaccttcccggttctcttgagtaactaccatgatcacagctttctggaatgtagcaggttacttgataaagagggcgggaattcttagaaaggagggtttctggctgcaagccccatacctgttttctgccaccttctctgccaagggagcttgagccagccatttctgggaagtggtgagcctcagatatggttcagggaagatgggaagtgttacagtgtaattccatctgctgatggggacaggcacaaacctggtggcttgttgtccttggaacagtcagtgatgaaggcagagtggcggtaggacagggaccccgcttagttatgacactgcctcctaagtggaactaagtggaaggtctagtggggccttcttcgtgggttgggacagtggttctgcacccccactcagcagctcaggaactgaagttagagcctgccttcaggggatgggcatgtgtacaagggataggggaccagttaatccaggagttagatggtgactgagactccaggaatttcccctttcctgtaaacatgggtcattttctagaattaccacgttccctttaattttgccatgtttaggaaatctggctgagctggtaattaccaagtctaactgagaaatgtcttatatgtaaccttctgtttcccttgagtgtttcggaggaagctgtgggcacgttttatggataggtgctccgagttctttccgctttggtccagtctgagtggctctgataagcgttggcaacaccaccgatttttgtggggcctggcttcagaacatgaatgtctgtgtttctgcaaaaccaagtgtactcactgcctccttttaaaatcatgctacaaggatgtctttcactttgaattctgcgcttacattgttcaagaggcatcaccatgtttataacctcagacgcagtaattccaccctagggcattttcctaaggaaaattgcttcccccttttcttttatggtagtattatgtgaaattattcattgtattcataacagtggaaagctggaaacaaactgagcatcctgtaatacaaaaggggttccattagcttggtagacgattctgtcatcatccgatggtaaggatgaaaatgaattagcaacgtggaacattgtcataagtggaaaaagtgagatgcccaaagtgtgatgatttgtatcagtcatctcttgttcggtaacaaaccatcccaaagtttagaggcttaaaacaatgcgatttaatcgcagtgccatctggcttggtatgaggtggttctgctgtcacacaggcttggtcatgtgactgtattcagtttgtggtttgactgccgctggcatccgaggtggcctaaccgttgtagctaaggacttggtagggacaccggaaggctgagacctctctctccttgtggtccgtcattgttctgcagtgaagcctgagttgcttctcatggaggctaggttccaagagcaaaggtggatgctgcagggcttcctgaggcctgggctatggaacttctcagctgaacttccaccggattctgttggtacagtgtgtcgcaagtcttgcccagatctaagcgggggtagaaagctggactctacctcttgatgggaggagcagcagtgtcatgtggacacacggcgtggacacaaggcatgattctcaggggctctggtgattgctcccaccacaggattttagttacacagtcacaggacaaggactggaagtgattgtgggaaaatgatcctagaccattggtagaggaggtgaggttgtggatgacttttttagatttttgctgttgccatgttatatagtaggttcaaagtaaaaaatccttagcatgttatccactggactcctagttcaagattgctggggtgtcagatccactgttaggtcccataaacttgcaggctcggccagtgcagaacctctgcagcctggccttcgggaagaagacatccagagatagtgaccacaccatggggtaccttcaagctctggtgctctctcttcgccttgctgaccttgatggagtggataggccttgggttcaacatgaattgacccaggccatgggggcattggttggcctcctctgtaaggtaggcgtggggctcagcctgcaagagctgaccatacttatgtaggattagggggcatcggtgggaaccctggtgtccaaggacagtattgtctggttgactgaagttagggaagtgggtggggaacatggaattgtcaatccttcaggctccttttgaaggtcattgttttcctaaacagatggttatttggactcttacaagttctctgtaagtttgtaaatgtttgaaaataaatagtggaataaataaatacatgggaaaccgcactttgcctacgtgtgggatgctcgtgagacctggagggagggcactcccatgaaggcggggatcccgggtaggcggtgatctgcagctgtggccgcctgctcggacaggaaaggccttgacgtccagatcctgctggtgggagagccgtggcccaggctcctacattgccttggggaggagagtcaggccctgcagggaagggttgtgaacctgctctgggcaaatgggcctggctcctgggaaacttcgggcctgcagtaaccctactctgaccagaggaatccttcccctgtcgcattggcatccctcccctcactgttctcttcattctggacccccttgtcatcacgatgccagtgctgtccctttggtgtggggtttgtgctctgacctgaccctcaggccctgccagtgccctggcttccaggcagatctgggcaggcaggtctgagcccccggagctgggtaagcatctggggcatgtgaggattgcaggaggtgacccgggacagtgcctcacgcccagggtgaccagaaactgtgttcccttccctaacccaccgggtttaaactttttacttgctagccatagagctcttaatcagacaatatccaggggaacccccattatgtaaggcaggtaaagctggtggaagctctcccacccactagttgtccctgctcagccttggcacggggccactgtgggaccggagagctgggaagccaccacctcagtccctgccagtctctggtctgatggtgaggaggggtctggcctgctcagtggcagggtgcggaggtgaggctggtggctgttcttcagctgtgggactcgtgtggggacaagctgaacagtgtgctgatctctgatcaccactcaagccacaagtgactggacaggcatggacctgtgtcctcatagtgaggacccatggggcttcacccaggacagcctggttcgcctgccctccgatgctggtggaggggaggcaaggcagaggggactcctgtaaagggctgtttttttctgtcctggaatgagcacattctgagggtgagtggctgtcagcagttaggaaaaattgcctgttgacttgtttcattaagaggccccttgccgagggtgaggtcgcagcccggccctgctcagggaggaagcggtgtttacagagcggccagctggtgccgggtgaggaggtggctgatccctcgttatggagctgagaaggcctgcgcttccagcccattcctgccatgccgctgccctaatggctgtgacaatggatggatggatggacggagggccaggccaaccaggcagtgaaaacaggaaacctaatcttttaaaaataatccagggggaggggagaaagtgaagcagcaaagcccttaagccgacagatggccctggtggggtgtgtcttccaactgggtaggtgcttctcaaggctgaaaattccagtgagtcggtgaaagctgagcgtgcccaccaaagacacttgaatgggcggctggcattttcaagctctgttccttatgttagacgatgttgttttagcacaaagcctccccccggatcccaagcctctccccaccatggctccagagtcatccctatgtggaacccagcggggcagtctgaccttgtccctttggctgtgaccctgtcccacccttggcctctgtccctggttcttgcccaggtccactattgcatggccagattcatcctcacagggacctgaccgctgttcccttctcacaaacctctgagttgcccatgggctgaaggtcaaggtcacgcatctcaggcaggcaggtgtgcaggaccctccacgctcgtgggcactggcggtgcgggagcacagctccctcctctctgctagctctgagagtcccccgccacccctctgtgtgcttcctgcaccccctctccttgcctagaatgtcccccacaatgtctccacttgcccagctctgtcctctgtgtccagctttgaggctactttctgcagtcaccactattatcccaccccatgtagttctctgtccccgacctgcatgtaacctgtttccctcctccggccgctctcagccgctccttcatgcctccttcctgggctccctttggtacttgtgtgtgcaccgccttctcgcctccaagtctgcagttcctggagcattgagtcatcctgttaccattgcttctgactcgaaggacacggccccttggggctggctggtgtcatgtgtggctgcacagaggggaggggctgttctgccacctgccctttgaggctgtgtgggcacggttccctctagagctccatgtctagcagagcatgcgggggtcctgctgtgcccccactcccatagtgcttgaaccacttcaccccttgcatggggaccaacaggatctacctccctctgtcgaatgtacttctgaaaggaggaaggttacactgaagtttcacctaccgtccatgggattttgaccctgctgtagtgacagctgcatgtttggttctaggggaggaggggtgaatgacttatcttggagaagccagagccaggtgtcagggaatggcctctgtgtctgccacctcctgctgcctctctgcctgggtcatttggttcagtggctataactgtcttggagcagcatttgcttccaggttgggttcaggtatgaagtgctgaaaacatgggaatccctgagcccagccccacccaggcttggtctgctaggggaggtggaagcagggcttctgaggccctgaggctgcctggggagtgcgtttcttctccacccacttgcaagctcagctcacttcctcttactgtatacttggtgtttcattcacactccttgcagcatgcttctgggatatgatgaaaatcagctgtgggtgttgatttcggagctgggcaacgatcctctctggacccgcattcccatctgtaagatgggggtagtaacctccaccctcactgcttcctggaattgttgatgcatcagagagagcagccagtttgcactgtgggcttccagggagatttatttcatgccatggttccccttttggataaggggctagatttgctttcttcatcagattgtccccggggacacacacaggagttgctctcacgtcgttgcctcttggtatctttgaagcctgtctgttagaacccgcctctttgatggtagggcaggatttggagaggtgatggcctctttgggttgaatttctcactctaatgggctcacagtaccttctgattacctcctggttcagcttccttgacaacaaactagaattgcttcagatgcaatacttcattcttcctagtgcatgagtaattcatatccactatttgctccctcttttacaaattggaggatggcgatgcagatggaagatgacctgctcatgcatcaggccgagacttcaggcttccgaggcacatgtttgaggttgagactccctagggagagtggagtcacctttgctttgcagaggagccatgggggaccatgtctcagcacctctgaaaggttttctgccccatccagtctgctgcttctctcccctccctccttcaccctgttccccttcatcaggggtgtaaatgatggtcttcctgtcttcccatgcacctcccttaggaccagagcaggtgggagatgtcttcacaggagggttccaggatgataggtttggagcaaagggctgggggcttctggggagccccattcctgcacctccatgctgaatgaagaggccacacgaggatgctcacactgctcagtgcttcttagagaaagctgctggctctgattaggtctggtagggggcagggtccttatttctcaggactcaagacagatcctcaatcaatggcaagagtcatttttgttttcccgccaggctcactagagtttctgtctcttcccacttttctttgtgggacagctttcgggagggtggggttgtctttgttatgagaagtgacagccagatggactcagtggctcacacctgtaatcccagcactttgcggggccgaggcaggcagaatctgaggtcaggagttcgagaccagcctggctaacatgttgaaaccctgtttttactgaaaagacaaaaaattagctgggcgtggtggcaggcgcctgtaattccagctacttgggaggctgaggcaggagaatcacttgaacccaggaggcggaggttgcagtgagctgagatcatgccactgcactccagcttgggcaacagagtgagactctgtctcaaaaaacaaaaaaaagagagagaagtgatagccctccccgtcttctcacctgtcactcctcttggtctccctgtggagcaagtttcctgcagtcactatgtgctttgttcacttctacatccacagtgcctaaaacaatgccagcacgtagtaggtgctcagttaatgcttgcagagtgaacaggtgacacacctgcctggcgcgtcttgggccccttattaggcacagtaaggcatagaaaactgtctgattccggccgagtttccaggctaagtgggaaggtggaacacagcatatgaagattaaaatgagaagtaaagtgatagttcacagtatgttggtgggaaaaggttgatacgattgtcagataaattgcacaagtgctaagtgctgagaaagttcagagcaggggaagtggttcccgaggaaggaggcagaggagtgtagattttgtagagaaggctaagagagggtgggatgtggcaaagggcgaagggtagaaggagacatgacctgggagaggggagcgtggcaggggcccatgggcttcagggctgtgaccaacagcatgctggtgaacagaccagacgtgggctatgttgtctgggcctgtgaagctgagttcaagagcccaagccttcctccctcatgcccatgctgttggaaccttgaggtggttacctgggcagaattcctgtcctggtctctgggcagcatctctcctgcttctgataaagactaacaaggtgtcttagtctgttcaggctgccataacaaaatgccaggctgggctgtttataaacaagagagatttagtgcgcacagttctggatttggggaagtttgagatcaaggcacctacagattacatgttagataagggctccctgcttcatagatggcatcttcctgctgtttttcatgtggcagaagggccaaagaagctctcttgggcttcttattgtaaaggcattaatttcattcatgagggttccacccttacgacctcatcacctcccagcagccccacctcttagtattatcacattgggggttagactttaacataagagctttggtggggggtacagtattaagtccatagcacaaggggtgacaccttggagtgggtggagggtgaccacctagcagtgtgacaagaactccactaagggaattggggtgtgagtgtgagcatgtgtgagtatttgtatgtgcacacttgtgtgtgtacatgcatatctccaagtgtccatgtatggctgtgtgagtgcatgtgcctgtgtgtggcccattgggggacaggagcaggggccttgaggctgggctttgggctttgtgtacatttcttagcatcttgtagatgcggatgctgactccctcctatggtgcctctcaagatgaaatgagagcatatccaaagccctgtgtgcacagtcgctcccttcttccctcttctcctggtatcagcccccctattctggctggctgagccctaggctgccggtgcagggggtactcagggaggagggctcaggcaggcagcagaggcctggagggcctggctctgtgggatctgtgaccttctccactccagttggcaagggtccaggtgagtctcccaccctcccagtgcacagcgagatttcaggttttgtttctagaccctgattgccatgtggttttcacaccgcctctcctcctgccattgacagtggggggctttgattgctgtcccccctgtaatgggaacactttgctgaccttttccttcctttccccgctaaatgattcctggccaaagccctgcctccccatggggagccgcctcttcctgcctttcccaaaggcacaggccctgatgcccaggaccccgtgtaggacacacagggacagacaggagtgcccttatctcacccgctggtttggagggacagtttatctctcttttccacatggtctaaaggaagctggtgctgaaatggcagagacagggactgactccacaacaggaagacaggctcgggcgcagatctctcgactgtggccgccacacagtggtcactgctgttgtcctgggccacctctctgatccccagggctctcctgtcccaagtggctgcctgaattggttttttgcactggcatttatacctttacttggttaatgattcttagagttctttatggactgtagggggaggaccgaggtccaggtggtggtgatggctgctttctaactggcagtcctgggcagtgccttgaggggaggcatttcttctaaagctcagctctcacttgtgcctccaggagagtcaaactgccgccttgctctgagccatctcaaagtgaggtgagccacattctctcagcagggtggtgggttggcagatgacttgaaggaagagcccactccctgcttacccactctcgttttaatacgccaagtctgcccagagacgctggcctcctcaaaggaggaaagacaccctccaaaacctgctgagaggccgggggctgtagctcacgcctgtaatcccaacactttgggaggccaaggtgggcggatcacttgaggtcaggagttccagaccagcctggcccacacagtgaaaccctgtctctactaagaatacaaaaatcagccaggcatggtggcacacgcctgtgatcccagctacttgggaggctgagtcaggataatcgcttgaacccagaaggtagaggttgcagtaagccgagatcacgccactgcactccatcctgggcgacagagcaagactccatcccccccaaaaaaacaaaacctggacagagtggccccctgcaggccccccgcttcttggggctggagcaagtgttcttatagatgtctctggtcgtcttggccactggctcggagacagccaccgagacccggcatttggagcagctggctgggatgctgcagggaggggtgtccaagcaggaggcagccaagcctgcctggagcaggataagatgagctcccctctgagactcagtattttctgttcaatgaaaggaacagtccagtatttgagacaggagaaccggaattgacttgactggtctgtggtgctttttttttttttttcctgtgccttgattcttccatttaaatacagaggacacctgaccctaaggcgcatggaccagagacatcatctgaacccagagtagcgtgcatggtgattattttgagatttcctctctgtccccatctgggctcattttcactggatggaccccaccatgcttcttagaccctgcggcaggctggccagcccaggtggagggcatgcgctttgccaaaggcgagaccgctggctggagactggactgcggggccatcctccaggctcttgcacggggacctggaggatgtggcccaagctcagtctccttcagtctgcattggtggctaatcaggacacgggtatgggggaaatccctgtaggtctggaggtggctgggatggcccagggcttgtttctcaccctttacctctagtttatatcccactgacaccgaggtttattcgcaatgcacttcagcagatagggtgatggggtagaatcacagagctgaggagtccacggtaaagaattccaggtccctgtgcttctcctgcatcccagctcttctgtcattggaaggcagtcatccaagactcctcccttttctggcctttgctgtcagggagcctgggggccagttcactattcatttcgcacagtcagtgcatcccagggcctgaaacacgctttgagccttcatttttgttttcttcccagtggccttatttttacactgtttgatttcttaaggctgctttggatccttttaaaagtaggcgagtgaaaagctacacaaacaaactcctgggcttggcaccctcctgtgcccacatccggcgccctttctttgggacctgccggagcctgggtcccctggcagggtggggcaggatagggtggggtgttgcctgagaaatggtgcaaaccttcttgcactccgtaaatgattcatttccttcaaatgtcctatgctgttttccagcagaatctccattatgtatgaatcaagatcctggctgacattttctgccttggctgttgtgagctttcccgtcagaaatatccttcccatggggcctgaagtaattattttatatttattggcattaagtgtatgagagagagagagagagagagagtgtgtgtgtgtgtgtgtgtgtgtgtgtcagaagtggtgtatcagctgccacatagtaagagagcaaaggatcttcttttgtcttatggtgttttacctgtgctgattggttcttggcagcctttaaatgcctaggcagagaggaagagagaggttcctaagcttcatggtgaatttctaagtctgtgttgactgcaggaaatgtatgaggaaaggatggtggttgaggcctctccctcacatttaggccaggggttggcaaattgcagcttagtcctgtctgctgcctgtttttgtaaataaaattttattggaacacagcttgctcattggcttatgtataacatttggctgctttcatgctatgatgacaaggttgagtagttgagacagatgccatgtggcttgcaaagctgaagatattcattagctggctctttccaggaaaagtttgacccctgctttaggataaaacagagaaatggagagacatggaatagcagagtatcttttcaactaggttcaatatgaatgaacaggtcccctcagttgcacctgaaaggggccagaagtcctataggtttgggtttgggggagattgaagttagacttgcttggttcagagaccaggccaggatcgagcatttgccattggtgacctggaggtgtctggagcaggatccttttaaataggcaagctgcttgctgggaacacagttcaccttaagctttaaaaaaaattccttcaaagccaaaaaccatgcaaatatggagctgcctgacaagccgaatgattgatagggtagaaaatagggtctgtcataaaatatttgaggaggtggatttttacagcagggagaagcaggctgacaagtgccacttgttaatggtgactaccaccttccgtacctactgtgtgccaggcatagcaatagacactttgttattgtgttccgtctagaaacaaccctgctaagtagctcccagtattccccagttaccagtggaggctccaaagatatatcttttgtgtgaattgcacagcccacgatcagggaggaagccatcccctgtggtccagccctctgcacaggtaatgggggaattagctggaattgcagccatcctgtaggacataaggaagaacatcttgactgtaagcatggttaaacactgggatgagctgtcagggaagcgtgagagatccccatctgggaggagctttggaaaggagaaacatttgtaagtctattttcagctttcagctgcatggtgacacagggcattggccttgatggcctctaggagatcttgtgacctttctgatttcagcattctctctcctgtcacatcagaccctttgctggtttagatcacaatagtactgccagtgctgcacccttttagaacttctaaggccatgagttattggagattcagtttccagggtggttcttgaacctaagaaatcttctagaagcctgggtcatgttgtgaggtccttgtgcctgttgggtcgtggttctgtctgcctcaggttactgttggccccagggctctttttcctgcaggccttagttagcaccatgaatggttaggggtatgggggtcagggtgagtggtcaccagtgggtttcaagggattggcctatttcatctaagttgccaaacttatgtgcacagagttgttcgcagtatttccctagcatcttcttaatgtgtgtgggatcagtagtgatatcccctctttcatttctgattttggtcatttgtgcctttctttttttgtttgttagtctgctagaagtctgttacttctttttgttgggtttactttgttcatcttttaaaaaaaattttagagacctttcctcttttctgatataagcatttgatgctgtgaatttgcctccaagcactgctttagctgcatcctacaaatttttatatattgcatttttattttcagtcattccaaaccagtttctaattttcctcgagacttcctttttcatctgtggatcatttagtagtgtttaatagtaatgtttcatttctaagtatttggaggtttttccaggtgtcattctgttactgatttttagtcaaaaataaatgtattagtttcctattgcagctgcaataaattgccacaaacttagtgacttcaaacaacaaaacatactaccttatagttctggccagaagcttaaaagaggccttatagggctaagtcttagttttccttcatctgagaaggtctttattttgccttcattcctgaaggatattttcattggatataacattctgggttgacagttcctttcttttaggactttaagatgtttcatccccttctggcctctatagtttctgatgggaaatctacagttacgtgaatccttattctcctgtatgtaatatgttgtttttctctgactgctttcaagacttttttctttaactttggttttctgtgcttttattatgatatgtctggctgtagttttctttctttatcctgtttggggttcactgcatttctcgggtctgtaaatttatgttcttcccctaatttgggaagtgttcagctattgtattttccgatactgttttctgcttccatctctcctctctttctgggacacctgggacatgaaattagacatcaacatcttttgatgttgttccatagatgcttgaggttttattccatttttctccatttttgttttctctctcttatttagattggataatttctattgatctatctttaagttcactgactccattgtcatctccattctgctgttgaacccctccaggtaattgtttattttttggttctaaaattcctatttggttcttttttatagcttctattttttttggctgagaaggcctgtctttttatttgtttcaagagtctttgtcctttcttcttagagcatggttataatagctgctttaaagtcttagtctgataattcaaacatttgggtcatcttggggttgatgttagttgattgccttttcctttcacagtttatgttgcttagttctctgtcaagtaattttgggttatatcctggacatcttgagtgtaatattatgagactccggaccctgtttaaatgttctgaaaatgttgactgatttttttttttttaaacaggcagtcaacccagttagattcagatggcatatcctggctcactttctcagctctgtggttccggtatccaccctgctgttgaccactgagggatcagtttgaaactgggcagtgatctgtgctgtgctgattctaagtgttttcacacatgtgcagtttaggggtgagcccagggcttcttatgaagatttaaaggatcccttctccagctccctcttctccatgatcttccctatactctctacttccccatgtcccccctttcaggtgttctgattagaaggcagttcccccctgagggtccactgttgctgtgctggtgaagggggcaggggcttcacctatttggtggcgcttggttagtgtagagtggaaagagtccacgggtctccaccccagggaggccgctgcttgcatctgtggggagaggaatggacacgttgtttgtgctggggaaaggtggataaagccaaaagagttcaatctacaggatttctccttcctgggcttttggttagagagagcaagcttttctgtttggttcttttttttttttcctcttgtctgtgcctgttggtagtttcaagctactctagtgcccatgctgggaggcaaaattccaaaaactggaaaaccagaaaaatcactgccaaggtgtccttaaagtcctgcaatctctgctcagtcctcctgcccttatctacctttttgagtcccatgatagaggtttcatgcagaatttgtacctgtggatagtgggaaaggctgtagtgtgctttttccatcttgcctggaattggaagttccaacttctacatttagacgtccttctctctgtgtgtggtgatgttccctgggatagaccactactgcccttagacagcattctgagggtggtggcccatactgatcacctcagcccacccagtaactttcctgcggcccctcccaagacccccgccccaacagggctaagctgatacacacactgcggatgcaggcctgcctgctgggccttcctggtgtttgttttttccaggcaaagcacctctctctgcctcctgctggtttattcagcagtgtcccagggtttgctcattgtctgctttgcttcagacccttctatcaaattccattgtctctgtcttaatggtctttgcagggtaggcatggccatctgcatgttcactgaagggcctgcctgcatttccagggagagaaagccttcaggccactggtgcataaagatctttggaaatgtccagaagatcccaaacattgcctgtcctgcatgccaggcctcacttgccaccagcctgctccccagccgcacatccagctgtcatttcctagagaacccatcccacgcagttgttttggacacatagcgttccttcagggaatgtggccccggggccacaggtggagtagagggcacagtatcccgaaccatctaacggggcccgactcaccctcaccatgcaccaggccagttatggtttctttctgtgtcttatttccccctccatcaaatgagagttattgtagaaaccttatagtgctgtgttgggattagcagtaaacagtttggcatgtggtagatgctcgggaaatggaagctgcccttttttcctaatgggaaagaagggattttgtttttgagacaattcccttcctctgctgctgcatagggacacctgggtgcctttctaaaattagaccagggcatggtggcttgctcgtaatcccagtgttttgagaggccaaggcgggaagatcacttgaggccaggagtttgagaccagcctgggcaacctagtgagactccgtctctataaaaaaataaaattagctggatgtggtagtgcacgcctgtagtcccagctattcaggaggctgagtcaggaagattgcttgagccccaggagtttgaggcaatggtgagccatgttcatgccactgcactccagcctagccaacagagcaagaccccgtctcataaaataaaataaaataaaataaaataaaataaaataaaataaataaaataccaacagcctgtgctggctggagccatggtgttaaaaggcccatggacttgggccatgcctgagctggctgtgctctgcctgccacttaggctgcccctccctgacccagcttgtgtggaggaggcatggaatcctacaggaatgtgaagttcatccttccctggatacttgggcaccatctggccaggctcatggagcaaatgggcctgtgagttatgtccccacccgtgcctacgcccaacctttatgccccgtttttagtgggagaattttgtttggagctgcaggtgttggggggtggcacgtctcaggctttggggtcttcctgttctctttcttggccctgctccactccttggttcccctggccctgtcttgcctgcctgttaactttgggtaccctcagcctgtcccaaggcagctcatccctcaggccctgccctgtcttgtctctccagcctcccagcccaggggcttgctctccatgtagtaactaataccttagtgtgatcctctaattttctgttgctttcttgcttccatggttgttggaagcctggagacccagtgtttggccaaggacagggcctgctggttttagagctcctggcccagtagggatgataggacccaggaccccaagtgctctaggcaggcactgttctgggtgctgtaaagcacggtgcctagcacctcacagggactcggggtgtcctggctgaccagccgaatccactttttattgacaagaagcctgggtcccagagacattaagtaacgtgctaaggtcacccacctgggcagtggtagggctgggtttgaaccaaggtctgcactgcccagctcatgaattctgctgcttgggagccagcagcactactggcacaagggtagggggacctcaggcctgtcagagagggtgcctggctctttgggagtggggggtgcaccagagtgggttggagacaggacccagagcaccaccctttacctgaccagcatcttggtggggttccccacctggaaaggcaggaccctggggtccaacagagcctattgcagatccaggttctggcccagctgggatgctcactggcttctgtggcttatcagcgagcctacctgctgcacccgtgagcatgggcggccccatctgcctcctccttcaggtgagatggcaggatcagagagatggaatgaatgctgccgtgtcgcattcatgtaggaaggccttatttacaaaccatctgtagcagtcagaaggcctgatgtggtcaggccagaccatggagcccctgttctggatccatttggcaaagatgagagagaagctgggttaggctttgttgggtaaatgcaaatgccacatctgtgtgtgcacacacataggctgagacatttttctgcgaggtgggggatcgcattgagggaagaaaaggtgctctaatagcttcagcctggacttgggtccagagctttggatagaagcatctttccagacaattgggatcctgtagaaaatctgccctctgaggctcttctatgccttctgttgtgtcctgggaccccttggcatctccaggcagagcctatacagagcatccacatcagagtcccctgtgggccccagtgcctgtagttccatctcctgcctggatgctcggttcttggagcgagcttcctgagcagcctctgcaggctccaggctctggcagcatctccacgccactcctgccggcctttctcctggtggaagcagcctgcgttgcttctctgcccggtggtgacaggctgttctcgtttggaaacagaagagacaccactgcttccccacaccgacttcctaaaacatgaggctcccttctgtggtgtatgtgtaaaatgcctggctctgtatatgcacgtggtgcacgcctggccctggggtcttcacattcttcagaagaggccaggcatggaggctcgtgcctgtaatcccagcactttgagaggctgaggcaaatgaatcatttgaggtcaagagttcgagaccagcctggctaacatggtgaaaccccgtctttgctaaaaatataaaaattagccaggtgtgggggcttacactcttgtagtcccagctattcaggaggctgaggcacaagaatcgcttgaacccaggagtcgggggttgttgtgagctgagatcacaccactgcacgccagcctgggtgacagagcgagaccctgtctcaaaaaaaaaaaaaagaaaaaaaagaaaaaaaaaaagaagaacatggtgacttcacctgcccagggaggcgtgccagccaggggcccatggagaatcagatattcagccagggacaagggcatgtcagtgggcagagtgccagggtgtgggaggctctctgggtggtcgctgaccaaaaacatcacttctgggttttgtgactcagaaatgagctcagcctgtataccctgcagatgtgatgagccccaggccgagtcctctgggggtgtcattaatggcgtgtgcatgagcattttcttctggcatttttacagagaccatgtgcagctggactctccggagacagcaaacagaaattctattatgtgtcctatcagctagtaaaggaggggagcttgccttgagttgtgtttttctgcgaccctgtgtgtttgatccttgtctgcacccagtttggccaccctgacctctgtcactcccaagtccgaggaaccagtggttatgtgaatgtgaagttatttacttcatctgtttatttagatctgggccctggggtggccccatgcgttgaataagtgtgttctacagaacccatggtccctgggttctgggtgatcagtggcctgaggagggaccagactccagcccgtcctaaggagcttatgagaagttttgaggggactggtgcctggacatgggctgtagcgtaggtggagtgtcgaggaggaccctacacacggtgagtgggagaaagcacctgggagagcatcccgcagcccaggagggtggtcaggttaagtcacagcagggatggggctatcagaatggtgggctgtgaagaactgggagggccaagactcagggaggccatctggatggggaaggtgtgagccgaggcccagaatggagcacccaggggacccaggctgatcaggtcgcagcgagcatgaggggactgtgcgaagccatgagctccagactccccagtcgtgggccctgatgcgggggtgtgtgtgagctggagccgtgggaccagggccgaacccgtgtgctggacagtcttcggggcccagacaccaagggccacccggagcctacaggaaagttggggagtagaggggcatgtgttgtatggacagagccctaccatgcttagaggagtcaggctcctcccccgactctgtggccacacattgtccctcacactcttgatttctcagccacagtgagggtgaaaaccagggtcagctcgagactatgacccagttcccatttcacctcctgggtcttctccaggttctgtggggttttttgttttgttttgtttttttgagatggagtctctcgctctgtcacccaggctggagtgcagtggtacgatcttggctcctaggttcaagtgattctcctgcctcagcctcccaagtagctgggattacaggcatgcacccagctaatttttgtatttttagtagagacggggtttcaccatgctggccagactggtctcgaactcctgacctcaagtgatccgcctgccttggcatcccaaagtgctgagattactagtgtgagccaccatgcccggccttctccaagttccgaattccctgaaagcagctgtgctgttgccctgccctctggggcacaatgttaggagtaagcagcgtttaagtgcctccctgattaagagaaagatgtatattcccactgggtggcgaggacatagatgtccaggcccatgtgttccacggcataatgtggggactgcagagaggaagggacatgtttatgtcccaggtgagtcatggaatctcagaatatgagggtgtgcatgtcagattttttcaaggaggggtgtcttagtcacttcaggctgctataacaaaaatgccataaactgggtaccttaaacaacaaacacttactcctcacagtgctggaggcaggaagtcagtatcaaggagctggaacatttggagtctgccaagggcccacttcctggttcttagccatcttcttgctgtgttctcacctggtgtggaaaggatgggggctgtctctggggtttcaaaagggcactaatccccttcatgagggttccgtcctcctgacctaatcacccccaaaggccccacctctaaataccatcacattgggggttagatttcaacataggaattttgcagagatgtgaacatttattctgtgtgctgtaaggggcatctcagagtgccacccccacatctccaaagctgctggaccttgcatatgggagctgactctcttggggctggtgtgactcatggctggaggcctggcttgttaacccagctctgaggtcctctgggtgccacctcctgcacaccagccagccaggtggcctccacgtaccttctgtttcatggagaagagctacttgcttaagacaggttcctcaaacccctggcatctggtctcaggtgactctgagcatctcatggctacctcctccccacctgcagcctcatctccaccctgccgcactctatgactgagcagcacagggcgccaggggatgtttgtctgcactgctgctgtgttgctgacttatgagacctctttggaaggggctcaacaggtgaggagagtggtgtgaatccacttgtcctaatagaccactccaactttctgaacatcccaggctttcctggtacagtccccatcttccagccaagaggagagcatggctcaggtgggattcaggcgagaacagggcaacgcacacctactagccaagatacaaagcacttaatacagggaggagtcatgtgggcagagcccagtgggtctgggttcccctcatgaggaccgagaggggaccaacacctgttagatgtctgctgtgttcctgacgttggcctgggtgtgggatgtgactgggtgtctgttgctctccttggcaggtgcctgccctggaggtaaagaggctgggacagtaactttaggcagtcagctggggtctgtctgttaagcaaggagcaggaatcagccttgttctctactggcctgtctgggaagcgtgaacaaattctgtgtcttgaatagtacccgagtcagttgccagccctgtgctggctctggcagggggtagctgtggaggcaagagtgttgggcagggtgacctgattgagccaagctgttattcttccacctgaggattttccagaagaagtgccaggctcagaaccggcgtcagatacctctgagagcctttccggttgccacggttctcccaggatcgtggagttcttgaaggaaggccttttcctggcgtgtctgcagtggcatggtgatatagccacgccgcccctgtttgtgagttgaatctctgcagaactcacttttcccaggaggtgctttcagaatgcagcataccacagtcctcatcaggatctgctcatttggctgggctggcaggtggctgagttggctcccggagcgggtgtctagcagctgtgctcatggaggcaggctgggcgtgtgaatctcacctcctcccacggccccctggggaagcaggataggagctgggcctggttcccgagcctggccgattgggagtaacaggtgggatctggaccaggttgtcacacccacaatgacagctgggattatcaccgtgggtggtaattcccacatgacagtttcgagtttcaggtcaagagctgggtcctctctctcctcttgcatctggacagagagatccttgccggctggttttctggctcgttcctcagctgttttctgtggcctgcagagtttgcagccccaggggagtaaggaaagctctgctctggcctgatttttgctggagaagagaaatgtggaagtcagggtggtggcctttgcagtgggtcagctttgggctgctgagacgggcggcgtgaaggccggcttccagagccctggctggcctttgtagtggatgagacggaccagattgccatgctagggtcacccgctgacctgcagtggcctgagcagatacatggctctgccagatttcctgaagtggagccctcagcctcacactgcatcccccagaagccaggcaagaggaggtcataaggtttttctggaaaggagcgaaagagtgcgctgctaaatgttgcaggtgggagtgcgtgaacaggtgaggcttccggtaattatgacaagtgatgcttgtgcttctcagtgccgtttcctccctctgatggggcctgcttgacacctcgcagggagcgtgggtggagagtgtcattatccccatttcattggtgggaacattgagagatgaaacgaggagtttcatctgcaggcccctgggccctctggtcatcccggtcatcctggttggtttattgtcttgttttttaagggggatgatcgaagaaagccttggaggtagggtgggggaagctgggaacagagggaattatatttccttttccaaatacttgtttaagaatggaagagttcctggccacataatccatgtgcacagattttccgggggaaaatccatttgagtttagacttggagaccgtgccacctcccggtctgttcctcaggcttttgacatctgcccacacctggaacatcttaaattctggtggagaatacaaaacgtcactcccctgccccagctcacccctagttcagccccccaggatacctgaagttggggatcctccttcttagctgtggagctcagggtatgttggttccacgtccaaaccttcaaccttcatctgtaaaatggggtactgatggctcccttgcagaggcctggggattcgaggcagcacttctggcccgtacctgttgccatttctgcatgttgtacccctggccctgactcaggctggcgtcctgaacacctgtgcatccacaaccccataagccttccaggagcactatagatcagggtgacccaggattaggccgggggtgggaattacagactacccccaggactgacccagagctatacccctccagggccggtgggaacacgagtggtttttgtgtgtgtatgtggcttgcagcttgcaaggggggtggggggcaggtggcggggttggttcgagtctcaaactgtcctctgtcgggtcgggtcaggcctcaaactctcctctgggccatttccttctttttctcaacagaaagaacccaggctatggaatcatgtgtgggcccagcagggttcataggcaccttctcagtctgtctccagcgttgggctcttctggtcctgcccagcttgtcgctttagtacctcagtttccttatctgcatggaagcccacctgtcagcttggatgaggggaggaaagcaaagcccctcaggccctgtgtgggaaggagagtctgaaagtgcaggggctgtgctcaggaaggagcgcagcttcaggaggggctggttggctggcagtgttgtgcaggacattcagaacgtgactgggtttctattctgatttgtacaagcataggatactcaggtggctctggtctgttctctagcaggagagtctggggtcaatctgtaataatttagcttctgagcaggtgcccggcactggaagaggagagcccaagagagcacggatacattgtgtggctgaagggggcaaggccctgggctgcctcctactctgaccttgtgggccttggtgtctgctcttcccctctgtctgccactctgagtctggaatgtggcagtgatatgggtgttgtgggcactcctggcatgtgggcagctcctcagtgctggtgtctgagctccacaatgacttcattcatgtaatagtatgttatggctgcgtaacaaagaaccacaaactgtgcagcccaaatcatagaaatttatcatctcacagttctgacgactggaaatatgagattgagatgttggctgggttggatccttataggtggcagttttcaagttcacatgacattctccctatatgccagtctgtatccaaattccacccacccacccccacttttttttaagagacagcgtctccctctggctccagtcccaggctgcagtgcagtggcgcagtcatagctcactgtagcctcagcctcctgggctcaagtgatcctcccacctcagcctcccaagtagctgaaaactacacttgaccaccatacctggctaatttttatatttttttgtagagacacgttcttgttatgttgtccaggctagtctcgaactcctggcctgaagtgatcctgcctcccaaagtgctgggattacaggcatgagccaccacgccaggccacctcttttttaaaggacacagtcacattggattaggacctaacctaatgacctcattttaacttggtaaagaccctattttcaaataagtttagaggttaggacttcagcatatgaatttaggagggaacacaatttagcccctaaaactgtacttctattcttttgttttaaatttcagagcctggctgatcgtgtgtgtgtgtgtgtgtgtgtgtgtgtgtgtgtgtgtgtgtctgtctatgtgtgaaaatatacataggccgggcgcggtggctcacgcctgtaatcccagcactttgggaggctgaggcgggtggatcacgaggtcaggagatcgagaccatcctgactaacacggtgaaaccccgtctctactaaaaatacaaaaaatcagccgggcgtggtggcgggcgcctgtagttccagctaatcgggaggctgaggcaggagaatggcgtgaacccaggaggcggagcttgcagtgagccgagatagtgccacttgcactccagcctgggtgacagagcgagactgtctcaaaaagaaaaaaaaaagaaaaagaaaaaaagaaaatatacataacatgtactgttttagccatttttaagtgtgcggttcagtggtattcagtacatccacattatcatacacctgtcactactgtccatctccagaactttttcatattctccacactgaaactccactaaacgctaactccctcctcccctcctgtccagcacctcacaaccccctttctactttctgtctctatgaatttgactactctaggaacctcatatacgtggaatcttacggtatttgtttgtttgtgcctggctgatttcacttagcataatgtcctcaaggcctatctcagtcagcgtgtgtcagagtttccttcctttttgaggctgaataatactcctttacatgtatgtggcacgttctggttttccactcatgcattgatggatgctagggttgctgccacctcttggccattgtggatggcgctgctgggaatgtggtgaatgtgcacctcctctcctaacctgccccaggcatccttcagaagcggggcagcccaagaccgagatgggggaagaaggtggtttgcctgccctcccaggcttgctgggtgtctgcccgtggctgggccctggccccgggctcagggtggtgaccgccagcagggggaagtccctcttcctgccattcccccccgaccaaccctctgtatttcctctttggaggggcagtgagtgggaagggaggacccacaggtgtgcagcggccatggcccgcatcctggctgagcacctttgctggtgtggagggactccctccagtcactttcagacctcactccccatgctgctcccacaccagggcactgttcccacgccatcctcctttgaagggcactacccatcttccctgtcttgccccttcccaccctcttcccagggacttttctggtcagttccctgctgccaggtctatacctcagggactagaagctcagcatcccctctgctcttcctccttttgcctttgtcctcttagccagacccaggctcactgtgcgtcagtgcccctgcctgcgtttttctaccaacaccaggcctacctggagtgaccatcgcagaagcccccagccctgccccacctccagtgccacactcagatgtgctgccagaacgtcacctgtctccctgcagcctctaggctcccctcttgttccagacccagacatctcctaaatggagcccaagtccttggcctgaagcctgaggctccccacaaaatcaccctcttcctctctctcctctcactgccagcctgtatcccctttcccagctgtaccccctttcccagagaccacttccagccccccttagctcttagtggcctctggctggatctagaaaccaaactgacaccaggtacattaacaagagaaaagcacacaaatgtcattagttttacaggtgcatgggaaacttcaccagagtcaagtccagacaagtggccgaagcaagatgctttatcctttttcgataaagaacaataagtttgagaagtggcaggacaagggggatctggctaggggcagtaaattcttgagcagtcactgggagatatatgaggggtgtaaacctggtggaagataagggttactttgttaaagcatatttattcaggcccactgcagcccccgattccatctcaggtgataagggctattttctcccctggttcaaggaagacacccctcccagaggaatctttatggcttgctgagtatagcaagaaacaggtcagctagccctttctgaagctgcagctcgaagtcagtgtagccatccggtgtattttgggatggcacgtccttcactctttcccagcctttctgcatttgtaagccccaggaaagccggcagctgagtcagcctgaatccctccatggggcgtctttgcagctccctgcccctgctggttgaaggctctgttggtcgcattcttctctctcacagactctgcccctccaaagcccttccagccctctcctgggggctgggttatctctgtcctcagactccatggcaccgagttcaggccatgtcttagtgtcctgtggcttccttaacagaatgccacaagcttagtggcttacaacaacaaacatttattctctcccagttctgaagactgaagtcccacatcaaggtgtccgcagggccaggctgtctctggaggctctaggggaggatccttcctttctgttcccagcatctgatggcccacggcattcctcgacctggtgacaacatctctccagtccctgcctccgccttcaaatggcctcctgtatgcctgtgtcttctgtctctttaaagatatttgtcattggatttagggtccatcagtgtgatattgtgatataagaaacctgtatgtggtcttccttctggtttctggcacaagctcctaaaatcattgtaattttctgaacgatggggtgataggagcatcttttgttattcatacaagcccttttctgtgggacctgaggttatgctaatgaggtgatgcttgaggggcccctagatagctgtgggacggggctggttgccagaggaaccagccacgtgattagagggttggaactttagctccacccctgaactctggggatggggagaggggtggagattgaattgatcacccgtgtctacagccatgccagcctgatctcggctgaactgatcatcagtggccaatgatttagtcttgcctacctagtggaacctccatgaaaacactacacagtgaggttcagagagctttcacgttggtgaacacatgaaggtgctgggagggcagtgccccaagaggccatggaagctcccccacaatacacaccctgttacccagccctcttccgtttggctttcgtgagtggtatcctttacaataaactggtaaatgtgagtaaaaggttttcccgaattctgtgagctgttctagcaattttttttttttttttttaagatggagcctcgctctgttgcccaggctggagtgcagtggcgagatctcggctcactgcaacctcccgggttcaaatgattctcttgccttagcctcccgagtagctgggactataggcgcctgccaccacgcccagctaatttttgtgtttttagtagagacgcgatttcatcatattggccagactggtcttgaactcctgaccttgtgatccgcctgcctcagcctcccaaagttgctgggattacaggcatgagccaccgtgcccggctctagcaaattattgaacctgaggagggggttgtgggaacaccccatctccactcccagctttagagtcagtaggtcagaagtacaggtggcccagacttcccccagtgccttaagtgggaacagtcttgtggtactgagcccttaacctgtgaagtctgacacttattccacatacttactggcagaatggaattaaattataggacacccggctggtgtccagagactgggaggattgcctggtgaaaggagaaaacccacacgtgtgttgtcaggagagttctgggggaatagaaacacatcatagtagtagtaattggacaatctagggtgatctcatctcaaagcctttaacttcattacatctgcaaaaagactctttccaggtaaggtcgcattcgcagattctagggttaggatatgaacgtgttcctttgggggcccactacagtgggcttctcaccttggtgtcctcaggggagccagtgtctgcctccctctcctccgttaggtcctggctccgtggtcatttcctcagggagaggccctgctgtccttcctgggtctgtcttcctccctcctgcatgtgctccggtgccacctgcctctctcccgtggccttgtcatggttgctgtgatgcccacgtcacgtgactccatggattccgctggctcccatgggcaggggctgggtgtgcggtgctcaccattccatacccagcacagtgtcctgcacgtattagatactcagtaagtacatttgtctggggctaaaccttcagggtctccaggaagtctttctgagccccagagtcctaaaaagcccaggtgctgctgaggaataataactgtatcatcctggggcggagggctgctgcctcttcccagctggggtttcagcctctgccctgcccccgcaccagccggcccccaacctgaagcctagagcatcaaattattattgcctccgggaatgactgggagccttaggcacaggtgggtccttggagacaggggatggtcctttaacagtgttctggatcctgatggagaagagagggggttctcctctgcccacactgaggcacactcggcttgtggaggaaaacggctgactagtgcccccagaaaatcgccagcaaagttgaccttctggtgattcagtctccaaccagctcaaccttcaagcaggcagagctgtcagggctggtcgtgtgggttggactttctcctccaagaaagctcagagttgtaaatacctgtttctcatctgcggtgtctagggttgcctggggagtcaaggcatcagggagcaggacaggctcaggcccttcccgactgacattttccagcctatggggggccttggctagcctggtggctttctctgtggcatacgctgattcatgaccctgacctctctctacccgggcagctgcggctttccattcttgggtgctggcctggtgatgtcattgttggggtacggcatgagggctgggaggccacaggatcctggggtgctctctgtgtacccttccaccacagaaccaaggaccctggtggcaggcctttagccagggtgcggtggctaactggatggggcacgtctcatttataaagaattttgaggcacttggcgtggatgcaagaaggggcagctgccagcctggcagaggaggagaaagtagagaaaccaccagaaccaaccacacatctccgaaagcactcactgcatgtgggtggcctgaggttatggccaggcggtactgatgtccatccggaaggatactctcagccctcgggaaacagtggaattatgttccgggttccctgcttaggagaggaaaacaggtcagccttaaaaaaaaaaaaaaattgaggtaaaattcacataacataaaatgaatcattttaaagtgaacaattccgtggcttttagtgccttcacagtgttgtgcaaccaccatctccgtttagttccgaaacattttcgtcaccccagaaggaaacccctgcccattaagcagtcaccgacctcctttctgtctttatgggtttacgtattgtggggatttaatatcaatggagtcatacaacatgtggcactttgtgactggcatatttcccgtagcatcatgttttcaaggttcatccgtgttgtagcatgtgacagaatttccttccctttgaaggcagaggccgggtgtagtggctcacacctgcaatcccagcactttgggaggcctaggcgagaggaccacttgaagccaggagttcaagaccagcctaggcaacatagcgagacccctgtctctacaaaaagaaaaaaaaaattattttagctggacataatggcacacacctgtaatgccagttacttagggggctcaggcaggagatcacgtgagcccaggagttcgagactatggtgagcaatgctattccattgaatctgatggacatttggattgtttctacctcttgtgaataatgcttctgtgaacattctggtacaagtttttgtttgaacactagttttcaattgttttgattatacacctaggaggggagttgctaagtcgtaaggttatcaatgccacatcttagaaatgccttctctttggaatgaaagttgacccagcaggcaggtcacacaggtgcagctgggcacagtcaagctctgcctgagactcagtttttcctgtctgaaaaatagcaatctaaaagttcatgcccactcaggtgcgtattccaagagatgatacgtgggttttcagcaccatatgtgacctggaggaagtaccccgtaaagggtggtgggttttttttgcccactacttcaaagatttgggtcttttttgctgtcagaggaacttacctccctgaagcactacgggtattccctgaccttacctgaggttctgctacgatagccagcttcggagcccccaagatccacagcccttctcgagggtagagtctgctcttggtgggtgcatggtggtaagaaggtgccaggctatggatgagcgtggggtgcagagccagctccgactgtggactctgcacccttcatgagacccgaacctctgtcccagccatggttttccaagcctctctggaggacagtgcctgcctgacaatccctccaaaagacgtgtgctgctgtttgtagaagtcgctggcaccatgctgccatggcctgcctaggacctgggagaagatgggaggccaagaggagggcaggagccgggaaggaggacagctgcagccatgacagggtgggggtttgatgtccgcctctgtgaaaacctccaccacagctggccgagccaccggatgtttgatctccttttacctttgtaaataaatactgcctagtctttggctgccagtgtaaacaaggatggagaccactctgctgatgatctctgtgctccctggagttcctgcctcctccacccaaattcctcccagtgcccctttcttctcttgactccagtacatgttgatcggagggccctttacagccgctctcattgttctgggtagggagggcccagagcatgacctctgatcccctgagggcttgctcccatctcaccctggggcacattggcagaggttgggtcaggggctgggttcctggaaccccacacctctggcagccacaccacggatggaggatctggggtctctctaggcatatctggcctgggagagcctctcctgcctggctgtacccaggcatcacatggccgatggtctgagctcagttctgcatgcatttcctgggagcccaccgttccaccttctgtctctatgaatctgactactgtaggtacctcatatgagtggaatcataacaatatttgtccttttgtgtctggcttattccactaagcagaacatcaaggttcatccatgagattgcatgtgtcaaaatgtccttcctttttaaggctgaatgatgttccattgcgtgtatacattacattgtgcttctcccttcttctgtcagtggacattgggttctttccacctcttccttcccatgttgtgatgaatatgggtgtgcaaatatgtcttcaagttcctgctttcagttcttttagaggctgggcgcagtggctcacgcttgtaatcccagcactttgggagactgaggctggtggattacttgaggtcaggagttccagaccagcctgggcaacatggtgaaaccccatctatacttaaaatacgaaaattagctgggtgtggtggcgcacgcttgtaatcacagctacttgggaggccaaggcaggagaatcacttgaacccaggaggtggaggttgcagtgagccaagatcgcgccattatactccagcagtgtccgggcaacagagtgagactccatctcaaaaaaaaaaaaaaatcagttattttgggtacataactaggagtagaattgctggatcatgtggtaattctgtttaattttttgaaagatttttttttttgaaccagtgtagtctaggggatgtgaccgcagcacctacctgggcctgggctgactgggacctaaccaggcattattcttttcgctatattatttttattttttggctgccctttttccttttatgaaagaatagatttgcagagttctggggttgggttgctaagcaaactgcctggagagaagagggtttcagatttcactaggccctccctcttccacaccaaccctgggctgtctgcactggacttcctctccccagccccactcctagtctggttcctggttcaggtgagcagcagccagattccatgcccccaccttctaccttctagtgtttgggttctgccttggataaagctttgcaggaaggatgtggctgatgagaccatcaacctcagtcctgccaagggtgaggcggcccagagaggtttttccactgggtattcctggtacgggggcaggagccaggcctcccaattggttctggctcttgggagatggtggctttcaaaatgccaaataatgtactttatcctcaagaggaaagggccttggctgggcatggtggctcaagcctataatcccagcactttgggaggccgaggcaggagggttgcttgaggccagagtttaagatcagcctggacaacatagcaagactttttctcaaaaaatgtttttaaaaattagctgggcaggccaggcacggtggctcacgcctgtaatcccagcactttgggaggccaaggtgggtggatcacaaggtcaggagatggagaccatcctggctaacatggtgaaactccgtctctactaaaaatacaaaaaaaaattagccaggcgtggtggcgcacgcctgtagtcccagctactccggaggctgaggcaggagaatggcgtgaacccggaaggtggagcttacagtgagccgaaatcgcgccactgcactccagcctggacgacagagcaagactctgtctcaaaaaaaaaaaaaaaaaaattagctgggcatagtggcatgcacctgtagtcccagctacttagaaggatcccttgagcccaggagttcacagctgcagtgagctgtgatcactccactgcacttcagcctgggtgacagaaagatcatgtcgctgaaaataaaatcacgggtggggggtggtgctttgtgtacttaggggagctcaggtgtgaaaaactgcgttttgaaaaagcaggttcctgtgtgctggttagaatggggggatgaggaaattgaggggcagtcctccccacaccatcatttgccttggagcagactggaagagtcagcagaatgaggggcaacaagtatggattggagtgatctgggtgagctgaggcaggggctgaagccctcatatggaacgtggcagggatgagcaggccatctggaatccagacttaaaagcatcagtcacccagacattgatttgagatctctgcagagggggaaacggctggggtttcagccacttggagtgtcctaattccccagcagagtctggccgtgagacctagtctctctgtctcacctggcggggtgatgtgtccacttcaaagtctcactggacacaggcaggcaaaccctcaccgggcacttgattcttgcaccaggttttagcgtggacgttgctaagccagcatgtggcttcgcacatgtggagtcttacagttactctgaagcaagccctgggaccccgaatctgaccccgaagttcttgctgggctgactccctactcggtgttgacttgaccttacacgggagtcagtgtagtcatgggctcggaaagcactcagataaaaggtgctccacccagtgatgaagaatgtgttgatgtcttaagatcgtcttcagataaacagcaaaaccgttggttaaaagctggtctaacccaccttattttgttgttgtttgttttgttttagacgtttcgcagcctgaagctgtggttttagtctctttctctagtgataagtggaaaagagggatgaggaaggggctttgctggcccgaccaaaaacaaaactaagaacccatgagtgtattctctcccttgggcacttggacacctctgctagaacatttagtagacgctgacaattccaagctaatgtaaaagccaagtctggagggtcatggggtgggagactagggtgaggaagttgttaaaggaggccaaggggatggcacggccttcatctaatagtgacagtagcattttagagctagagggtctttatccattgtctagttcacatgcatgattttaaaaaaggaagctgaggcaggaggattgcttgagcccaggagttggagactagcctaggcaccttagcgagtcaacgtctctgttaaaattaataaatgaagtcaagaaaggtgaggcatgggcggcctcagtgacctggactaactcacagagaggtagcaatggggagggccagagcctcgcttctgagggattacaccacagctcacttcccccacccaaaggccaaaggaactgagcgttaataaccaacatagcgatcttggtacctggagccccctcgatgtcccatggattaaggagaccagattcctccatacagcttgttgagggacttggtgggtgccccttgctcttggggtcttcctactttggctgctatgctcaacccagacccagcctcttcctggaattctcctttcaacacgcacagagacagaacccggcccggactttgcagccagtagttgtgtgcaatcacctgggacagtgctgcaggtcagcagccggcaatgctagacaccgggttggggtcgctcagcaggtctaagccctggctgccagctagattcccccaggaagcccctatagcttcggattcagcaggtctgtgtggatcccggtgaaatcgttttcaaagcctcccaggtgttgccgacgtgcagccagggctgaggacacctgttagagggtgctgagtcctgtgggacgagaagtggagaacctgggagagggagaggcagaggtgtgcaaggaagccggaacttcggccacctgcacccacagctagtggcagatcactccagacacacggctctccccggccttccacgtggaaaggactgacaacagtctccacttcaggattgctgggtcagttgctctgagtgcctgagggcagccctgtgcccacccagcctgggtgtgtgtggtggcagttgtaaactcctgaatgaacaccaaggtcacctctgctggtaacctttgggcagggctgcttacaggtgactcatggtgagagtgacgtcaccccatcagggtgagctctcagaagtcccatgggcctcaaagtccccctttggaaggagtggagaagggatcctcacatgagccatggattgggccagaagatccttgtgggttgacagtggtcatgatgagtccactggcttagaaaactcaggctgagaacaggccatggaggagctccagatggctaaggccttggaaacacgtgttgagctttgtcattcagcctgggaggaagggagtgattatctccaggtgcctctgggaggaatgaattactctgtataaccagatagtcccaacaggcagggggcctcttgtaggataagccactctgtcctcctgcgggtactcacattggggtaagggtggtctgggatttcgacagacctgctggaaggtggtctatgactcagccagaagctgggccagactgggggatgggggaacctgtagccccagttccctgggctggcatcggaatagcatggtaggactcgctgctcatggtggacagaacttgcaccccagccagcatgctggcctgtgctcctcaccccatcagaccccatgggcaggtgtgcaaggtgcaaggaccgttcctgacatcaagacggtaacggtaacattttgggtttccctttctttttcttttcttttcttttttttttttttttgagacagagtcttgctctgtcacctaggctggagtgcagtggtgcaatcttggctcactgcaacctccacctcccaggttcaagcgattctcctgcctcagcctcctgagtagctgggattacaggcacctgccaccatgcccacctaattttttatagttttagtagagatggggttcaccatattggccaggctggtctcgaactcctgacctcaagtgatccacccacctcggcctcccaaagtgctgggattacaggcatgagccactgtgcccagccagggtccccctttctatagcaacccaacccccctgtatgggggagaaccaactgttttctctgtacacaagctcaacgcagaacacttatgtgaccaaatgtaggggtttttcccacaccaagcagttctctgcagacaccagctgggtgtcctacaatttcaactcagttttgacattgtctacctggagttagcatcagatcccactgttaagggctcagctccagaagactgcccctaacgtcaggtgtcagtagcaagtccaggttatctattggccgtaaattggaggttcctacagccccctccttgagtttgatcacttgctggaacggctcagagaactcaggaaaataacttactagctgactggtttttaatacaaagatacaactcaggaacagccatatggaggaggtgcacagaggaaggtctgtgggaaggggtgcagagcttccatgccctctcggggcactgccacattttcagcaacctggaagctctcctaaccctggccttttggacagccctcattgtgtaggcatgattgattacgtcactggccattggtgatcaactcaaccttcaactgtgggtcttccccagagagttgggggtgccaactctctaatcgtgtggttggttctcccggcaaccagcccccttcctgaggctatccaggagccccagccacctgtcatttactagcacacataaagacatgtattactttggagattccaagggttttaggacctgcatgccaggaaagtagagggtgggatatgcaaagatcaaatatacatttcttaagtcacaaccccctgccaggggcagacgtatctcagaaagccccttgtattgtctagggagtgagctcatgttcatcccccctcaccttgtggtctttgaccagtcagttgtgaaggggacgtcagcatacccgaggtcgttgtgagatgcctgttggggacagagatggtgtcagctgggtgcttgctgggatgggttgagtatggatgctcccttctctgtctctaacacaggatgcttctttgcacacacagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcggtgagtccccatggtgtacgtgtggcaggagggccaggtgaggctccctgaagcgcagccccatgctcaggggtatgtagcaggtaggtggtggagcagccaatggtttggaagcgagtgggtcaccaaaaactccttcctcatctctacatgtggtacacagacagcctgccagatgtgttgatcagggagatcgggggatgctttgaactgagcgtggaggaggcaggcagcatgtggtcttgaggctgagaatgtcagcaccagaggccaccaccaagacctgcgtggtggcgccggcaacactcctgagccaggtggtgtctgggcttgggtccctttgcttcatagccttcttgctcccttttaccaaagcgtgtgctgaggatggctccatccatgtgaccagagcctttcctgtgaattttcacttgaccctcattaataattcttggcctttctgtcacttccactttacaaaggtgaaactgaagtccagtggtggcttccccaaggtctcatggctagtgagtagcggcacattcagtagatgctctgccatgccctccaagaaagcagtggacccacgccccccctcacatgagaacgtagcccgggctggttgcaggctggatggtgctggaccgcccggccctgcatgaagttctgattcctcttgctggtcccacagctcagggggctgcttcagcaatgctctggggcccagatgctcaccccttgccattggtgcatgtccccccacttgacctcttgggttccttacttcttgggctgagaaaatcactgccccagggcagttgctcctttttgtctttttggtccctgatgacagattacttccgcactctgcttagcttatttctagatggtttccaccatagcctggcatggtggctcacacctataatcccagcgactcaggaggctgaggtgggagaattgcttgagtccaggagctcgagactgcagtgagctgtgattctcaccactgcactccagcctgggcaacagagcaagaccctatctttaaaaataataataaaaaaataaataaaaagagcaagagagagatggacttttccccatttctgtaaggaagctccagaagtgtatcttctcactgagctgcttttttctggggctgacatgttagctgcacgcctgggactgctgcttacgtatatacttttgtgatttctgaaggccttggtgctgggcaggcttctcattctgaaccgagaggatgggagaggaagccagtgggtaacatgtacctgctccgtgcagcacacacaggctgctgccttaggtagcttcctatcccacgtcgagtgtcagctttttacagactaggaggccgaggttcagagaggtgaagtaacttgcttgggccacacagctccagggtttgaagccttcctgattcttcaatgggcacactttccctccctcaactgtcttgtctttcttggtgcacccctttcttgctgcattgtgagcgtggtttggtacaaagaaggaccaagttcaggtaggctaagtgctgaacttgagaaaggcaatttctttccatcattcttgagggctatctgcacccagccagtccttgatgcagttcctggccccgaaaggaagctgatctgcccactcagtgccccagtccctgtccgggggtgggggcctcccacccacacctggctctgacttggagtacagccttcacctttcagtccagggcttctcctctgtgaagccactccagatcctggtcccccgacccctgctccctgcttctgccctcacaggagctgtagatgtttctcgtggtgcacatcctgcaggaggttgcacgtctctgcctgtcaggtccagagtttccaatcccaagcacgccccttggcccagagctggtctgaagaggaggggatttgattggaggagaactgtgtgtagctcctttccagaaaccttctggtgctcttcccagtggttggggccccaggacgggtacccttcactgctctggagacaagcatagccttgacttcctggtttccctgccagccatgcaacaagccatgcaaatgtcatctttcatttctgatctttggtttgaagacatggctgtcgcttcctaggacacctgacttcccccagggagcatggtgatcttgaggccagaggcaccctgatcctgaccatccagtgggaaatgggcatcaggctgctcatccctctcctcctgcacgccacccacccctcatttggtcccagatgctgatcttgagtctttggggtgtcagtggactcctgtggcatgggtcttctctgtgaatacccactcgtagtgcagacagaggctggacagaggccaggcacccccttgcccggggtgctgtgggaaggattcacacaggctggcctgttgcgacaacctgcagccccaggaccctgtacagaggccagccccttgccctctggtatgccttgagggccaggttcttggggtgttcgccggctgggccgcaggacaatgtccagtctgttggtaatgaaaacctgcccttgcccagagcaagagggtcctttctccagcagctgtgctagctacacactcccagcccagagcagcctgcccctcgcagtaagggttttgcaccctgatcaccactgggctcccccagattagggggactaggaggagggactagaaggggcctctttgcactctgccctgtcctgaagctcagttccagctcccgccctcagttcacccgtgggcctggtagccagctgacaacagttttattcacctgttctctgttggcttttcctgcttggttgtcacaagcccagtttgttttgtgggttctttattggcttttatttagcctcaagttttgtgtttgtacccacctaggtagggtcatggtaggagggccttccttccatgtcactgacttctttttccaatttccctttacctccggcttcctacccgccccagcctccttgcctgcctccatggccctccctgcattcacgtcctttcccataactggcacaagcacagccctgagttataaatagccccaggccaggccctgccctttgctctctcgttttctctgcatggacttggctgatttctgagccatccctgtctgatgccatcagcactattcaggactctagaagattcttagtctaaggagaagtgcctcatcctgagtcttgtctccaccccaccccgtccatgccctgagccagatgttccctgagcggccccgcccttcagaacacggagggagagccagattctgccttcctgcctgtgctgtttttcctcctggctttccaaaccatgtggacagaacgagacacagtgctcccacccacgccggcacaagcatctcacactgggtggggctgtcatgggccctgctgccctagcagcctccctgggccctacaggccgcctggtactcatagtagcaagattgtccttagaacatgagcacggctggcaggctgggtggatgggtggcgctgcccaagggacccaccattcccttcacctcttctcctcttgtggagcagggagcggcatctgcacacagtaggaggcacctgcaggggcagctggggtgctttccccaaagactccaccattcatgatgggcagagagggggtgtcataggtcgccccaccctacgtgtatgtgcaccatgggcagcagacttgctgaacttgggtagcatttcagggcaccaaggcaggctcaactgacagccctgggttccttggacccaactgtctccaagtgagagtacggagaccctgaaggagccctcagagattcataaaaacgcagccaacactaggatacaaccaggtgtttaagatccactcattgatttattaaatgaatcttaattgagcacctgggtgttctgggcactgtgctagacagggaagttcctagctcaggcacagccgtggcctggaggctcccacccgtggagtcactgcctaccctgccctggggggacaggtgtgcatggaacctgcgtgtccttttccttggagctgctctcagcccagatcttgatggctgtcccccccacacacatgtacgtgtgtataaatgcatatatatacacacatatacacaggcacccgggcatgctgacacctcatgcatacattcacacaagtgtgcacacacttaggagattcccagggcaaaaaggtggcccaggaaggctttttagatggtcccagtgggcaagtgaggatgtgtggtccaagccccagggactcaaatggggcacagggtggggctccctccccgggcagtggaggctcagggccggagggcatttgcctgagaccatggggcaggccaggccctgggcacttcgtgttgaacctgctgtctataccatgacatgcctccctcctagagggccagggaaataggacagcagggttgggagtaggcaggggctgtgctgggaccctgattccaaattctacagataccatgaggcctgagctgacctcagtcagatccttcctcaaacccatcagttctcactggaggtgattctgctcccagggcatgtgtggcagcgcctggagacattgtggctgccacacctcgggggagagggtgttactcacatacgataggtagaggcaaggatgctgcacagaatcctgcaaggcacaggatgccacccagcccctgacagagactcctccgggcctagatgtcagcggggccaacgagaagcctgcccgcagccagtgattttccccgaaagtgggaaagtgagtgatcagggaccaccgccccagttccacgcctgtgagcccagcaaccagtggagaagtggacggggctgtcacagacaccggacctggcaccacccccaccccccgcacccacacactttcctctgactgcaggcagggccattgggcacaggcggaacaaagggagcacggcctcagcccggtggagcactgaggtgctgccatgggcatggccagcctccaacattgccagtggccagggagtaggcgggagtggccaggaagtcaggtggcgatttctgtggcctttggcatcatcatctttggtgtcatgcctttgctgggactgttgtaacaaagcatcacagactggggggcttaaagaacaggagtttattttctcctagtcctggaggcctgaaatccaagatcaaggggtgggcagggttggtttcttctcgggcccctctcctgggcttgtcttctctatgtgtcttcacataatgttccctccatttgagtctgtgtcctgacctcttcttttacaagcaccccagtcctggtggggtaacatggctcatgcctgtaatcccaccactctgggagtttgaggtagaaggaccgcttgagctcaggagtttgagaccagcctgggcaacatgacaagaccttgtttctattaccaaaaaaaaaattttttttttttttttgagatggagtttcgctcttgttgcccaggctggagtgccacagcatggtctcggctcactgcaacctccccctcctgtgttcaggcaattctcctgcctctgcctcccaagtagtggggattataggtgcccgccaccacacccggctaatttttgtatttttagtagagacggggtttcaccatgttggccaaggctggtgatctcgaactcctggcctcaggtgatctgcccgcctcggcctcccaaactgctgggattacaggcgtgagacattgagcctggaccccccaaaaatgtttaagttagcagagcgaggtggtgggtgcatgaggtcccagctacttgggaggctcagatgggaggatgacttgagcctgggctctcaaggctgcagtaagctgtgactgtgccacagcgctccagcctgagcgacagagtgagacatcgtctcaaaaaaaacaaaaaagaatgtgacatatggaaccttttggcttcagtttaccttaaaggccctgccttcagatacggtaacgttctaaggtactgggggttagggcttccacgtgaatttgagtggggaggggagatgttatcataactaggactagaaggtggcctcccaggggcatgggctctgtcccctacatcaacatccaacaatgtgtcagcttcatcatttggagacaaaaacagtagagcttccctgaactttcagcagggacgctaatgagaaggggggactttgtcatagcccacatgtaagagggtccctgccagtccagtgatgtcagggtctaaaaagcagggtcaggggacacaggccttgagccccagggacagggttcttctggggcagatggtagcagtccctgtggctgggagggagggcatctggagaaggcggtgctgcctgggccccgtcaatcgaagggtcatgtggcggcagcagtcagagaatccaggtgaggcgggccccaggtgagcagtggggagtggagtttggctgcagcagaagccaggtggccatgctgtgggctctgacgccccctcaggtcagagcctccttctccttccctgactgtgtcaggcagctgcccttgggttgcatgcagaagcgtggagggaggcctggcccagcctgctccgcaccaaactctgtttcgtggtctggcaagagtaagggtggccctggtgttgccagatgacccccctccccgggattctcagtgactgtgagtgtgtggcttagtatgtgcggagggtcccctgcctccctttaattccatgtggagcctttgtgggggcaggggtttgtccagaggtcaacaagctggccctcctctctcagagggccctgatggaagaatccccctaccacccttccaggctgacttctgtctatttctcctgcagagtgagctggacttggaaaagggcttggagatgagaaaatgggtcctgtcgggaatcctggctagcgaggagacttacctgagccacctggaggcactgctgctggtgaggaggatttagggagctgagcagggcgggatggggcagggtgacagggttggggagcctctttgcccttaagtcccaggtcagctgtcagagcctgggtgcagctcgccatccctggagtggataccagtggaagactgagttgccaaaccaagctggttttaaaattgtatttgttatgtgatttaaaaataaaagtgcatatgtcaggtaaccatgactgtctactgccatacaatgcacctgacggatggcagcccctctcacctgtgctacctcacttgtgccctcttccagcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggtgagtaacccagggccggtgctgggactacaggcgtgtaccaccacgtccagctaattttttgcatttttagtagagacagggttttgctatgttggccaggctggtctcaaactcctaacctcaagtgatccacctgcctcagcctcccaaagtactgagattacaggcgtgagccgccatgcccagcctttttttttttttttctaatttatatttatttagatagttatttttaaaaagagatggggacttactacgttgtccaggctggagtgcagtggctattcacaggcgcaattccactgctcatcagcacgggagttttgacctccttcctttccaaccttggctgtttcactccttcttaggcaaactgatggttcccgactcctgggaggtcaccatattgatgccaaacttagtgtgtagtgcactacagcccagaactcctgactgaagccatcctccggcctcagccttccgcgtagctggggctataggtgcacgccaccacaccctgtgtgtggctgggactacaggtgcacgccatcacaccctgtgtgcgccatcacaccctgtgtgcaccatcacaccctgtgtgcacacactttccctaaagcaggcttcctccgctgggaaacaagtcctctaggggcaggtgtggccagaggccaggcccccctctaagtgtgaagagcatgtgattccttaaaagcccttcccccagcacttctggactaccgagacacacagctctggcctcgggcctccccttggctggtgctgggggctgagttttctgctctgaggtgtggctttcctgtagggggacccctccctctgccaccctgtgctgcagacccccagactccaggccagagctaaggcttgaggaacacagaaggcacttaatttgttccagttcttgctccctggggctctttcccccatggccagagagcaggaggctgtattttgatacatgctgccccctccatctttgaagcccccccacccccgtttctccgtgtgtgtgtcagcagttttaaacctagtggagggtggtggctcgggctgggctccgcgtcgggctgccccgcagctgctcttgggcagccagggccgctgggtgtggggccgccgggaatggcgggcccgggtgagggcgggcccgggtgagggcgggggcggagaggcgaagaagctgcaggaagggagggtgacgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacctcgcatattgtcagtgcaggaggagatgggaagattggccttggtaagattcacagcaccttcgctgccaagtactgggctcatgaacaggaggtgaactgtgtggattgcaaagggggcatcatatcattgtgagtggctccagggacaggacggccaaggtgtggcctttggcctcaggccagctggggtagtgtttatacaccatccagactgaagaccaaatctggtctgttgctatcaggccattactcagctcttttgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagcgttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaacctgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccgctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaaaaaaaacctagtggacgtgacttggcctgccgccctcctgagaaatggagaatcgtgttgttggggggaaaaaaacacacatccagagctctttgccagataatattccgaaatcactcagagacttttttaaaactttaatatctgaggaacactggaatttaactttggaaggtttccgctggctgccctggaggccttgagctaccttcatgcgtcagatgatgcagccggaagactcggaggagaggctggcgttgcagtgggaagttgttccccataacgacgagctgagtactcacgtgtgttcaacctgggctgggtgctggggactccccaaggacagataggcccggtgcctgcccttgtccccatgaccagctcagtagggttggcccagcatcgctctgtcaggtttccgggttggacaagtcttaggaccaaaggagcttgcagtgcccttcccagctccggtgcctcttccaagcccaggaactcgtgatccacgtccagtggttcagaaagccagactcagatgcggcttctgccacctcctcctgtggggctgcacgggctgacttccctgctctgggttgtggttctggctgaagttttatcaactcagaatttttatttttctaattatttcaaacttacaggagaactgtaagaatggggcaaagagctctagtatagccttcatccagatacactgatgggaactttttgccacatttgctttatctctttctgtgcacacgcaaacgcacatagacacatacacacacaagcacaagaagttttccccctgaatacttcatttgctaagaacaaggacattcctataactcacagtagaatttgtcaaattcaggaaatttcacattcatgagatactattatttaatatgtagttcatataaacttcccccaagttaacaattacattcttcacagctgttttcattctctgattcaggacccggtttaagatcatgttatgtacttggttgtcccatctctctagtctccttccatctgtaccagttccttagactttgcttgtcttccatgaccttgactttttttttttctttttccttgagatagagtctcactctgtcgcccaatctggagtacagtggtgcagtcttgtctcactgcaacctctgcctcctgggttcaggcgattctcctgcctcagcttccctgagtagctgggactacaggcacgtgccaccatgcccagctaaatttttttgtgtttttagtagagacaaggtttcaccatgttggccaggctggtctcaaactcctgacctcaggtgacccgcccgcctcagcctcccaaagtactgggattataggcatgagccaccgcaccctgcctttttttttttcccttttggagatggagtctcgctctgtcacccaggctggagtgcagtggcgtgatcttagctccttgcaacctctgcctcccaggttcaagcgattctcctgtctcagcctcccgagtggctgggattataggcatgcgccgtcacgcccgtctaatttttgtattttcagtagaaactgggtattgccatgttggccaggttggtcttgaactcctgacctcaggtgatctgcctgcctcggcctcccaaagtgctaggattacaggccgccgtgcccagacaaccttgacattttttgaagggcacaggcccactcgggtttgccagtttcctcaggaatagcctcacgttctgcgtaacagcaccacagcagcgaggctgtgtgcttctcagtgcatcagatccggaggcacatttttgattagtgaaaaatgtggaaaggaattgcttagaactttgcacaagccacctggaagatgtgagctcctggagcaggagggaggagaagtcttgaaaggagtcctcttcccaagacccctgagaccctgctgagctgtcacctcttctgagaggctgtcctggtcctgaccacattctcaaaagcagtctccttgctctcagtccctgtcctgcttataaccatctgccattactttgcttgtgtgtgttcatgcatgtgtttatcaggcactgtcctgttagaacaccagcttcagagggcagcgccgtgtctgaattgtttaccactgcggtgacaaggcctaaagcaggcccttggctgctttgtaccaaggctgggaggcactcagtgacttgcaaaggagggaggagggaaagaaggaagagctctgggcctcatcactgcacggatgaggaagaacctagaattggaggatgcaaggactcctccaggtggtcagcatggcaggggcctggcaggtgtcttccagctgctaccctttcctcgtacactctaagacccttcttgcagcccttgtagggagcagggccagaagatcagacagtgccaagggtgcctggtttatccagcatctgggattgtcatctgtagaaacataaaattcaatataaatgcaaatgcacatggaaataaaatttaggtttgacacaaaacaaacaccaggagccgtgaatgccttgggcttccagcttgcagtcagctacagtgggagtctccagccctgaccagtgcatctcctgggtctgcccttatactccccaggcctaggtttgctgatttttccctcgctgcccataaaggtgttgtggggcccagagatggcagtgtctgctgcactcacacaagttgttgctgaatcgagtgtgtgtctgagctggaggtgcagtgaggagatctattattgccattggtttaataaagaacaaacaacacctctcgccttacagccggtcggtctccccccaccaggtgtgtagcatgacacctgagcaccctcaccaggcccaggatgggcttgtgtctgtgcagtgggaggctctcttctgcaaagacggccggacttggcatttcttatgtgtctgaagggactggacatgcgtggaacaccatgggtgggaaagggggtgacctctgtgtccagggtacactcttgcagccagaatgggaaagtgctgagcacagacacttgtccagattcactgacaacctcaaacttcagctgccgctcatggcaccatttcagcgaatggggtgggaggaataagtagctctggaagggaactgttacctgcctggcgccgtgagtcacttctcagcatgtcattttgggagcgggaagtgtgctgggtgcgtggggaggggagcaggtgggagggagcagcacggaagcgccgaggcctctgcagcctgtgtgccgtctgctgtccctggagtttctgcagagctgtgcacgggagcctgctcttcagaaagatgggggagcagcagcacctgtcccactctctcttccttcctccccctcaggccagccagctgggtgtgtaccgggccttcgtggacaactacggagttgccatggaaatggctgagaagtgctgtcaggccaatgctcagtttgcagaaatctccgaggtaatgccttgatgccgttcagacaggtgcaccgctgactcccacctgtaccctccacctcccgaggagaacagagtgcaccagatcaagatctggtcgtgaaccccagctgtttccagattctgttgggttcgttgcgtcagccctgtgctggggatgctgttgtgcgcagaccgaaggagcagcccacagggcgtcctgcctccccgggggcgagggcctgattctgggggttgccgagttccggggacactctttgcactgtctgtctgcagtgaggggtgtctgtagttctgcctgtgagcagctctctccacaagagtcctgaggctgactttgtacctggcactggaggcgaggccggaggtggcccactcttccttttctagcctgccagagaccttgagagcattgaggaagcattgaggggctagcgccgtggggcgagggctcatggcacctgtgctctgtggacccatgtggggagcaaagcgacaggttggagctgcactaacccaggccccaggtctgagaggctgctgactccctgcctgcatttagccccaggaagctgaaacctcaaaccatgtggtgttagcgcccagggcctcgaaagagtcattcagaaacagagaccatgaatgggccattcagaaggctggtggcccagccagaaccagaacccagccacacccctgggtctgcactccagactggggttctttctgcccttctccagcctgtgtctgcctggtggtcactctgcgacattttcctctttggaggcccttgcctcttcatgagccccccatctcgctgtagctttgccttctgacttggctttcccccacccagcaagggttctgagcagaaagccctccgtgtgagaaccgcagggttagaaagaggcatgggcactagaaatagggagtgaatgcggtcacccttgctgggacaccctcagctgtcacccctgggctttgttgctgaggctttgtgccgtcttattgtttatcaccggatggagcatcacgggcttcgctctgatgtctccagtggtgacagtacctgccgctctgttcttccagagtctgtggggcaccctgctccgccaggtgctgctggtaacaggctctgcatgtatccggggctccagctccctccccactgccagcctccctctggaccattcaatctgttctcttttcctttttcattaaatgagcaaccctcctcccccacagctggaatggtggcatcgaatttcaagtgaccttgacaaatcagggacctgatcttttaagaacaggttacagttaagcgggcaagttcaagtccacccagacaggtttctgcagaggagggaggaaacaccatgggacgccacctggggatcacgtggtgccaccaaccatgcaccagtggattctgagccatggttgagatgcagggagtgggatggggctcaggaccagctgcaaaccgacccaccgtgaaagtttgtggcacctgcaccatcagggcgacatgcactttggttctctgtgtttcaaaaaagacccagaggaattggagccacccaaagaaagcagagtcaaacgcaaggaagagaaagcagcaagccctgcagaggtgttggggggtcagtgctcaggcgtgggagttcgaagatcaccctcaagtacaggaaggagtggagtagtgtccgtcttctcctgggacagtcctgagagatgggcagcatccagttagatctggttccatggaacaccagctctccagacggtaggaataggaattacatgaaaagggctttgggagtcaggccagtttgggaaatgcagggttaaaccaaactcacaagttttcttgaggcaggttttcctggagctcctagataactcccaagcatcacactgtccacggacacgtgggccgcctcccaggctcttgtgagcccagcacctggtttttgcagtcttttgtttggctctcccacccccttacaccctttgggaactgctgagtcagatatacagaagaacagtcactgcgagggctgttaaactctcaggaaaggtaccaaagtgcatggcagcgtttggccccagtgagctggaaaacactttcgtctggtcttgagatgtttcctgcagcacaagaggttggcagagcaacctcagaacctcttctgtctctgtttatgcttttgttcagaagcttagtaccaggaattaatctcagctccttcccagaggattttaggcacacagggatcttttattctgcacttctccagtgatgctttcaacacaattgtatcaaaacagcctaggctattcacttacaagccctgcttttgccctgggaatcttagcacctcattttttagtaagtacacttgcagatccggagagggcaggtggaggtataatccagtgtcagtctgcagtggtgggcctgccctggccgtctccaaagatgggtgctcttcggaactggcagccccctgcatgctgtctaattgccccaagaaaacagtgacgtgtgtttaggagcatgctcctgttggcctccatttacaggatcctctgtgtcagaggatctcagccaggcgtgattttgttcacaagggacacttggcaatgcctggagacattttggttgtcaaaacagcaggaaggcagacgtgctcctgtacctataggtagaggccagggcagctgctcagcaccctaaggtgcccaggacagctgctcagagaatctgtagcccaaaatgtcaacagtgacctggctgagaagccctgtcccaggtggaccgcagcatccagggcatcctgcgtgctcggcttgctcgtgggtccctgcacaccctgtgacttcattatcagctcagaatgcacctggggtttgttgtagtgagggaaagctgaaattgttgccaaagggggaactgtctgcatcatcaaagctgcttctgtcatctgtgtgaacatgcgcttttctctctgcagaacctgagagccagaagcaacaaagatgccaaggatccaacgaccaagaactctctggaaagtgagttctgcatgctgaggtctctgtgtgccctcgtcagggaggctgctgctggcagagggggcgttgtggaaaagcagacacagtgcccacttgggtcatcccttggtgccttccctgttctctcttcagatagagtgggcacgaggaaagaacagctcagggagggcagggaaggataccatcaggaccagtttgccaccaacattagcaacaaggtgctgcttaaattgacttaaatgttatcctgttgaccccagtggcctcataaggaggattttttttttttgaggcggagttttggctcactgcaacctccacttcccgggttcaagtgatcctcctgcctcagcctcccgagtagctgggattacaggcacacaccaccacagccagctaatttttgtatttttaatagagatggggtttccctccgtattggtcaggcttgtctgaactcctgacctaaagtgccttggcctcccaaagtgctgggattacaggtgtgagctaccgcacctggcagtaacaaggattttattttctgtttttgccaatgacaagtttggtcataaagtaatctgtgcagagcacaggctttaagtggctgggcaggaattgagtccagagttgctgggaaagtgctgtcaggaattgtcagtcacttcttattttcagttgttagggtgttgtgaatagttacacttgcaaagaacagcagcccccggagctttgtcctccaagcctcagtttccctatctgcaaaatgaaaatagcgatgagtgccttatgctggttgtgggagtcttgtgaagaacatacttggcatgtctcagaacacacctgagcgtctgtgcctgggacgggccacactcactgtcatcatggagaagcacgggtggctgaggctggccagggctcccaccatgccagggagttgctcccactgcagtggggctcatgtgcctctggagtccgggtgtcctcgggcaggtcgccagagaacctgtcaaaccaagagttgtattggcatctgagtaggtttctgcttgtctcagagtcaggtgtctgaaatgtcctgggatcgatggtaagagcagctaagaggtctgctcagcttaccctctgggctggggagcaggtctccctccagaattggggcccaccccagcccgtccttgccagggtgggttccctgacctcaggctagaggagcagcagtgctgagccttttcagctgttgccaccgagccagccatgcaggctcgggtctgacagccgctctggactctgcatgcagtgaatgtcctggacttaaagtgttcctgttgggtgctctagccttgcccttgtcactgcgcagaggggagatggggcctgtggaggctggggcagccccctccccactcacccttgcaccgagggtggtcaggcagctggtgtgcttctccatgtgcaacctctctcacctcccctctctctccacagctctgctctacaagcctgtggaccgtgtgacgaggagcacgctggtcctccatgtaagtcacagcgcccctctggaccgggaccaaaactgccccctcgggcacacacagcaacaatgttctgagacctttttttagttgtcatagctgcagccaagggggtgctactggcatctaatgggtagaggcctggggtggtgttggacattctgtagggaaaggacagctctctcttgtccctccacaaagagttactccacgcaaaatgtccacagtgctgaggttgagaaaccctgccctagatccttacagaggagtccttcttggccatgtgcatgcagcgtgagtttgctggaacacatgtaggacctgcttccaggatggtgctcacacaagctctgtccacaaagctggggcccaagtgagagagactgtggtgacactgagggagccggcgctctgggctccgtccacactttgtgtctgcactttgcacacagtggcaggtgccagtgctcctctgtgtctaactcaagtctttcttcctggggcaggacttgctgaagcacactcctgccagccaccctgaccaccccttgctgcaggacgccctccgcatctcacagaacttcctgtccagcatcaatgaggagatcacaccccgacggcagtccatgacggtgaagaagggagaggtgagtgtggcaggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcacatcatcgatgagcaggcatggcctgtgcctgtgccgctctgagccttcctaggtgtggcctggcacataatgaggcagatgcattcccaggcaggtagcagctactgagaacagccaaggcgtgtaagctggggagccagtgtccagggggaacagcttttgtcagaagcagcactgaggcgaggggagctgacccccggcctcaggggtctcatgcagggacagaagctgtctggcccaggcaggacacaggctgggcgtgaacctgactgtagttgcctcagaaccacctcatggctgggtgcggtggctcacgcctgtaatcctagcactttgggaggcctaggcgggtggatcaggaggtcaagaattcgagaccagcctggccaacatggtgaaaccccgtctctactaaaaatacaaaaattaactgggcacggtggtgggtgcctgtaatcccagctactcgggaggctgaggcaggtgaatcgcttgaacccaggaggcggagtttgcagtgagccgagatctcaccactgcactccagcctgggtgacagagtgaaactccatctcaaaaaaaaaaaaaaaaaaaaaaaagagaaccacctccttctctttcttctggttcatgggccaggtggtcggcactgtaccaaggacacgggccctgtcctcagggcccccagggtggacctgcccaacacatggggcttgctttcctcctcctgccctgggccaccaggcaggcagctgtcagccccatctgccacacaccactttgggaatggtaccctgagtgtccagagtctaatccgagttgacctttagtgagggacttggtcaggtttctcctggtgggcctggcccaggaagggcatggaggaggagggagctgtcccttccattccgctctccggcttgtccaagccctggagctgggcagactcagagtcccatgccagcatcgtgaggaccgacccactgggtggcctagagcttctcccaactgggcccattccttgtctttgcagcagggtgggaacatggccccacctcatcgggcacctgggctgtcaaatgggcatgatttagtggcagtcctcgccatccgtgttggctccttggcagtctctgagcgcattgaaggcggaagtgggtccccggcaccttccagtggaggcgttgagcagtgcaagtgttccccagctgctcatcccatggctgggacctgggagtggtgggggatcagatcttgcttcttggagcaacaaccgggccctgcccttggttctcttccctggctcagggccccagaaggagagcaaacctgtgacaaacctgtgggcagtccacacagatctaagtggatgttggatttgcttctcctaagcctccacgtgctgggtgggttcctgccaggttcgccctaccctcctgagatgcctgctctttctcttctaccgactattcttttatgagcgctctgacctcctgggaagtgagtgtgggcgtcctttttcccatggcttctcctgtgcctagtctgctccctgcaactgcagctgccatttagcattcctagagacaaggaagggccttctcagtgctcggatcattggaatccactgctttggggaattaaggaaaacgcgatgttgtctagaagttgacacctaggccctcgttcctgcatccgtccccatgggggccaacttccacgcttacccatggtcatgtctcggggccaccaaggaggaagtgtaatttaagaagggctgggtgcggctgggcgcggtggctcacacctgtaatcctagtactttgggaggccgaggcaggcggatcaccaggtcagaagtttgagaccatcctggctaacacgataaaaccccatctctactaaaaatacaaaaaattagctgggcgtggtggtgggcacctgtagtcccagctactcaggaggctgaggcaggagaatctcgtgaacctgggaggcggaggttgcagtgagccgagattgtgccactgcactccagtctgggcaacagagcgagattctgtctcaaaaaaaagaaaaaaaaaaaaaaagggctggttgcttcacaaaggcaggggcctggatctgcatcctccccaggacctcgccctggtggaggggcacttgctcattgaggaggggtcacctgggtgccttagctgcaaagcaaggtggaggactaatgactctagaaaagtcaccgtgagtctgaccagcaccccttcactcagagctttctatccgaggcacgttaagggaggtggcttgatggtggctaaggcaggatgatagatgcctgtgctttgcccctgcccctgccattcctggggcagatgctgctgatcagttgggcactccaagcctggacatccacctcggtatcccctggcactgcccaacgggtttgcagtccttgatgcagaaagaaagatgccagatgggcgaagccccgtcagggtccgctctccctcactgctaccagtgtactgatttggggacacccttttgcttccctgggtgtccgtgctctctgagggcaatgatgcagggtccgtggcccctccactgggtgttgagactgaaaaggtttcacagcctgcgagggactttatgaaagtgaggggtggtggcctgcccgcatgctgccatctgtgtcggaggtgacgggcgagctcccctgacgacactagccaggaaaggggggcagaagctccaggctacttcctcttagaatttgcagccaggggcagggcctgaacttttctcagttctgcccatctcttagtttggtacatgacatggagtgtcaagttcccaaagggagaaagggactgtgcctctgcattctcatgacagttctgtggggtcagaggtgatctcccttttacagatgaggaaactgcgactcagagaggttgagtgtcttgcccagtcacacagccactaagtagctaagccaggatgcgagtgaggccatgggcccctggccgcctgtgtgcccctcgggtgtgttactctttggttcccttcctcctctgtgagccgataggacgtttccacccctcctcttgttcctgcactacctggaggtaggaaagaggaagagatgtcccttttagctccgcacactaccccatcccctgctgctgctgctgctgctgggagtgtgtcaaggggttggggctgtttctgtcttccctggcatttgatgtcaagaggaaagctgcttctgttggcctgggtgtttcgaggttctcctgcagtcactactgggcctcctgggaggtggcccattgctacctgctgagcctgggcaagtctggcatcgaggagaggcccaggtatgagccctctgcagggtcagccaccccagccccagacccccactgtggctcctataatctcattgcccttttcagccacatcccatggctccagggctgtgctctttggggaacagtgactttgggctgcattccaggtagctccctgatgctgaacggtggccggcaggtgctccagcttcctggcatcctggcccaagcacacctgggggccgtgagccacaggtgctgcccaagagaatgccctccttagccttcccaaaatgacaggatcaaaggatcccgcaggcacagtttctttccaggcctgggttctgagggctggtgggtggcgctcatttgtttaggtgaattaacttcacagttagataaccaatccccactgctgggtgacttcccacgtggttgcctctctgtctactcggagccttggcaccacgtgctgctcagcaccccctccgcctgggctcggaagcatagcggacgatccagtttggatgttctgtttcccaagagccagccaggcattgacctccaatacccgttctctgcctgggattgcagaggcccctcttttaggaagaacacagacagcagtccaaacaggagctgcaggaaggccctggaggagggaagtaccaccagtgcaggcttgaggctgagagatggtgaggctcgggcagaggagaaccaaggtctttcagttgatgattaaagagttggagaacaggctgggcatggtggctcacacctgtaatcccagcactttgggaggccgaggcgggtggatcacttgaggttaggactttgagaccagcctggccaacatggtgaaaccccgtctccactaaaaatgcaaaaattagccaggcatggtggcaggtgcctataatcccagctactccggaggcggaggcaggagaattgcttgaacctgggaggcggaggtggccatgagctgagatcacgccattgcactctgcactccagcctgggcaacagagtgaaattccgtctcaaaaaaaaagagttggaaaacagttggagaagccagaccctgttggcaaagtttgcaaggggtgctacggagagggaggtgcccaccccaggggtgaagacaggatgggtggggttctcagctccactggacaccaaacagaagctgtaagtgcaaggctagtgcccatgtcgagggctgggcctttctgggcccttcataaacattggcaaacaaagcttgggttctcggcttgtctgggccaagttctaattccttccaggagcgtgggcacgttgcttacctcttagctgtttcttctccaggaagtggtggagctggagcctgctgcatgggagggttctgtggagtgagatgagatgttttacgtcatgctcttttcacaccttcttggcacccagaaagagctcagcaaacattagctgctaccagccaccctgactgtggctgtcagccagcattgttcttcccaggccctgccctaccctcctcctggcatagtgtctctcagggcataggaaactttctcggccagattggccatgggaggctttcttggggaccagagagtctgcagggagggcaagtcaagagcaggtgagagggagggaagggcgagcaggacccttgacctcattctcggctgcagtgtatattggcctgcctggtgaccctccttgctcctggtcccactgccaaacctctggagtctgccacatccctgcatagacagggccactgacaggcagtggcagccagttcagtggcactcagccaggtctccaggggtgtgcgctttgctctgggggcagggtagcgggggctgaggccactggctgcctccagggcccccccaccagccagcagctggaagctccaccttggtcttcacttgggccgtcttccttctccacttcctcagctgctatgtgggcttctttggcaacttttccttgtctcaccagtcaaggccctgctgatttgttgatgatcagactgtagttcgtgtacctggggaagttttccagcatctccatggagccatggtctctgattcctggagcatgtcgtagtcggttcaggctgctgtaacaaagtatcatctgctgagaggctcacacacaggcctttacctctcacagtggtggaggctggagatccggcagggtgccagcagggtcaggttctgatgagggcagtgagaagcacggccaccctcccactgtaccctcacatggccttcctgggagtggacatggagagagaaaaggacctctctttttttccttcttatgaggacactcatcccatcacatggattccaccgcatgacctcatctacacctactcacctcgcaaaggccccacctccagataccagcccattggagttagggcctcagcataaattctgagggggacagaaactttcagccctaacagtatgcttcttccagactggccttcctgggaaggccctggataggctgtgcctggggttgggggtgatgttgcactggcaacagctggaggaggcagctggcctgggggaagtccccttagcaaggaggtgcccctcctcactcccaccagcctgatgcgaccccctcctcagaagacagggcacataatgtgacctcacagggcctcagtttccttgtgtgtagaaatcagggttatggtgcctgccttgtagagtcctggtgaggagtgagtggtgtgattcatgggaagctgtgactgtcacattcccacctgcagaggacatggcgaagggtgacagccccgtgtgaggccctgcaggtcgcagtttcatttaatcctcagaacataccaccagactggtctttctcaccccatcatgtttaaggaaacagaggctccaagaaatggaggagcatagccagcatcatcgtcacagagaaggagaagggtgggctcgggacagtgaagatgcaggctgtcctggccacccttgctttctgcgggctcctgtggggatgatgattttagttattcaagaagacaggtggcgtttcttccaactggtgtttcccacctgggatgtgggggggctccccaaagggagtgttgtcctgccaactggggcctgctgtcccactgccctgccccgctctgaagcacacacagggacccatgcccacacggggttacttgcaccaggacacacacaggcctgacacgcacaggacatgcccttgcatgggaacacacacacagaaacatggagatgcacacagtgagacacacgggcacacacctacccaggccacaggcctgtgtggggttccacgcacgagggcacgctcaggcactcacactcacacaagaatgaacacacctggaaacatggagacacacagggacacacagacgcagagcacataggatcttcccctgtgcccttttcatacacagactcccatggccccggggagccaaagtgtggtaccgtccctgtcccggggccactgaggccctggccctctctgtcccacagctccagctgggactgtttgccctagttgagatgctgagccttggggacagtggtttccagccacgtggccttatgccggctttgggatgcagtcaggattgtgaccccggcccacccttgccgtgtgccctggaggacgactcgggtgggctatgcaggaagcctgtgctgatctcaaggccaactgtcctgtactccaggccggggaccaggctgctgagcgcttccgagagggacatctcctgggcagggagtgacataggccacgccatgtgggcctcccagccatgtgctggtgctgtgtgggctgggagggcaggcaggggccgagtgacggggactgcagagcggggcctgagatgctgtgacatgctgggctgcctgtggctttcgggcttctctcagatgagagttgcacaggtgggtggggggttggggagtctgtggcagcatcaaaagagtagcccagaaaccgccgagtccactgttcgagcctcccgggcctgcagcccgcaccccagaggggccacttcctccccacagtcaggcctgtgtgtcctctcaacgtggcaagccggcatgtgggtgctacaggtccccagtgtgacactcagtagccttgctgaaggccgagggtgccccttaggtgggttgtgggcagcctctgctggagagggagctgcgtttcttgaccgcaggcagagtgggctgggtctgcagtttctgagctgagcatggggtgccctctgctggtgatggcgagaagctcactgcctttgtatggagaaggctgccatccagccccgccactgccccagaaggaaggcgcctgagacccctcctccttggccgggaggccctttgctgtgtccctgccaagaggacctactgcagtccttcccgaaggacctcagtgtcctgggaccctacccagatctggtccccactgcagacccagcagtttgggttacccggcttcagcgctccagctctacatgatgtttctccaggtgcacatgctgtttcttgcttcccgtgggtgccgtcaccaggcagccgtctgccctcggcaggcggggtgtgggtgagtgccgatgagtcatggccttggcacgccggcagccttcctacccttccacttatgggcaccagcagcccctgcgtaattcattggttccccttcgcaagagccggctgcctgtcgtgagccaagctgcttatgatggtgacatgaagcctccacctctgagagtgtcggaggactggcccaggctgttcttgcaaatggggagctctgttgcctccggccccagaatgggggaaaagttcagagagaccgaggctccccgagaagaacctcaggctgcaggtgacagcagggcaaggtgcctggtctggccccaggaccagcctggctccctgagagcacaaggcctcatcacttctcgagatgaggacaggtgcaccgcctgcggggagacactgggttttcacactctctgttgtatgtgcctcccctgccaacccttctgactctcagtgcagggcgggcgtcgtcctccctgtgagccttccctgagaccaggtgggctgggtgcccactaaacacttggcctctctgccacgaggttgtggactcctgagggtagaggcctgtgaatgttacccctctctttctgcgctgcctgggacagagggtggacctccctgaagctctgttttctcattaaggacctgcctacagcctgttgtggggattgggtcaaataattcaggcgatgtgctcgtgcagtgcgctggtcccagcgtggggaaggcttgctgcgacagcctctcctcctgtccctgtaccctcggcacagcgcccaaccctgtgaggtaccaggcaggggtgacttacctagacatgcccattcagcagccccttgagcaagaaggaccgacccttgcctttcagatgcagaccaagatgcagaaaggcacccttctcaggccgcaggtgtccaggcaggtgtcagaggtgcagcccgtgcacaccggggaccctatccatcctgtctagttgggaggactaggagttccacatgtgggaccctcagttcctgctgccttcagaaccaggcccaacccttgctgtgacctcgagggctgccacttttcagagtgcactgggcctgtctccacccatagaccatactgccacatctgtacctcgggcaccaatctctccccaccacaggggcctgtgcctgagatggtccctctacagaaatacctgctcctggcatggctggcttcttgccaattctggatctccagctgccaccccagagaggcactggcttccctgtttaaagagggtccccccatcacccatcttcacagcagactgtttgcttggctgtgtgccccttcagacccacacccattacctccccctctcccccatcctcccaccctcttccaaaggctgaacacacaggagggattgggaaatttgttgaacaaagaagttacacataagccctgatgtgttagcaggacagtgagatgaacaaaacgttctggaaagtgggtgtgagggtcagatgtggagggagtgaaatcttcccagggagagaatgtctctgggtcaacctgctcctgctgggctgggagggccgaacaccccccacccatcaccccaggctggccctgaccccagccttccctgtgcctgcagcaccggcagctgctgaaggacagcttcatggtggagctggtggagggggcccgcaagctgcgccacgtcttcctgttcaccgacctgcttctctgcaccaagctcaagaagcagagcggagggtgagtgacgatgtggcccctgtcccagcagtgaccccaccctgactctccaggtcatggagggtcttgtcatggcggaggtcagtggtgatgtagctcgttacattccgtttctacttgggcacaatgccaggctccaggttaaagattgtcactagcaatctggagacgtcatggggcatcagggtgaccagctttgactcctgtagtgaggggtaaacccgaccgtggcttccggcactattgcagaaaggtcacctcaggacccatccgggaagcgtgagatcaggggctgcaggcagtgctgggtggtggctgctccttgtctccccgagcctggtggtggctttccgagttatcctcggcataggcgtgcacacactcccctcctccctcctccctgggttcacccaggttgcaccaggttggaatggagcaaagagggccacactgggaaggaccagcacggggctctttcctgcatcctgccgttgccctgctgagtgggtttaatcagtcaactcagaggagagccttagttcccccatctgtcaggcgaggggatgacgccagctagatctgtagtccctcaaactttacggccctgggggtggatttcagtcctgtcctgtcattgtgcagccttgatgtgctcccacatgagccttcaaccttagagccagctcaggacaaggtggatctagactcctgagatgcctggggcctgcggtcacatgttcagagtgtctgttcccaggaatcctggcacctgccagtggcctcatcccagtctgtcccatggaacacgtgctgggttttaggtcaggtaaaccatgtatggccgagaacactggctcttgggctcttgacagcagtgacatcagccatagaaggcagtcggtgcatgtgaacgttcttctctccccatccccagcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaaggtgcacaccaggggagcaagggccgggtttggtgtggtcagagtggcagcagtccccgcacacggccagtgggtgctttctccgtcaggcctctgggccccaggtctggtctctgggacccctgtaagctctcagctcttggagggctgggcatctgggcacaactaggtgtccagttgttctgagaacccccagctaaatggggagcaccataccagagcggctgccaacccaaccctccagaaaaatgaagggaactggtcgtggtctctacagtgcgcctttcacgggatacttcttagacctggtggactgcctcatgcttagttgtctgacctgtgaccaggggtccctcacgagagaaacttgtttaaactgtgtccagtttatgcccacctgaccattgctgtggcactgggagcctgattttgtgttttcactggcatccccggggaaaacttaacctaggcaaacacctcctagtttttcggaaacacagcaccacaataggaaacaagttcagagattttacctacaggttttggacaaggaggtgccatgagtagggagggcagtcttctgtccctgggtcatgcaaggcagaaatgaagagttagcgcatgacagctagcagtatttataagggaacagggtgtgatcactttaagttcacaggcaaatgcctggatggtccttttaaggaagcagcaggaatgcgggagctcagtcagccgggcgggagagaggcttccgggttctcacctctggccacaggcttgagctgttcaagtgtgtggtctcctgatacccaggctgcgtcctttgccgtgtggttccattacatgggtgaagtactgagtcaccagagagaaagtcacagccagacagtggagggcttggagtagtccaggatgcagggttgggggaggtgctggctgtcccccatacaagctaccctgatggggcccaggcccaggtggcagtgccacccctctaggtgttcaggactacctgcccttggttttttccagagatgtttgaagactgtaaaaatggtgaggacaagcccctcaatcaaaggttagccaggccagaggaggcgggtggcatcaaggttaggcctgggtccaggtatgcccaggtagggtggacgcagcaggacaggaggtcctcagcccttgcccagctgcccagcctgctgtacccaaacccagcacacttaggaacacagggagcttcaagactggggtgaacattctattgtcatccttgtgggactgtgacctccagggtagggtgtccccacacagagtgggagccagtgctcagggcagctgagccctattgactgttactgttgcattctccatgttcagctctttgggggatgggatggggtggggccctacctggtgacaggcagcacagttttctcctccccagggatagtggcttctagagtgaaacccatggctcagcataggaagggccttcccatccaggttctgttgacggtcgtctggtcttctgctggcatctccacaaacatgcccaggggcccgatgctgaaacctagttggattaggaagagggtgagggaccctgtaggtcacagcagcctcctagacattgtctgaatttgggaaaatgaaaggcagggatgttggtaaaagtttcttctctccgcccttgtgagaggaaagacttaattcctccaaaaaaggtttactgagcatgtcctgcagcttatgccatgccttgaccctgtaaaaaagctgtttctgtcctccagaggccaccagcaactgcggtctggggccctggtctgtgctgagtggagagatgggattcttgccctctgcaggctgaatgcagctggtggtggggatggatggaatgggagtgggttgtgtggagcgctggaatgggaaggtgaggctgtggcatctccccacagagggcgaacaagggcagcaaggctacggagaggctgaagaagaagctgtcggagcaggagtcactgctgctgcttatgtctcccagcatggccttcagggtgcacagccgcaacggcaaggtgagcgcctgctgttccggcccctcctgctctcctggcctgggatgggctcctggttgcctaatggcagtgcgttttcacttggatgcgccccactctgagagaggcatgtccggcatggtgcatgcaagcacgcacattcctttgtctggggctttgggctgtagcccccaggttgagtggcagctggctcagctcccacagctgggagtggacagggtctccagggagggtatagggcaggggagcctagcaggtttgtgcagatctggcccttggtacagggatgctgtcctggggccttgagggccagagacacaccttctgtcctgagtctggctcctgctgccatctgtaacctgggcctctccctcctgtcaatacatgtctgtcaatgtccagaatggcttgttttctagcctgaccaggagaggcagctggtgggctctgcagaagcctcacctctgggctagtgtggggcttgtgaattgaatgcaggaggtcaggtctggatcaacgttcacctctgcagatcccacctggttacctccatgtccctaagctgtgcccctctgccagcatcacaccctgacccatgtagttcgggtgagagatggtgtgccagaggtgctgtggcacccagctggcaggaagggtagggagtgccggaagcgacatgccaggccgtgagcacacctggccactgggctccagccggctggagatacgagttgtgtgctctaaggtgccccgggcctaccaggcatttgcgtagccagggcggagataactgggtgtgttcttcttgcccaccctagagttacacgttcctgatctcctctgactatgagcgtgcagagtggagggagaacatccgggagcagcagaagaagtgtgagtatcctctgtcctgagaggggctgggcttcaaaccattagggccaggctggcagctcctgtggttttaaaccttcttttttatttcgaggggttttatccaagtgaagtgttgcatggagggctaatttagaaaagaagttggcgacagccatcccgataggcccccagccctcttgttcccctgccagcctatcctgcccccatcacctgggcactcatttccccactgccctgtgatcccctgtgaatcccccttccccaggccctttccagattccacacctgcccctacacacacccctgccatctccccctagtctgctgcccatacaccgcacccccggcctgccccctagtcctttctgggaccctgccaccaccccattttcttggcctcccccatttctcctcatctactccccgccccctgggccttccctgccccagcaggtgctgatgctaaaggggcctttggctgggcccacttgggcattcacactgtgctggccccactgccctgttcatatggccggggttgcccgctctcagctcaggggcgctccctcctgtctggggcagccccttccttctctgggcacttccctctgtcagggcgctccttccttcgggtcctgcctggcagtgtcggtggggaaggcagacccggttccctccttggaggtttgggattcaccctgagctggggctctgcatgcctctggcctggcctgacctcccgcgccctcaggctcatcattctcacctatgcagagccacctctcggcccccaatgccaccgtggcctgggggatcaaggatctccgggcagccctgccagtgcttgtgtcccagggtttcctgtcataacataggagccccagccatttccagagtggcagcctctgttccctgttcagcattatgcccagaaataagccccttttcctcacctggtggagaaacgggggcctgtgttagcagaggacgggcagagccatgctgctgtctgtatggggagacctcacagggaggtgctcccagtccagccactcattctcagacctgccttgtggctgtgcttaggtagcgtgggatgtgtgtgtttgtaagtctcatgctaagactcctccaggcctgggctctccagggccacacctcactctgccgccagaccagcactgcacttgagagccaagtgccctctcctgagcccccaagccctggcaccagttcttgccgtgccccttccccagggtgtgtggtggaggtccagtgggaggggccagagggccaaggagcagattgaccaattggtgcacctcttttccaacctcccaggtttcagaagcttctccctgacatccgtggagctgcagatgctgaccaactcgtgtgtgaaactccagactgtccacagcattccgctgaccatcaataaggaaggtgggcccccccgtttccgtgtacagggcacctgcagggagggcaggcagctagcctgaaggctgatccccccttcctgttagcacttttgatgggactagtggactttggttcagaaggaagagctatgcttgttagggcctcttgtctcctcccaggagtggacaaggtgggttaggagcagtttctccctgagtggctgctgctgggtggttgaggagatgcacggcttctgttcctagtcacaaggctgcagcagacgctcctcagatgctctgtgccttggatctggccccactcccgtcctcccagccctcctctcctccagctacctgccagccggcacttttggtcaagctgttttgcattcactgttgcacatatgctcagtcacacacacagcatacgctatgcacatgtgtccacacacaccccacccacatcccacatcaccccgaccccctctgctgtccttggaaccttattacacttcgagtcactggtttgcctgtattgtgaaaccagctggatcctgagatccccaagacagaaatcatgatgagtatgtttttggcccatgacactggcttaccttgtgccaggcagatggcagccacacagtgtccaccggatggttgattttgaagcagagttagcttgtcacctgcctccctttcccgggacaacagaagctgacctctttgatctcttgcgcagatgatgagtctccggggctctatgggtttctgaatgtcatcgtccactcagccactggatttaagcagagttcaagtaagtactggtttggggaggagggttgcagcggccgagccagggtctccacccaggaaggactcatcgggcagggtgtggggaaacagggaggttgttcagatgaccacgggacacctttgaccctggccgctgtggagtgtttgtgctggttgatgccttctgggtgtggaattgtttttcccggagtggcctctgccctctcccctagcctgtctcagatcctgggagctggtgagctgccccctgcaggtggatcgagtaattgcaggggtttggcaaggactttgacagacatccccaggggtgcccgggagtgtggggtccaagccaggagggctgtcagcagtgcaccttcaccccacagcagagcagatttggctgctctgtcgagctggatggatactactttttttttcctttccctctaagtgggggtctcccccagctactggagctgtcagaacagtgaaggctggtaacacatgagttgcactgtgtaagtttctcgaggccgggcgcagtggctcatgcctgtaatcccagcactttgggaggctgaggcaggtggatcgcttgagctcaggagttggagaccagcctgaccaacatggtgaaaccctgtgtctactaaaaatacaaagattagccgggctaggcagtgggcacctgtaatcacaactgcttgggaggctgagggaagagaatcgcttgaacccaggaggcggaggttgcagtgagccgagcttgtgccactgcattccagcctgggcgacagagcaagactccgcctcaaaaaaaaaaaaaaaaagttcctagaaacagcaaaatgtggagacagaaagcttaccagggattgttggggaatggggttgggagagaggactaactgcagatgaacccaagggggactttttaggtgagagcagtgtcgtgaaaagactgtggtgctgtttgcgctcacatttacatttcctaaaattctttaaaccctacacttggaatggatgaattacatgacatgcagattgcaccttcataacataatctttctcctgggcccctgtctctggctgcctcataaacgctggtgtttccctcgtgggcctccctgcatccctgcatctcctcccgggtcctgtctgtgagcaatacagcgtgacaccctacgctgccccgtggtcccgggcttgtctctccttgcctccctgttacctttctttctatctcttccttgccccgtgcactcaaccttgcatccccaaaccaaacctattattcatggaccccaaacttgttcctcttatgtcctgtccctttgaggggcaccaccatccacccgcatggccaagccagaaaccgtggtctgctctccctccgttaaatgccattctccatcagtgaggcttcttagtcatctctggctgcctggccaggccctggctgtggcctcctccctggtctttgtagctctggatatccctgcagaaagggtccccactaccaggcctctccatccccagtctcaggtagtttttctaaaatgcaaaccccaccctgcaacttaccgcccacagcccagcccactcttctccaggcctcgcctccctcccttccccctgcaccccacgacttctccagcactgagctgcttcctgtgccccacagtggcctggagtcccctttgccttaactctttgccccatagtacagcggggtctgctctgattgtaggggcttcccacatcccccaggatggctgccctctgctgtggcatcactgtgtaacaatggcgtgtacacctctctgtccccaccagtgcagggcccttctcatcgtaggggctttagctggggtttgtggatcgactgagtgaacgaatgttgtgggaagtcccgtttcccagccgcacccagggaaattccacagagcgggcaggggcatcgcatgaggtgctggtgttcacgccagaccacaattaggtgtttaatttttaaaaagaaagttacaaccttttttttttatttttattttttctgattctgcaaataacacctgctcttacagaccatgtgggtgatgtggaaaagacctgtgaccttctccatgtccacttctccccacagatctgtactgcaccctggaggtggattcctttgggtattttgtgaataaagcaaagacgcgcgtctacagggacacagctgagccaaactggaacgaggtgaggaactgattccacaagggcccagcctgccaggtggggcacaggatattttccactggagataatctaaaccttcaggggctccctgagggcttcccccgaaggcagtgctgctgaattccaggaatctcctggggggccagtaggtgacgtgtccaagagattttatctccttgttcctgaaaaccttacccatccctgtcatcacaaagaagccacctattttgctggagaagtgtttggaaagagacttaaaaaggctttttgtctgcctttgttagcgcttatgtttacttggtaggtttccatagtgtttttccgcagaagttggaatgagctcccgtgaccctcttggcttccggaagcctggggctctgctggtggggctgggacagggactgtagggtcctgcttgcttgtctcggggtgttgggtttgtattgtgtgtcgccgtgccttcctccaccttggagagctgctgtgtgagtcacttagccatttggccctgcaccttcgggagtaggggaatgattgcagagaggcccgtattgactaagtcccagatccatgagaggtgccatttcccagcttctgcagcagctgtgacctcgaaggtctcattcttgatgctgcaggtagaggccagctgggcctgcagagagctgcctcccacccctgctcctgcgaaggaggaagccaagagcccccaggctgcttggtctacacgggtcacgaggctggtggatggagcagtggggctggaacccaggtctcctttctcagcatccactactctttgatcattttagacatgttgcttgaatagtacaagggcacaaggagctcagtaaaataacctggtcattgtagctctggacatccctgcagaaagggctgagtggcagctgtgatgagagggggtataagagccacaggggatccatcgaagaagcctttgcagagaccaagagtgccacgacccagcagagacaacaagagagggtgccaggcagtgtgcaaaaggttcaggtgccaggcagccacggaagctccggggaggcatgaagacatgagggttagattgtagcaggtcacgtccaccaccctcactgtccatgaagatctggacttggggacactcacatgttcctggcgcacacacacacccaccccctcccctattcaggttcagaaattcctgctgcttgcttcttcccgcaccctcctccatttccccgccaagaagccatgcgcgcacacgcctcggtgtgaagcgcagattcaccaacagcaccgtcagggtgatggaggagagagttaacaccacgcacccacggcagacaactggagagctcggggagcagtttttcctccaagtccctctccctcctgtatcaaccccaaggatcactcttttgtttccttttagatataattcattttttaaagagcggttttaggtttgcagcaaaatggagcagaaagaacagagttcccatgtacctcctgccccccatctcaattatggacatcccactccagggtgggacatgagttacagttgatgagcctgcattaacccatcattaccacccagagttcatagttgatgttaggtagggttcattcttggtgttacacatgttatgtgttctgacaaacgtggaatgacgtgtatccaccataataatatcttacagaatagtctcaccgccataaaagtgaacctgcatcgacagatcattatctttcagagtccatagaaatatctttttttgagggagagtctcacactgttggccagcctggaatgcagtggcatgatcttggcttactgcagcctccgcctcccggattcaagcaattctcgtgcctcagccttacaagtagctgggatcacaggcatgcaccaccacgccatactatttttcgtatttttagtaggatggggtttcgccatgttggctagttagtctcgtactcctggtctcaagtgatctgcccaccttggcctcccaaagtactgggattacaggtgtgagccaccgtgcccagcccatagaaatatcttaacaagtaccctggcgattgtgaggcaggtggtgtggggatcaccctttgagatgctggtgtaaggagtttggattaagtttgaaaggcagtcggagcttctggaagcatccgggctgggccacggtctcatgccaggggtgcttacaaggaatacttccatgtgtcccaggactaagggaggagggtctcaggcattggtccctctgggccagcaagggcagcagggagagccccggttcagaggacccttcagccataacattgacccgtttgttcacactggacttcccttctcccttggggctgcaggaatttgagatagagctggagggctcccagaccctgaggatactgtgctatgaaaagtgttacaacaagacgaagatccccaaggaggacggcgagagcacggacagactcatggggaagggccaggtccaggtgaggcagccatccctaccctcccctgcccgatgcatggcgtcctttttcatgcagcccctggggacactgagatggtcatggccttgcacccagggtggggtggggtgggcagctgtggctctgaaacatccatcgtgggagacctgagccggtgcctgcatgtatcttgatgggtcttgacgtaccaccctctgtctgcgtgtctgttgcgtcggctcattcccaaaggaatttccattcaacttggttttgcagctggggcctcagttcctgcccggccttaggagaacccaaggtggaacagttagatggtgtcctaggctgaaattggcccatcctgtgccagtcttcttagaaaagcacaggggtcccagaggctgcctgcaagcacaggggtcccagaggctgcctgcttggcatcccctatctgtggtctagacccaatttctagggtatagagctgtatctctgaacagggtgcacacagacaggtctcctcccaggctaatctggaagcccccaggtgagaccgagaatgtgtccatacaggaccagcaagggggccctggttcttaaggagactgcctgggccctctgtccttcagaagcttgtctagcccctgggagcacgccaccagggtttcctggaggatcatagctggcgccccaggccctgtttatcctgttcccaccctcacaattgcgcgggggtagctgagaggaagccctgatcgtgctttccttatagtgcattatatcagtgggttgtgggtacagctctctcttcccaggaccttccatcttcacaagaggcctctagagggagtgggtttggctttccacatgcccctagaagcacagggctcctcaggaagcccagtctccctccctaagcaggaagtaaaaatcctcttgtggttaaataccaagtgccaggctgggcgtggtgctcacgcctgtaatcccagcactttgggaggccgaggtgggcggatcacgaggtcaggagatcgagaccatcctggctaacaccgtgaaaccccgtctctactaaaaatacaaaaaattagccaggcgtggtggcgggtgcctgtagtcccagctactcgggaggccgaggcaggagaatggcatgaacctgggaggcggagcttgcaatgagtcaagatcacaccgctgatctctagcctgggtgacagagcgagagtccgtctcaaaaaaaaaaaaaaaaaaaaaaataccaagtgccaggaagaatgaagggagagggtggctcttccctgagtcacctgtcatctttgctgatggatcccacattctcattcagatcagcaaatctttaccaagtgctggcctcacccccttctgccaccctggcctggctggccacatcttcggaggtgcagctactgcctgtttttctgccttggaagcttataagggaactcagtggctcagagcctcctggggctccctatactttgagatcaggtttaaaagcaaaaagactcctctggcacatgcctgtattccagctactcaggacgctgaagcgagaggattgcttgagcccagctattcaagaccagcctgggcaacatagacccctgtctaaaacaaaataaattaactaaaaattgctctcagctctcctgtcgctgtcccactgcactgtcttgttcactctgccagcctttgtgtggattctcatggtgggagattgtaccacacagatgggccacaccactcttgatggagtacttagtgctggtctcctttgagatccgaagtattttagcatcagtcaaatgacggtcatagtttgggtgatggtcacggctcaggttcttttttacacgtgcttgctttggttgttgttgttgttctttgttttcttgaggcagtatctggctgtgtctcccaggctggcgtgcaatggcaggatcatagctcactgcaacctcaaactcctggctgaagcaatctttgtgccctagcctcccaagttgttgggattacagtcgtgccccaccatgcctggctaagttgttttttgttttttgttttttttttttttttcgagacagagttttgctcttgttgcccaggccggagtgcagtggtgtgatcttggctctctgcaacctcccgggttcaagcgattctcctgcctcagcctcccaaagtgatgggattacaggcctgagccactgtgcctggccacatgtgctttcccattcggtccttgcagcagatctttgagagagctcatttgacactcaggagatgcttctctaacctgctcagaatcagggccctgggtattcagggaggtagagggagcagactgcaaagccagtcgtgctcccatcgctcccacttctctctccctctccatgttttctgtctcccccacccagcctagggcattcctcccccacagtccagcctgcatctggcacagtgtcactgctcagcccagggatactcacagcctgggtgcctggctccttttttcagctcatcaaaccaggtaaagggaggttcagattctgccaaccattgactcaattcatccaaatcttcaatcactggaatcctgggagtggctggatttgaaccaggacctctgagtactattgctaagtaactgggggtctcagtgaaagagagaaaagagctgataggcctcttcctgtgttatcatgtcaggccatcttttgaaactcttttctgcaatgctactgaagtatttatgcacgtgacctgtgctcttctgtcagtctaggggtgctggctgagcaccccaccccatcccggggaagaggagagcagtaagtgtcgaagaaaaacccgagctggacagcagttaaagtggtaaaagcaggttttgtttagtaactattgtgatagggaaaagactagaaatggaaggcctagaaatgggctcaatgctgaagtcacttggatgagtggggacttgcagccaagaagcagggtaggggttgatggatggaaaatgatgaagtaacatcagggggaagagggattctggtgaaaccgacccgacaggattcttgctgaagacaggccaaagtgatcgatctcccccgggggatggcgtggggtgaggaatctgatcagatagcaagggcagggggttctggctaaacggacttagcaggattcttgcaaaatttgggctcctgagaacatgcccaaggatgggatctagctggaataaaaagctggagggaccagatgagttccgtcaaggagagtctttgtcacacccccaccacactcagtgtgacctgggtgaattactgtcccactggcccaaatgtgtttcctcacttttccttcccttccttccttcccttccttcccttccttccttttctttctttcttcctttcctttttcctttttcctttccttttgcctttccttcttcttcggagtctcactgtcttgcccaggctggagtgcagcggtgccatctcagcttactgcaacctctgcctcccgggttcaagcgattctgctgccgcagcctcctgaatagctgttattacaggcatgtgccaccacgcctggctaatttttttgtatttttagtagagacggggtttcaccatgttggccaggctggtctcgaactcctgacctccagtggtccacccgccttggcctcccaaagtgctgggattataggcgtgagctactgcacccagcctcctcacctttaaatcttccccaaatatttgttcaaaacaaacatcactcattttgtgttcctgctgcaacagaccccctggggcctgcccctctccaaggctgttttttgttttttgagacagagtctggctctgtcgcccaggctggagtgcagtggcatgatctcggctcactgcaagctccgcctcctgggttcacgccattctcctgcctcagcctcccgagtagccgggactacaggcgcccgccaccacacccagctaatttcttgtatttttagtagagatggggtttcaccgtggtctcgatctcctgacctcatgatccgccctcctcagcctcccaaagtgctgggattacaggcgtgagccaccacgcctagctccaagactgtttaggggctacgtaagtttctctcctatgggcgcctctgccacatggaccatgtctcattcgtctcggaatgccccccaggcacatcacagacccccctgcacgggtgaatggctgtgtggacgagacctacatggccctgagataatccttgaaatacaaatgaggattctcgatgccttcgtggccttacctgaccatacctcccccaactcccatcacgtcccccgtgacgtgatctttattttggcttatgtttgtctctgctgctggaaagtaaacgtggaggacagggctttgtccagttcattctctgtggtatctccagtatccagacagagacataaaacatacatctgtatctgtaagttatttaatacattgtttaatggatctagagtttatatatatatatatatatatatagtaaaatatatattggcacaaagcaagtactgttacatgcactggaaattgctgagccaggcacctgccctctcacagatgaaggtgctgaagttcccaggggtggctggggcgggagccagccaagcctggggcttctccaccacgctgtgcatgtgcccagtggtggtcggggccttcatggtgagggggtcggggagttcagagtttggactcccacgtgcatccctgcaccatgggcagcctttttatcttagccagaaggctgagaagtaattccttcctttttaaaaaaattgtaaaataagcacaatgtaaaatgtcccaggtgtttttaagtgtgcagttcagtggcatcaggcacattcacattgttgtgcagccatcaccaccatcatctccagaacttttttttcatcctctcaaactgaaactctacacccattaaacaataactcccaggggggcaggtgcaaaaagaataactccccattcctcctgcccccagctcctgttaacctctagtccactttctgcctctgtggatttgcctactctagctacctcatgtaagtggaatcatacagcatttgtcttttgggtctggtttatttcacttagcagcatgtcctcaaggctcacccatgttgtagaatgtgtcagaatgtccttcctcttgaaggctgagtaatattccattgtatggattaacagacattcaccagcaggtggacgcctgggttctttccagtctgaggctggcatggtcagtgctgttgtgcacatggacataagatccacccaacttggtgttatctttgcattcgcaagctgttgccaggcacatccatgggctctcggggggaacagctgctgcagagtgggcagtccaacagggagaccgcccgaaaatgggtggacctcactgcgtggtggggacttgagagcagctgccagggtgccaccaggagggccccagtcagacctgctggcttgtacctggtcaggtgcccacataacccaggctggcagagaagtctgggaaactccagccagccagccagagcaccagcttcaaatgaagcagaggctcacagtccaaatctcatccccgaggctcacataaaacattggcaacaacaaaaatgaactctgatgcccccactggaacatgagttgtgagcccagcaagacacataaatagagcaggagaaatgggagaagacaaaagtctatgacttgatagaatgttgccctctaaggagaatagacagggctaacatgatttagcaacctagaaaatttgcagatgaagagagatgcacctgtcatcctagcactttgtgaggctgaggagggcggatcatttgacatcaggagttcaagaccggcctgaccaacatggtgaaaccccgtctctactaaaaacacaaaaaaattagccaggcgcgatggcgcatgcctgtagtcccagctactcgggaagccaaggtaggagaattgcttgaaccagggaggcagggatttcagtgagccagggtcgtgccactgcactccagcctgggggacagagcgagactatctcaaaaaagacagaaaaaacctgaagaaattcctaatggcagcaaggctccaatttccccagctctgccaactgtggtgactccctctctggcccaggatgtgcaggagcactgggactgtgtctcagggcccccgtccctgttgcgctgcactcggctaggctgcagactagccctccagcaatgtgtcccataccccgtcccatgaatcttggatggatgttgatgccttcaccttgaaaaatccctccctgaagatacagattcaatgtcccctgctctgtgaaggcttctctgtcccgtgacctcacttcccaagtaaccgtgccatctgagccaccagtcaatctgggccaaagcctgccctggctcttggcacatttgccacatccttcctttccagcttctctgatctagaccatgaaggctggggagaggggtcttcttgttcttggggacccccccgccaggcatggcacacaggaagccttccatgactagggtggcacagcgggttcctggtgtctgaggatggaccaggatggcctcgctcactcaaatggctcattcaggctcggggctggcttggaagggacacccgacttgggtcctcttgcacctgcccacacacaaggacttcaatttgtgctgtcagtggctcttttctggactgtgggcaccaccacagctttgtccctgctgtactgtgtatccccttgcctttctggcttgtggctctgaacaaagcaggtcacccatcccaatttctagagcccccccaccgccacccccaccctcatggagcctctatcgtgcaagaagggaggtggggacctggcaagtcatccaggacaggcatttgaagagcaggagccaaaatctgagactcgggcaagtggttcctaaacccagctcatcagcaccattaaggggagcaaaaaaccagaccgggccaagcccccagcccagaagatcccgactcctgctgcccacagacaggcacatgagcagctttgctgaggactcctttccatcccagacccctgcccttggggcctgccagggacctctgccctcatggttggatctggacactcccgggatgctgcggcttctctacctgctgcaactgcctcacctcacgggagggtctctctacgcaacttctgagtcgaggtgcataagcagtgtgggggctgtaggcccctgtagctggctgcagagagccaagcgcctcccacacggtacagcacagaaggctcctggtgtcactgggaaaagcccagattcaaaaaggctgggctccggagtcatgcacatcctctctcaggtatccctgtgcagaaaacagtgtccacgggggagaaagaggccaggctggtgtcgcagagcgccaatggcatagtcaccaccactcctccgacttacttcctcctgggatcccacaaacaagccccccagctgggagcctggacctccagggaccagggcagccgccacctacttggcgtgagtcatgaatgcccttcacacagcaatcagattccttcctgtctagccatggttcccacccatcactcccactgacacagggaccaggggctggagccagatagtgcctgctccatcgcctcctcacaaacgacagataaggatgagaacagcagcaaacgctgaccccccacccgtgagagcataagtcactcaaccgtcaaggctgcatggccccccccaccccaatttaattcacctgtgagagggcaagtgcctggctcagcaatttctagtgcatgtaacagtacttgctttgtgccaatatgtattttactatatatatataaactctagatccattaaacaatgtattattacataacttatagaggtatgttttatgtctctgtctgggtactggagataccacagagaatgaactggacaaagccctgtcctccacgtttactttccagcagcagagacaaacataagccaaaataaagatcacgtcacaggggacgtgatgggagtcggaggaggtatggtcaggtaaggcggataccgtcatgaaggcaccaagaatcctcatttgtatttcaaggattatctgagggccacgtaggtcttgtccacacagccattcacccattcaggggggtctctgatgtgcctggggggcattccgagatgaatgagacatgcatggtccatgtggcagaggcaccaataggagagaaacttatgtatgtagcctcttaaacagacttggagaggggcaggccccagggggtctcttgcagcaggaacacaaaatgagtgatgtttgttttgaaccaatatttggggaagatatgaagatgtaaacatcatgaaaatgtaagatcacatgagcaaattcttacacagattccacgggattcttcttgaagcacaccgccatcaacatggatagtgatacaggtcctccttgctctattgagagccacttttggaccctttatttttaacttttgtaccatgaaatgcatccatttttataaccgaatgattttatagtaaatttacagagctgtacaacttttaccaacaatccagttttagaatatttctatcaccccaatttccttgttgcctttttttttttttttttttttaagacagggtcttgctctgttgcccaggttggagtacagtggtgcaaccacactcagcacaaccttgatgtcccaggctcaagtgctcttcctaccttagcctctcaagtagctgggaccacaggcatgcgccaccatgccaggctattttttttttttttttttttttttgagacaaggtcttgttttgctgcccaagctggtctcaaattcctaggctcaagtgatcctcctgccttggcctcccaaagtgctgagattacaggtgtgaaccaccgtgcccagcccctgttcccagttatagccactcccagacccaagccgatctgctttttgtctttagagatttgcccattcttcacatttcataaacgtggaatcatactagagtgggcttttttgactgatttcctccacttaccattatgtttttgaggtttattcatgtggtagcattgtttggttcctttttatgataataattttccattgcatacatataacatgtttttatttctgcatttactatttgacagacacttggatcatttctagtttgggctgttaaggttgatgcagccacgaacatgtccttggtaccagtctctatatggacgtatgttttcattcactgagtaaacacctagtaagattgctgggctgtgcaacaaggtgactatttggggaactgccctacgttgtctggagtagctgcaccatcttacatccccagtggccatgtatgaaagcccatttctctacatcctcaccgatgctggttatagtgtatcctaagggagaagggtgtgttccttttgaagtgatgttagagactggttgggatcagagaagagaagcaaagagttaaaagtgggatagaggccaggcgcggtggcttacgcctgtaatcccagcactttaggaggccaagttgggtggattgctttaggtcaggagttcaagaccagcctgaccaacatggtgaaacctcgtctctactaaaaatacaaaaattaaccgggcatggtggcaggtgcctgtaatcccagctcctcaggggctgaggcaagagaatggtttgaagccaggaggcagaggttgcagtcagccgagatctcgccactgcactccagcctgggcaacagagtgagactccgccttaaaaaaaaaaaaaaaaaggtgcaggatggatctcaggagagcagattgtggtcatagactacagcaggaggcctgtaatctctctcctggtgaacacagaggttctctggtggtctcagcaaagacccacccccgggagtaggttatagtgcagacacatggggcccagacaggaacaactggggttgccctgctggaccatccaggctggtgacgatgggcgtgaaggaagctgttgtctacaaggagctaagtgaacaagcatttcctcctttggaaggtttactcatagccccctccctgcccctgctgagggtgggtgagaggatgtcctccggctgcccattggtgactcaatccagccacactgactacaaagcaagcagggcagtgctgggcccccagcagagccaccatgcaaagtggtcagtgatgcttcagggcagcacacagcacctgccccagttgggcttcggcctccctcagcccccaccccaccacttccctgggatggatgtgcacgatagttttctaggcagacctctaggccaccatctgccaggcccgctgaccatagtcattctttcaaggctcctgccttacccagtccagggggagaggagcagcaacctggtccatcctcctgagaccactgcatgtgagcagacagacccctgcctgcccagtccccggccaggcagcaggcatgttcctcaccaagaccttgcaacccagggggaccctggacagcatccggagtgcctcggtttttcccttaagggaaaactgtttcccccttggtcatctgtttttccaaaccccagtcttttgcttgtttacttctctggtgctttaaataactgcacgagagagcgtaccagccttgagcaatgtttgggattggctgagctgaggcacaggcctcattatcatgctattctttatacggcttccgctctgcggcgcacactctgttctttggaacagagccagccttgggacagcctttcccactggagctgccagtcaggaccgccgtgagagccagtgcctggaggccaacaccctggtcttcagtcactgggagtcacagagaggggcccgataaagagccctcctggcagcatcagtaccaggttggagtgggcgctggacaccaccaatgctggggagtggacgctggctggagccccacccagggctgcacattgctcagccagctagctctgggggagcaggacctgagcagggtgtcctccaccctgggtccatcagaggcactgcatttgattattggggttacctgctgggagtggtgcagattttggacagtctggattgcttccagcacaaggcaggctgaccagtcatactttactcagtctccaaacttgggcaacaggaaactagccacttgagaaggaagctcagcttttctgggctttagaggagatggagacacgttggaaattcccgtaaccaataggctggggtgggagggtgttcttcccacacacacacaaaaaagtggaacccggaggtgatgggaagctttgaccttggccagccagactgcggggtggggtttccctcaaagcctggtcaaaaggccttggaggctggaagctctcgtttagccccaccagcttcccagagcagcaaggccaagcatgcaagagtcaccatccaccctggccatgatgcagggcctcctttggtacttccaccccagccgggcgggccggagccgggcggcctctgctgaaaagcacctgtgggccgtggttccaggggggctttgaggggcagccgctgatgtctggacagcttctctttctgtctcttcttacctggactctgggttgcttgttagctgcttctgcctgttctgggttttcaaggggagaggggcccagtgatggctgttctttgaaggaaaggtaagaatgtctcctgcttaacatgtttctgtgtttccagttacttggttggttagtagagccagggtctctcgctttgttgcgcaggctggagtgcaatggcatgatcatggctcacagcagtctccaccttctagcctcaagtgttgcccccacctcagcctcccgagcagttgggactgcaggcacatgccaccatgcttggctaatgcttttgaaaattttttttttatagagacagggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccgcatggcccccggtgggagacgtcccgccgccctttgcttctctgtgccactctggctgcacagttcagagccttgggaaacgttaaccagtaggacctagaaggggaggtgagaaggggtcaacccccaggtgtgcctgtggtgagccttcgtgctgagcaggtgcagggagggaggcccaggtgcacacacctgtgaagtaggggggcagctggctgggctccttgacctgctccagagcttcttattttctggccacttcacctgcagaaggcccaggtggctgtagccgctagggtcccttgcagtggaaatgatgcctgtcctcagcccctctctaggcctggcactgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgtaaatcccaggtcccactcagattatgagtcagttctctgcaggtggaacccagggaggtgttttttttgtttttgcttttatttttgagacgaagtcttgctgtgtcgcccaggctggagtgcagtggcgccatcttggctcactgcaacctccacctcctgagttcacaccattctcctgcctcagcctcccaagtagctgggactacagacgcccaccaccacgcccagctaatttgttgtatttttagtagggacagggtttcaccatgttagccaggatggtctcaacctcccgacctcgtgatccgcccacctcagcctctcaaagtgctgggattacaggcgtgagccaccgcacctggccagggaggtgtatttttaacaagatggtactgctcattcacccagcccagccagtgatcttggcatacccaggaaccgctgacatagaacgtgctccccataaaacgggagacagaggcttcacggatgggggacatgtggcttggtcatgacagggtgttacataccaggacagactgtgttcgggtgacattaaggacaagctcctgcaggctagctgtctggatagtgccgggtgggggtagaagttagaggggtcacagaggggcttcctcccggccccctcatcagctgcttgatttagggcttgtttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcacctttcactgagctccacatagcacccgtggtgatggaagccggatggagagagcctgccagcctgcacatcagctcccaactgggcggggcagagggaggagggggtggggaccccaggcagcagggctctgggagcagtggggccctgggttccaggggtgtctggcaggcccctccttactctacctctgttggcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccgcaggccctgcaggacagagactggcagcgcaccgtcatcgccatgaatggggtacgtgtccgtgggactctcctggtgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttagaccttaaaagcaatgacacacccaaaaaggcccgggtataaatggtaaaatgttaatatttgagattcttggctttttcttacattattctgtctttcctacttaatttttaattgttactaagaaagagaaagccaggcacagtgcacctatagtctcagctactctggagtctgaggcaggagaatcactggaacccaagagttcgattacagcctgggcaacattgcaagctcctatatctaaaaaaaagcaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccctactgtagatcgaagtaaagctctcggtcaagttcaacagcagggagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccacctggcttggaagcagtaggctggctccaggaactgcccaagtgcagggttttctgcccttgcttggaatttatcacggtcccagattcctgttgaatggccgtaacccctgcccctttgtcacgagtcagttgccaagagaagcctgtttggtttgagagcagttcatgcagacatagaccacttcctctgagaattcatttgcttccccaggatggaatctggctgggcctctgaccttgctggtcacgtgggccggggcctccatcagtcataccctggactcctatctgtgtctaaacaccacgccccacccccaactgcacggcagccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagccgggggtacaggctgctaaccccaggcctggaatctgtcagatgcccttcccgtgctgacttgacatagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcagatatggagcaggtctcctgtgttatggcccaagcagggctgttaggacactgagaacattccctcctcccgcaggagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcagtgagtgttggcctgcgcaggacgggatggaggtgtgggcaatggtgtccgcgatgagatctcagagtgctccatggcccaggcatgtcacatccttctctgtgtcttttcttcatttactgtgttattatttttaaaaaagagaagacaagagttgtagaaaaagcctctgtagaaaccagtttttaaaccatcctagccatgcatgccacttgctggggtaggccaggggtttctgcagggccttggccttcctgccttggggttggacaggaggtggaagcccaggactcagtgcagtctgtcccctgccatgtgtgaggatgcggcaggcagagggcactgatgaaattcagcccaggctggggctgcagcatctctgcctccatctcaccaaccctcacaggctatgaaggacctggaactgtcacaaatgccaggggagggcactgagaccccagagggtccctcccagcatcttcaacaggattttgtgcctgcagacccttctttggggcacacaccaccaaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccacgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagcatggcagggacagtgctttagccaaggcagggatggtgggagactcactcgggatcctcaaggaggccgctgcatttccgtgctctttccagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcggtgagcactggaggccttggcctcatgggagacgtctcctccacgtgcactgctgcccttggaggctgtgaaaagtgaggtgtgggaacccaagctgtgccccctctgccatggtcggcattttaacccaacctcaaaaagcaggggaccagaaccgagcctgtcctggaaggccttgcccatccctagagggctccctgtccctactcctcaaggagaccaagaggctgaaatagtcagcactgctgtgctgtggggtcctaaagtctgctgtcctccttcctgcagaccagggctgaaggagggtgcctgggtgctcttgccatgggtcctggtccagccaagcatggtttcaaacatgacctgacccttagtcaacctggaggctgatgtctagagtgggtgctggtgtgtgcagtacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgttcctcactcccctgtttcattccatgctgagcctcccctgccttgggctcctctggggagggggtggtggcaggagttgtccaagggcagctctgcccatgagcagctgctctagcggctcctcctgctgctgtttgccgggtgctgctgacccctgcgaggtagagaaaaggcgttcaggtggttcacaccccacacaggtgcccctcacagggtcctcaatgggggccagagctgtgagactgaggatgatgacgagcctgggctgtgcagggacacaagccccaggtgctccatgtgaacacctcgggagaggtctctggctcgttgtgaccccaaggagtaacccaccgccttctgcagctctttcagacccggttgcaaaggagagctgcatgctcaacctgctgctgtccctgccggaggccaacctgctcaccttccttttccttctggaccacctgaaaaggtagcccagctctcccatggcagcccagggctccaggtccccaggccgcagagtgcccctctgctcccactagacccccaacaccgaggaccttttctcctgacccttgtctgcagtcactcactgcctttggcgactagtgccactgccacccctgccccagcctctcttctttgccaccctcctctctctgcactgtggccttaaaaaagagctcagagctttggccgtggccagcagtgcacttggacccccctcttccctccgagtcacatcaagtaggagacctccccaccagcccagagctggctccttgtcctgggccactgagacccagaagtaccagggctggagtcagcttgcagcacagccagggtcgaggtcactcccttcctgagaactccagcacagcccagcccctctgcctctctcctgggggtggcgttgaaacagcacccgctgctttggtcctctacagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtatgggaagacaggctccagcccatgcaaccctgacctgacagaggtggcctctgcctgccccacccccagtcctgcccatcttcttacttgcattgtatgtggtgtggccaacattcacagagagggacttgcctaggtctgcatggatgggagtgatagtgggggcccaggccacctcctggtcctgctagtgcactttgctggaagcttaaaactacctcaagtgttcgggtgtggtggctcatgcctgtaatcccagcactttgggaggccaaggcaggataaccaatcccaggtgtttgaaaccagtctgggcaatgtggcaaaccccatctctagaaaaaataaaaagaaaaattagccaggcattgtggcacacatctgtaatcctaggtatctgggaggctgacacaggaggatttcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccatctcactgtaaggggttcatgacaccagcaggggtccccagcacctgagatggacttggaggcttgggccccaaagacctcccaccagcagctgtgagccccgctctgagccactcttctcttccctactctgcccgggcaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttctttttctttccagaaggatttttgtgcagaaatgggtcttttgttgccatgttagtcctccttggaaggcagctcagaaggcctgtgaaatgtcaggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacacctgcgggggagcccaggcattctttgtaaaccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccacacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccacctcctgcctcaacagcctgtgtggtggcaaagccggtgtggggctggggaacgcagcgttctccaggagggggacctggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacga

SEQ ID NO: 104 - DNA, 19020 bp, Homo sapiens
gctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggtgagtcagctcgcccactctgtccgaccctcccggtcacccaaccccgtgctggcacatcccgaggccagggccgcgagggcacagcgtccgcgcccacttcccgcccctataacttgaaagcggcctgcggccccggggcgtcctcatttccggagcgcaaactctgggccaggcccgcgctggttgtggaggagagccaggtcagatgcgggaagacaaccggactccgccaggaccaccccagcccagcctggagaggagtccggacagaaaaaggagacagaggggctgttgaggaggctcgaggagtcagaggcctggtgaagtgagggttttcagggaaaaggcctagttggctgaaagttaaggcccccaggcccacctagagccttcgtcctttgcagactgggagcaggagacccctccccactctacttccactgcctgagctgtgccatgcctcacagcccagtaaggtaagctcagaggggagctcctccttggtagacacctgtcaaggggagacccaggtcttctgactcccaggcagggtggggcaggcctggttcccccataccatgctgcctgctgtatgcagattgagagaaatggcctctgccccatattcctgacagagagggaagcctggatctggttttatttataattcttgagacaaggtcttactctatcacccaggctggagtgcagtggcaccttcacggttcactgcacccttgacctcccaggctcaagcattcctcccaccttcctcccaagtagctgggactgcaggcacaggccaccatgccctgctaatttttttggtttttttttgtagagactgaggtttcactttgttgcccaggctggtctcaacctcctgggcccaagtgatcctcccaccttggcctcccaaagtgctgggattacaggcatgagccactgcacccagcctggatctgatgaaaagttaggtggaaactcatgggtgaatccccaggtatttgcacagctccttaactgtctttctcctggttgggtccacaggactgtggaagaatgaggtcctccctgacacctttggggccccctgtgagccgcgaccgtgtcatcgccagcttccctaaggtagagagtcattacgtctgcagtgctctcctggccctgcagccacatcagctctccccactctacactcatgcctagaagtaaagcaggtgaatcaaggaggtctgtccattgtcagatttaccttgaggagctgggagactggtcactgactgcccaaggtgggaccgcaagttaatggtgacactgggcagcagtgtggcctggaggttataagggctgggattttgcagccagacagtccttgatgtgaatccttcattctgattctgtcattaagctgtgtggctgtgggcaaattactcaacctctcagagccactgttacatgaaggtaattcctctcatattgggtgcctggctcatggtatgcaggagctcccctgcagtcatagttgctgttgttctcatcatcgttgttgttatcaaaacagcattccagttccatgaccccaaatccagggctctctcctcttgccattccgcctctatgagcttgaaaactcacagctctcttgtgtctgtattaaaatccaatattaattgcagcagggaatacaaattgagtacaacctccatagggggcagtggacaatatttaccaatatagaagatgaccctgccctctaagatccagccattctgtttcttttttcttttttttttagagacaggatcttgctctgtcacccaggctggagtgcaatggtgccatcataattcactcctctaactcctgggctgaagcaatccttctgcctcagcctcccggagtagctaggaccacaggcatgtgctaccatgcctggctaatttttaattttttttaatagagatgaagtcttgctatgttgcccaggctggtcttgaacccctggcctcaagcaatcctcccacccgggcctctcaaagcactgggattataggtgtggaccaccacaactggccttgctattctatttctaggaatttacttggcagatattctggcatgggtttacaatgtgcataaggataggggttggagcagtttgtaagaatagaagataagatacaacgtaaacatcctcggagaggggactggttaaacaagtaatgcttcctggcacagacatgaggaagaatgaggcaacctcttcaggagctgacatgcaacgagagccaaagtaaaccgttaagtaaaaatgcagggcatggaacagagtgcagtagagtgtgtgcagcacactccggtgtgtgaaaacaaggagagggagaaatgtctatttgtttatatatgcagaaaatatttctggcaggatatataagcccctactctcagtggttgcctctgtggcttcggacaggtgcagagggatagatcctctccatggaatggccttttttgcatcttggattctgtggccaggctggtgaggaggaggtgactctagacaggtcctgggtatttggagtatgtggctcttcctccttcccccttctttaccttcctccctaagttccttcttcacacacctacagagaaaggctttgtgtctcagacctgtggacagttccccatgggttttccatctcaacagaggctcaggcaattattctctctgcagagcttgacagtggtaactagggatgacagagactggtctttcttgagtcaaaaggaaggaaagtgtgattggcacaaaacagtccaggtatcatgagatgaagaacctcattggcagagcagacggcgaggatcagagttaaggagggttgcctgacatcacacagctgctcctggtacctctgggatttgacctggccgtgtctggctccagagcaccctaccccagggaagcagcttagggaatccatcctggtttcacaggtggcattctcccctcctgcccataatagtcagggatcaaggccactgctggtcaagttcatcctgcaccccagggccctgagaaattcagtcaggttgagcagggtcttcagactgcttgccaggcaagtccttccctttatgccatgtgcctcagtttccctgtctctgaaatcagctcacacttcttaccctgcagccttcattatcacagtcttccagccatcctgtaatgaccattgtgtctgagccagtccctagcttaaagctgtcatggaagctgacagaaagaagcagccagcttgttcatggtagctgctgctcttctgcaggaaagtagactatcaggctaagctgctcacctgcattattcagttactcctccaacgaccacatgaaaaggtgctattatgagcatccctgtttaatatttaaggaaactggagctcgataagtttctgtaacttgccctttgccagtctcctttcaccatccctgctgcctcaatcacagctggaactgagagggcagatgggccaggcagagcccgaatccatggttgagacactgcggctgagggaggggagctgtggatccaagcagtgttcagagggacagagcaggtggctgtggctgtgcaggggtggggggcggggggcgggacccttgccatacacagatcacaccaacagcctcaatggtgtccttctccccacatccttgccacattctgtatttagcctgggccaatccaatggcaaaaaataatggtcatctttagtttgtttaatctcatttttttctaattacagaccaggtgagggtgggtggggtacgtgcagttttttctgaccctgaggcccatgctcttaaaccactgctcaggtctgccttccaagaaacgtggacagcagaaagcgcctcctaggacattttccaggcacatgtatgcatgtttttaaaacaaaatgtcatcagagattcatagaaggtatggattagagacagggtctcactctgtcacccaagttggagtgcagtggcatgatcatagctcactgcagcctctgtctcttgagctgaagcaatccttccacctcagcctcctcagtatctaggaccacaggcatgtactactgcacctggctaattggatcttggaggatcttggcaccaaaagagctccactcgtctcgccctgagagggttgagacccagagcagacaggcctgtcacatgcatgcagcaagggaactgcggccccaggtgagacacagatctccaagtccctgcctgggctcgcccctctggactcacaaggccccagagcctcaaggctgaggaaatagaagatacacatgacaaatgggtcagggaaagctaatgaggctgccagctgtgaggcctaggaaggaaggctgggaagatcatctcccctcactgcttggctacgagggcggagccacagctttgcaggatgatgtgtccgtctgtctgtctctttgcagtggtacacgccggaagcctgtttgcagctcagggagcacttccacgggcaggtcagcgctgcctgccaacgcaggaacacggggactgtcgggtgagcctgcagggtgtgggatgggggagcaggtggcaagaaggaatgagtgcatgaagcacgtgaaagaatgaacaaatgaaacacacacacgaggctggtgcagccctgtacaggcctgaagatgactggggttttcttttttttttctttttttttttttttgagacagagtctcgctctgtcgcccaggctggagtgcagtggtgcgatctcagctcactgcaagctctgcctcccgggttcatgccattctcctgcctcagcctcccgagtagcggggactacaggcgcccgccaccacgcccggctaattttttgtatttttagtagagacggggtttcaccatgttagccaggatggtctcgatctcctgacctcgtgatcagcctgcctcggcctcccaaagtgctgggattacaggtgtgagccaccgtgcccagccagatgactggggttttcatctggcttcagttaacacacctgccatatggaacaactttccctcttctaagtcacgcaggtgatttttcagcctcaggtcttggtacaagttcatttcctctgtctggaatgtctttcctaatcccctcgcttccccttccccttccccttcaggtctcagcgtgtcaagtcctctgggagccttctctgaccccccactacccttgcccctggactggggagggtacccctcctgggtgctcttgtgcccccaagaacttatctcacagaattgcaggctggattcctcactagacctagcccaagagggcgagggctgtgtctgtcctcttcctgccgcggcagctcctgccaccactggcagagggattgtgaaatagtcattccttcttttaacaaataggtacaagggcctgcttttgcccctcttcctaaggagctcatagtctgctcagggagttggctgagctcacaggggtcacagaggtgcgatgaggctgccagagagcgcagctagaggttcccaaactgcacagagtgggtgaggcagagctgagatcagaatagccgaagtggccatggtggtgggatgagagtaatggcatctgttggggaatgctggtgccatatcaggtgcttcacacagatgatctccctgatcccttatggcagcactggaggtggggaaactgaggatcagagggtacctgctgtaagaccttgtcaacacctttactcattcataggagaaatggagtcagaacgaaagggccctctgggagcagggtagacacaatccctgctctcacggacctggcaaggtgacctgcagcccaggtcaccaggtgacacagtggtgccctcttgctgtctgcaggcagaggaagtgcctgtcagatatttacccaggttggttgctgtgaccatttggctccttggggatgagctgcaaaaactcttaaagtgttgtcaacagtcccaggaagctgggacaatggcacctgtagtcccagttactcaggaggctgaggtgggaggatcactcgagccaaggagtttgagactactagcctgggcaacacagcgagaccctgtctctaaaaaaataataaacagtccgagaaacgcctctgcacagagtgtaggacacacagagggtgagggtggcggctgctcttggggaacagtgacccacagagagcccaagaacctcagagccgatttgcctcaagccacagcccggatgcatagagcctcagccctgttcggggtgtgccccttggcctgtcggacccttacagatctctaagtgagcagggcacggtggtgtcatggtcagggagtgcctgcttgcaagaggccggagcccacatcggcgcacagccccgggggtgcataggagggtgaggggctgcccgtcccttttgccggggtctccctgcacgtggaccctgtgtctgcaccctcagcacagctcccggacagcacagacgtgcccacggctgttggttggttaccacagccacaccctggcctcctgcctctgcccctccacctgtgactcggcctcttgttatgcccattcctaattctcaggatggggactttggccaaatatggtgaggggtgcagctctaggggcagcagagtctccagcctctcccgtctcccctctggggactgtgaagggggaacacagtgtctcagcagggtggcccatcctgtgtccaggagtgaggggtgtctcaccagcagagagctcagggaaggaaggggctgtgagtgtctgaagacaccctggaaggcatgcccgacggcaacacggccatatttctcacaggctcaaactctccaaggtggtggtggttggcgatctctacgtggggaagaccagcctcatccacaggtacaaggcttcctctgcccctttggccacctcccccagcaccaggttgtcatacctttgcctgggtggcccagataatatcaacatagcagaaatcatgtggcttccaggaactgctgtgcctcagcctgctgggagccggataagagggggtgcaagaaatcggggagatggcagggctgggcagaaattgtggcgtcccaggagcctggcgcttgtcagactgtccccctggggccacgggctctcccctccactgccctccctgcaaatggctgctcagtttcgctcagtttctaactcacagcttgccttccgagctcctgcagcctccctttccccacattgtccttgctggctgccctgcccacccatggcctgcgtggaccatcgcttcctgatgggaagtggaccttatttgcctaaagacttgcagtgttacaagtgaagcttccgggcacatttctgtgagtacacccctgtgacgacttcctcatcccccacaggttttgcaagaatgtttttgatcgagactacaaggccaccattggggtggactttgaaattgagcgctttgagattgctgggattccctatagcctccagatgtaagttgctggttcccccatggctcgtgggcagcttcctacaggcacctgagaaaggatttggggagctccttcactgtgtccatgtcaaggaggactagtctagacaagcagagcctgggggtgttgtgtgacacttagcttcctggctcccagagcccccacatgctctgtcagtcccaaagttgtctcattttggtcattggctctggggaaggtgctcacagcctgacctgcccacctgcccatgacctccccaatgcccaccccactcctcttgaggccctggctccagtccctccctgacctaggcctcctgtgatcccactcaccaggccagcagggtggcctcccgcaggttgctgctgagctctgagcctctgttcccacctgtaaaatggggtcaaatccagtccctgcatgccaggcttgggcaaggagggctgagatggagtacacagcacccacatccttcctcaggtctgaggcactcgtcttcctcctcacactgcagccttcactccctctccccagcctcactttccttccacttctgtcttttttttttttttttttttttgagacagagtcttgctctgtcacccaggctggagtgcagtggcgcaatctcagctcactgcaacctccacttcaagcgaatcacctgcctcagcctcccaagtaggacaacagctgtgtgcccccacacccagctaatttatttttgtatttttagtagagatggggttttactatgttggccatgctgatctcgaactcctgacctcaagtgctccacccgcttcagcctcccaaagtgctgggattacaggtgtgagccaccgtacccggcccacttctgtttgtcttccttgctaggccctgggagtctgactcacgatggcctccactggccttaccccttccctctgccttccatctgagtggcccagggccactctcccaccccttaccctctcccaccccagctgggtagcttccctctgccccggcacctggagaatgctgcaggcctgcctgggctcgggccctcacctctactctcctgtgagacccttccgtgctcccctacatggctagccccgcccccctcctctccacttgcctgctggcattcaccaagctccttcctggtgcctgagttcgttcctcaatcctccatgccctgcctggactgagccttcagatcctgtggatgtcagttcctaactctgtcgagatagtgcccccttctctcaggacttccacagccccagcaaagccctggagatggaggataacaaatcttgcccaagggagagtacaggccagtcaagagcaaaggaggctgggagagaacgcagggctgcaggactgagggatccagagagctgagaagagcaaagggccagtgggggtagctgaggtggagccgggaaagactggctgggggctgggctcacccgtgtgaccacaggccatatctcattagagggccctggacaaaacagggacactgtcctggctcagcctctcattgtcttacattgaggcctttgccagcctccctacgggctcatctctaggccaccaccaccagctcctcccccagagtcttcagaaatgaaagaaaatatgaatgaattaatgaaagaatgaagcccaaacttctgtgtcatactggatcacttgaaaaaaattcagaccatgaccgggcatggtggctcacacctgtaatcccagcactttgggaggccagggcgggtggatcacctgaggtcaggagttcgagaccagcctgaccaacatggagaaaccccatctctactaaaaatacaaaattagccaggcacagtggtgcatgcctgtaatccaagctacttgggaggctgaggcaggagaattgcttgaacctgggaggcagaggttacagtgagccaagatcatgccattacactctagcctgggcaataagagcgaaactccacctcaaaaaaaaagaaaaaaatcagaccatagatgtcttgtttgtgacttgtctactttgcagtttactgagaaaagttcaattttgatcagttgacctcaaaaagcgatggattggggaacaattttccgactcagccctgcatagtgactacctgccttgttctaagccagggcaggtagatctcagtaggtgctctttcccctcttctagactgtgcccatggcagacatcattaatcgattgttgtactcttttccatggagccagggctttgcttctaatttcttctcactactgtgctccagagagctggagctaactgctgagacccacctattgctccagtgttaggtatctccaactcctactttgggacctgcagtgtggaaggtgaagcaatgacccagtcacacccatcacccaaccaagtggcagagccactgctggaggccccgcctggagccccagtgccattcacagagccttctctacaagtggactgctacatcttcagagcgagtcatgtcttgggccgtatgttccattttaatgtctcagtcagaagggagtgagctgcaactccatccatccaggcagcagaacaactaatgccacacacccccatccactaggaatgagagaagtccactgggggcaccctaggaagagatcataaggagctgggggtagggacatctggctcacaacaggcacttcctgaagcccatgcagctggcacaggcccttagggtctcccacccatggtcccgtagcctgttggctcaagacactgtgattgtgtagcctgacaccatttccctttctttctcacccacctcacagctgggacacagctgggcaggagaagttcaagtgcatcgcatctgcctactaccggggtgcccagggtgagcaacatgccacgtcggggctcaactgcatgcagcagcggggtccctgccgggctccacagtgggaatcccgagttctctgcacaggcaccagttttttgtcctccaagacccactgagaaaacaccaggccactgcttgggaacagggaagctgccttcatccccaggcactggctgactttggcgatcacaccctttaaggaccctgtggtagtgggtgctggctttaagtctcagccccagtttcagctcataaagatgctcagagatgaaagtgcttttccagaggctcagagaagggcagcactggactccagggggaggtcggaggaggcttgtcctgtcttagcagagggggctgggccagggagtaggagtgaaagggggaccacgggaggactgggaggccccaggtgggggccagcagggccggatgctcaccacttccatggccaagggcagccaggtggtgctgggcagggctcaccgtcagcagggggcggcagcataagctccggatgcctaccccaccttcccaggaagaagacagaaatggatttcagtgggagatgtgagagaacctcaaaagtatccaaaaccagactcaaattataaggcaccgatatgtctactcggtagtggtgaaaaagttacaacattttcttttagacttaaaagaagcaaaaataggaaacaaaccaggcagccctcagccgtgggttggagctccagctctgccctggtcgcatggcctcctgcacccttcgcctcttcgggcctctccttgaaaggatgcttctcccctgggaataagaggtgcgaggcgcctggcccacctctccacatggcagcctggctgccgtcatccctttcctcagtttcccccttcctttctcttcccatctgccttgggaggggcgtgggtctccctgtagccttcagccaaggtgcagaggaagcccctgtccggccctggtcacacccctgggggcagtagagagcatttgcctggaatgttctccacatagggctcccctcaggaccccaacaggaccggggtgcggccagtgatgagaggagctgagggcccaggctgcatctcccggttttctgcccacctggctccccggaagttgtttcgctaaagcaggttgttgctaaccatcactgctgtagctgctgttggttgaaatgaaagttggccctggactaacaggttttttttttttttgagcctgagtctcgctttgtagcccaaactggagtgcagtggcgcaatctcggctcactgcaagctccgcctcccgcattcacaacattctcctccctcagcctcccgagtagctgggactgcaggtgccggctaccacacccagctaatttttttgtgtgtgtgtatttttagtagagacggggtttcactgtgttagccaggatggtcttgatctcctgacttagtgatccacccgcctcagcctcccaaagtgctggaattacaggcatgagccacagcgcctggcgactaacagctttttaaaacagctgctcttgtttaatcctcacagcaaccctgagagctacaggtctcgtcctcgccattttacaggtgggaaaactgaggctctcagcagttaaggccctcacctgagctcccttagccgtaagtggcagagggtgtctgacgctaaagcccatgcgctcgctccacgcctaccttgtcctgcctccctggatcccacactgaggctgggctgccgggtgcaggctggagggtcccggtgggggacagccatggggtgtttcctcctcagccttcattgtaggaggttccggtgctgagtgcctggttggggggctgccctggcagttccttgggagctgggcacctcctggggagcccccttgctcgcctcgcctggcactgattggctgttggctttttccgggtgtctagtgatcatcacggcctttgacctcactgacgtgcagaccctggagcataccaggtaagtctgggctctctggcccctgcagtctccctgggctcaggaagctgcctggaagggctcccagaccctggccagtggaccctgaccccgtggtgggtgtgagtgaccagggccccttgtcagaaccagctgcccacggactacttactgtccaactgcctttatcgcttgagatttgtccctattctggaggagccagcacatgagtgtgagcccagcacagccacccccaggcacgtgctcagaggggccccaacctgctttaatacactgcctttgccatgttgcaagtccggatactttttgaatgaggtgccccacgtgttcagttcactgtgggccctgaaaactgtatagccagtctttgaagtgacatgaatttggcacttgcagtcttgagaagagagaattggcaatgtgacccattcaagaggctatcctacttctgctgggaatcggccagctactagagcaaagccctctcaccttaccttggtctggggcattcacacccagcaacttccaaaccccgtgagggaggcgggggtgatggttctagttgataaacatgcagggctcatgcaaggtctcaccgggagaggccagaggtggggccaggaggggtcttcaccacctccagccagtgctctggtattcccacccctttgggtccagccaacgcccttccggctggaggtgcagcatcctgctcagccagtgtgggccaggaagccctccttgtccctcccagcccagcacttcagccctggggaggtcccaagtgtgccctctgccccctgtttggggtgggaggatgggtgaatctctcagcctctctccttacactccaggcagtggttggaggatgctctgagggagaacgaggcaggctcctgcttcatcttcctcgtgggaaccaagaaggaccttctggtgagcagagtggcactggtggtctgggtggcccttgggaaaatgcctccccttacagccctcattggaggagccatggggagggagggaggcagcacagtgggaagcaggcagctgcctatccccctgggcctccctgcaggagagccgggacgctgggtcaacaagggccatttctcccagtcaggggccgcatgtgagcaggccgaagcagacgctgtgcacctggccagggagatgcaggccgagtactggtcagtgtcggccaagactggtgagtgggccagggctgtcaccatggtggggcagagccctgctcttgggccagtcctgtggggcctgccatgcagtgtttccctctgtagccagtcgtctgttccctctgtggccctggtgcacactggcatcacagccctgctgtgctggtgcctggcagcactttcattgcctaagaggagctgcgtcatctctagaaggaagctgggaggcctgcctcacggatgggggaatagtgaccccaaccctgtgtcatgccgtgctggcctgttctccataaccggagaaccccataactactcataactaccccataactactcatgaggcacgttccattttagtcctgtgaagtaacttccagggccacagggtggcagggccaggatccaaacacaccctcacctgtaaccactgcactatcctgcctctggccctgaaatgccaggcatgtgacatcacctggcatagagaagggcccagtgacaggggctcccatcccttcccagtatcactgtggctcaaagaccccagctctcactgaactcactccccaccgggtctacccctggccatactgggtccccagcccaaggcaagatgcccagcatctttgagcctccatctcatctgggaagcaggtgatgccatccatctcccttttttgtgaaaaaacgttttaaattacaaaagccaggtgtatttactgaggaaaacagaaaatccaaagacacaaagagcagatggcaaacacaggttgttgggggatgaaatgaagtcatacgcagggcctggcacataataggcccccaaggctctggggactcaggaattgggcccagtagtctttaccctgtgtaagaggggacagcagatatctagtcggagactgggtgagcactgagggttggcgtcacaagtagaagcaccactttcagcccagcgcaaacaactggcagtgccttccactgctcctttccaacagtgagaactgctctgtgagaacccttcctcccttatcagagtaacagtgagttcaccgacagctcactatggaccaagcaggactgccctatgcggttgtgcaggttgctggctgcacaagggcagtgtgcgtgttaagggctggaaaccagcccgctctctgatgggcagccacctctacctggaggaggatgcataaaggctccatgtgggggctgacagcaaatcaatcctcacagccccaccggacaggtatggaaagtgacaggagggcaggcacatatctgtcctgagttccacatcttccaacacttgggccatagtagcatctgattggaagagtagatgctgggaagcaaaggctcagaagtttgagggagtggcccaagcaggcagtggggtgggagttgggaggctggagccaggtgggaggccaggccagtggaccctgcccctggcactgtgctgcctgtgtgagtgggtggggctgtgccctcctggggtcattgttactgtcagggtgctctagaaagggctacgtgccaacctgagggtaggctagcctggctttcacacccagatgcattaaggggcaaggagaaacactgatgaggtcccggctgtcttgtgggcccacaggcgagaacgtgaaggcattcttcagccgcgtagccgccctggcattcgagcagtcggtgctgcaggacctggagaggcagagcagtgcccggctccaggtcggcaatggagacctaatccgtgagtataggtgtgactgggttgggctggggagtaggctggaggcctaaaatccacatgcgccatcctcgtcacctgaggccttgccatttcctgaacttgtggccctctcctgtcctttgaccctcctctcagggtgtcactgcagcctcaggcctgtagcccctctgattccacctgccaggtcagacaccctccctagccctccctgttctcctgacacatggacctcatgggcatccatgaggtcctcatagcccaggctgggcgtcccaggctctgcagatgtgtcctggccccggctctcccagtctgcacctttgccctctctgttccagtgcctggaaggccctctcttggcttgtgtcaggccattcaggccttgaacagcaggcccagaagcttcagctcacagctctgactgtcagggccggcatcccctgcccagtgtcagctacaggattcctggttgatgctaaattacttctcccctccttacagaaatggaagggagtccgcccgagacccaggagagcaagaggccctccagcctgggctgctgctaactggggcctgcgtggaaggcctccgctccctgcacacacacggacaggaatttccgtgactgtggtgtggagactggagcccaagctctgcagcgtgtcgccctcaagctgtaggcccatgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggatgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacatctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggcccctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggcgtgcaatggcacgatcttggctcactgcaagcttccccttccgggttcatgccattctcctgcctcagcctcccgagtagctgggactacaggcacgtgtgaccatgccgggctaattttttatatttttagtagagagaggtttcaccgtgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccgccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatatt

SEQ ID NO: 105 - DNA, 82650 bp, Homo sapiens
ataaagagacttagcacatttattcactcacagaggtgaatgaagggctcagggtttgaactcgatgacactgatggcgatccgggctgcccgctgtaaggcttcggccacttgaggcttttcgtaagtctccacctccatggcacggaaagtgggcacgtgcgtctgcagggccttgcggccctcgggggcctctgccagcatggtaagggccttggtggcattcaggcgcgctatggtcatgggggagtgcagcagctccaggagcaggccgatggcttgtgcctccagggccgcatacttccctgcaggccaccaacacaaggcgttccaaacagcccaaggggccctcttctcaccccctctcaccctagccctctcctgaccctcctccttgtgcagtctcaaggggtttatgcctggtttatgccccaccaacatgccctcaccctcagggctcttgcaccttcgctgagtccggcctgggcctggcctcttcatctcctgcctttccggcctcaactggctcctctccatccaccctcgtatcctgcccaggagttcaagaccagcctgggcaacataatgagattccatctctacaaaaatttaaaaattatccagatgtagtgacaggtgcctacagtcccagctactcaggagactgagcggggaggatcactagagcctgggagtttgaggctgcagtgatcgtgacatcgtactctagcctgggtgacacactgagacactggctctttaaaaaaagtaagcccagctgggcgcggtggctcacgcctgtaatcccagcactttgggaggccgaggctggtggatcacgaggtcaggagattgtgaccatcctggctaacacagtgaaaccccgtctctattaaaaatacaaaaaattagccgggcatggtggcaggcgcctgtagtcccagctactcaggaggctgaggcaggagaatgcgtgaacctgggaggcggagcttgcagtgagccaagatggtgccactgcactccagcctgggcgacagagcgagactccatctcaaaaaaaaaaaaaaagtaaacccaatagttcatatatgttgccaatatttcttgagcacctactctgcacaaaacacacatggttcctgagagatgccctcctcaaccattcgctgcccctttctgctgtccttgccggccctatgctcctgcagtgcccagtggactctcccctttgctggtggaacctctcagcctgggccctgccaactcccattgtccttgggattgatcccaagcccttcccagaggcgacttgtcccctgtgtttgccccacccatgctgggcttctcctccacatccctcatcactgcctcccagggcctggcacgtggcaggggcttcaggaccctcagctggagtgccagcttgggaataagtggcctcatctccctgggtctcagcctcttgtgtctcgagccccgtggccctccaagcactcctacagaaagcctggaccgagaaggacactgggctgaggctgccccaagataaacacgcagggggagcccctgccaccgtgcagtcagcatcctgactacaccagtaaaaggaggggctgtggactccaagaaagccccaacctctcccatctgcatacctcaagcagcattagggtcaggtgtgcagggcctgggaggacctgtctttgggaggctgattgcaaatccaagcccagatggtcctccatggaactcaaaggaagcacagggccccaggctggtgggtgtgtaggggccagagggaaagtcaaatgctttcaggggtcctgggagtgccacgccccagtctgccaggtgtggaaacagcccagggttcttccatgagcccagggttgggtgacttagaggggaagcctgactggctgggagtcccaaggtagggggctcgggggagataattctgaatttgccccctcctccagtttaagaaaaataattaggatgaataaacaccatagagtcaagggctccagggtttgcttagacctcagggtaacagaatcatggatggcaaactaatcaacccttgagtcacagctcacaaggggcctgggtgggaggcgggaattccaggcccagggaacagactggtgcgaaggcacagaggtcctaatgtgagtgactggtgaggggccactgtgctggggagaagagggagggctgggccttggacccaaccttgaaaggacatcagtgataggccaaggggaggttttttttttttttgcaaagtgtggagtttgggggacgatacccagcccctgagtacagaaagctcatcacggctgctagcctgctagggtctccctccctgcggcaccccccaccgcctcaccttcagtgatcactgtggcgaacatcagggcaccggcagcgttagacttcacatgctccactgggtctttcagcagatggaccaggatggggatgacgtcaaaatgacacacctgtttcttgccctctcgagatatgctggggcagagagggaacagagaggggctctgcttggaagggagaagaggcgcaaggcccaggagtgccccagggagacacaaaagaaataattgtgtgggggctaccccaggtagtcccaggactggtccccatgatccaggactggtcatggcagggatgctgggctgcagaggagcattggtgtgaacgcggcccactgccagtgaagaccacggggtgacagggcctcactctgagccagcacacagaaaagaaatagggcatgttctccgtggccccaaaatggggaacagcaggacccaggggtgtcaaccacagggagacctgttttgactttgcctaagagccagagctgacagtgatgggccaagctgcccccaacagcagcagctgccgggcactgggcaactgcagctaaggactcagaccaggtaacttttaggccacttactctggcactgaatgaagttgtggaaatgaggatgatgaactccccaaaagtttcctgagagagggtcaattctgtcccctaaaaagaaagggctccctgggccaggaaacactgttcacaagccccacaggaatgccacagtgcaaagacccctgtgtcacttagtttaatcaacctttcccaaatgtagccaccaaagaaccctcatttttgtagagctcttaatgacctcaaagacacaggtgttccctgggaacacagattgggaaatgaggttggccagccactagctgtgacactgggagcctttcagggcagtgggcctcaaccccgaagcccatgatcaaagttgcagagtcctgggccccacatgcagggattccctgattcgttcacacagcaagacactgagacaagagcgatgcagggattccccgatttgttcacaagagtggggacaagagcagggtttctccagctcagtgttctttagggccagataattctcaactgggagccaaagctcccccgctgcaaaccctgggtttagggcagcaaacagaggaaagccctgtcctcaggagctcccctcggggatgacacacaaagtaacggcagggatggtggtcacagtggacatgggaggacaggggacagcagggaggttacagtttcagagagagagagctctctcctggaaagccactctcatggtcccacagaaaggggacctctgagcagacctaagaatgatggggctgggacagggcccaggaatctgcattttcacaaacctcccggtggcttgggtccggggccccacttgcagaaatactggcctgagcctctagtgagactctcagaagagaagccaggacttagggaaggcaagagggtctccactaaagagacatagccacagctaaggcagagactctggggttcggtgaccagcctgtcctcgtgaaaaggggcccagtgtgagaacacacaccgcaccctgccccctgcagctttgaggctttgggctccctcagtttccaggccaggatgtagactgtgatcctgtgtgacctggtgtgagacacaagacactgcctccttttctcacctgtgaaggcagacatcacctccctggagggtcgcctaaatgtgaggtttgtagacaacgcctggcacacaggaggcactcagtgaccgctgggtgtcatgatcatcaccagtgcatctcctgtgctggccttcctcatggggagggggtgcacaatcatctggctttgtccaggctgaggggtttcctgggatacagtacactcccaggccaacgggatggtggtcaccctaggggagaaggtcatcctctgtcccagctccctcctgcccctgggcacaagcaggcaaggggaagcaggcccagggtggccgcccttgagctctggaccagtccagctcaggtgccttctcccagccttggtagaaacccagcctaggccaggcctcacctgacattaaggagcgcacgggcggccttgctgcggatgttctggttggcgctgaggagcttctgcttcaggacaagcaccacattgctgcccagggcctcggtggcatcctcctgcaggcagaggaccagtgtgtccaggatgaactcctggaactcctcctcctccacctccacctgcagcttccataccagtgaggaaatcagacctttgctgatgatctcttgggcccctacaaggcaggaaagggcactgagggcgggctggccacacacccacccacccatgccagttggcctgcagggctcaaggagggtcttgcagaaccagtgggtgggtttgacaaaaggacttgcaagtgccacccccacacacacgtcccgcctggccaggggcctgagcgaccagcaggcagctgcagtgacagccatgtcaggggctaagggcggaggctcagagaacccaggaaggaccagtcttttgtcgcctgtgtctcagggggcatctaccatagcaagcgcacagcagctggagaggcagtaagccacccctcggagagctgacagctcactcctgcagggcccaggcacaccaggagacctccactcttccctccccctgccccagagttggggagccagccaagcccccgcttcccatccaccaaaatatttcaaagctgctggagaccccacactggtctgaccagccctggagaagagcttggttttgactctgagacagaagacctagagtgtaggccagtgtcacactcaccaaaaagagctgtgccccaactaaaggtgacgggaagccataggctctcgtcttcaagggacctggggctctgtgggaagggggctccacatggcacagctggggtgcaggtactgggagaagcacaatgaggcaaggctcccccataaacaggccccacctggctcctcccagctcccttccctcctgaggaatgtcagcatgtggttgcctagagaacccagcacgagtggcatcctgagcccaggacggtgggcagaacagccctcctgagtcactgagatgagaagcacagggaatgtgcacagtgcccttccctacggcacgcagctgccctcgccactgccctgcagcccactgcctactgcaaagccatctacagcccccagggaggtggccaccagcagacacctctttcttccgccctccccagctaaaccctctaatttactctagagagagaaataaacaggttgattagcctaaaggtctccaagtgccaattagtaccagggatttcctctttgaagacatcaccccaaccttcttcccccactccctgaggacatcaaacagcaggtgcccagggtgatggggtagaaaggcggagcagggtgctgagtggctcttaccgccccccaccatgtctcataatgtccagcagctctccatgccccatcccccaggtcctctggtgtcaggtggcttccagtgcccctggccagcttctcactgtggtatcagatggagcagctagatctgccctgtttgttctcagggctctgaccacccaggaaaagtgggttcctgttgcttctactgtgttggccttttttatttaatatgcacagattgcaaaaaaaaaaaaaaaaaaaaaaaaaaaaagcctaggtctcatttaaaacatatcctttccaatctgtgtgaccttggacaagttacttaacctctctgagtctagtttccttatcactgaaacgggcctacctggcagggggttgtggatgaaaacgtgttccacgtgctgtggatttcttcatccatgtaagggtctgtccctgtgtgcccagaacatctgggcctagggtggcaagagtctcctgaattccaccaacactgagtcccagctacaagcaagggcctgctggaggctgaggagtaggatacaagacaaacgctgcacagcccaagccctgcagatcccatcagtgcagaaaccccccaaccctaccacccctcccgaggcctgatcctctctctcgcgcagctccctgctttgcccataccacacacctggcctcctgctcccgctctgcttcccctcaggttctgcccacggtctccctacccactcctggctatagattcaactcagtggtgacctggacggccctcttccagctcacagcagggaggcgacaatttgaccttctgttaattttgctggcagatggaaggacaaagttctgggatggggacacttgagcaaagacctgggggtaaggaagttgttaattttcaaatcagggctagattgtagcctcgtctcacctatctgagcttcccaggaaatccctgggacaggtgtcattgctgagtcaggatgggcacaagttaggggaggaatatagaaggagttgaggtcagaaaagtcaacattcaaggtgatcacctccattacccacctctccttggtgaggaaactgaggcccagagaggcaacttgaatacctaaggtcacacagcagatggtggcaaagccaggcgggaccctcagccccttgggttttgtttctcaggcatttgtcttgtacttctgctcctagaaatgcttagcacagggaccggggttcattttgagacagagggagaagattaaaaataaaacgcgtgccgggtgtgcctttctgctcgttcactttgcttcttttcagctaaaagaagagtctcgggcctggctatttataactaacccagatctgcgatggcttgctcaagtgggggtggggcacacagaccccagggaaacaatcggggaaatccacccaactgggcggcagcctgagcgtccgctgggggtggggggtggttgcagaagaggtaggacaggtggggcacagagaatcagccagatggggtggcaccagagcaggccaggctctgggccatccatggtttagagacaagcaacatatgcccaccccacccccgggaagtgggaaaactagtggaatagtcagctggggacaggtcactacagaacaggttgacatgtgtgtagaccaggaattccagggtcctaggggctctggaggtgcacaaagggaggccccggggaagctggttctcatggatgtggaggagagcccagaacagcagggctcaaatgtatgtgtttgtggggagtccccgatctggcctggctgatatgtaggggctaggatgggttcagtggttgatgagccaaagagatccaatgggattgaggggtcacggatgtccatggtgtggagccccagtggtggagtctgggtcattttctttgtggtggggcagggcgggtgctgacaccatgttgaggggccactcctcagccagctgtgcctgctgggttggggaggtgctgagtgggctcagtcaccaccatggcccccttcctctggctacagcaaagccccagctgttgtctcccagccaatgagggctcaggacagagcaccagcacccaggttctggtcgcagccacaccctttcctgttaggggactgcacatccacacatggcatctggggcccaccttgccgcaggtgacccacctgtccagctttagccttgcatggccctgtgccctgaactcctggcccactgggcctgcctttgctccaaggggtgcttctctgtcctcagctttctcggcttccaggtagctgggagcatggttaacagcttcttcctttaccacatgctctcttcccgtgcctctggtaccctccattctctggttcctgaccacctccccaactgctcctccatctttttggtaagcaccatctcttcctccagtggtccccaccctctccccttctctcatctccctgggtcctgataatgccccgccactgtctcctaacatgctcttggtctccctgccatctcacagccacagcagaccgtacactgaactcagcctcacagactgacttctgtgctcactcccacttcctctggactgactaactgatgtttttgttattttattatgtccagtaggacaactcacattgtctgtgggaccacgcctactgtaaacaggcaattaaaaacttctcctcctccttctcaaatttaaaagactaatgttaaaactctcgagcagttcttaggccaacgtccctgatcctactgccccaagctggcatctgtgcatgggcaacgaccctggccccagccacactggtcttctctgggttcttcctggcctcgtgctccttcatgtcctgcaccgtccccgccttggaactcacttccctcccaccctatgtcactggccacctccacgcctgctatggcctcattccaagcatctcttcctttgggaagctggcccaatgcccaatgctcccccactccacatgcccccagagccccagtgggtctcctcagatagcctcacatgactgtaaggcccaatcgttgtttgctttctgcccctgccctacaggcagagggtctgccagaaaagggccggtctgaatcctagaactgtgcctacaactataccctggtggaggaggctatctgtaagtgactgctgcatgaatacaatattggtttgatgccaggtgagatgtccctctcttactttgaggtcaagtcagggaggtgtcagccagccccagtggacccctccgcaggctagcctctgctctggaccactggaaagggccatctcactgttgcatgtgggcttacctctgcaaacaattcaactctgacccccagactctgcagtggaaacagcctctggctatcccaagacatgctaatatgcatttcctatatacattaaccctcagagccaccctctgaccacagtctgttacattcccttttgacagaagaggaaacagaggctcagccaggtagcacagctgccggtctctgtgtggtcctcctggcaagaggtccagcctgacacagcctggtggtgtggaaggcaagcacaaagggtagctagcccctcagccattggctgaattcccttggtcctcactggacacctccagtgagcactaagttcgcctccatgatgcccataacaaatatacgtcctgttcctgacagttgaggcagcaccctcacaggtggcccatgaccctgcaggtacgtaacgcaatggtctccatctcacagaagaggaaacattcctagggaggttatgggatgatgctgagatgccacagtgtccagctggcaaagccaggcacatgcccctgcccctccaccacagagctatgatggagagaccgctccatggacctctgccatggtcaggtccagggctgctgctcaaagaatggcatgatccacaccttacaaaggtgtgaggtgataaggaacgcgttagctgggaaggcatttgcactttgtcagggatgctctaggatacacaaagcttcagatttacaaagatggagaagagagacaggagcattcatgtcttggccctctggcttgagagtcttttaagcatggaactgagggactcctggccctgaggtccacagataggctttgaaattgaaaacagaattttgcagcctgggttcagctgcgttttgctgagggtctgatgctttccaccagcttcccaaaagcgccaatcagtggccttaactgaactggctctctcacgcttgtctgggctgggggccagctcctcggtccttctcccttccttccctcccaaggccacccttccgtgtgccaggattgccagggacgccaaagagcccctagacactgggcggtggcggcggggggcggcggcagagatgactaatgctccctcccatcgctgcacaaacctcaccggtgtaaatcgttagggtttgcataggcctttcacacgttctgaaggattggtgagacaatccaggagagcaggtgccactagccccactttgcaaacagaaaggctgggagaggtcagtcggttgcccaaggacgtagagctcacaagaggccgaactgggtttgaacccgagtggagagaaggcgagccgggactggctgcagtaaagagggccaggaccatggctgggctcaggcttggtttcccgggctgccagaggtggcccctggggctcggctaccaggcctcagcgcagcggagtcggtggaacgccggcgcggggagctcttgcgggactgcggcgcgcgcggagctgcgaccccgcccctgtccgtccccattgggctactggcccgtccgtcagctgcctgtgcccaatggacagagggccggcgctcgtggcggggcggaggtgcccggcgcgtggtgcccggcgggcgcgcggcacccccccgcccgcggttggcctggcaacgggctgcgctcgcggctccgccccctgccggcggcggcgcggcgcggggcgggcggacccgcggactggcggcgggcggcgggcggcgggcggcgggcggcgcgggagggcgggcggagggaaccaggccggccggagtgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgagtgagccgacccgcggccggccgcgcgccgctgagcctcaggggtcgggggcacggccggggcatccaccttgcccccacttgggactcttcccaggcctttgtgccccggatccgccaggacgcagcgtcagggatgcccctcaggggtgggggacaccaagggcggggacgcctgcgaggtgggcagggggcggcctctggtcgggcaggtgctgggggagggatgcgccgccaagccgatgaccccgcgggagggggcggttgaggacccgggagggtggacagagggcgccggggatgccgcgcggggccgccgggcgcccccaagcagcggctgatgcggagcccgggcgggccaggcgagctgcgggagcggcgctgaggcgggtctccctagggggaggatcagggaggggcggccggagccgatgcagggccttgcctgaaaccgaggagagggccccagaggcctgggcccgaggacctgggcccgcagacggacagctagcagttctcggtcactgctcttgcagcgagcaggttcctcacaggcatttagaggaagagatgagtatcgacctgctgcgattgtaatacgttcccggctcaatattttttcccttaaaaggcggtgggggtgtttgggggaggggagtgagggcctcagggctggcgctccgtatcctgcgggcgatccgagggggctctgcctttagggcggtgctgagccttcctgggtgatgatggcaggattcggcctaggccgagaatgggggctcctgttaactgagacaagaggatgatgccaagcgagaccagcgttccgcgtagtccgtgttggggtggagggacccgcctggtagagaggtctgtcttgcttggggagacagctgagcccctgaccggctcctttctgcccaagtgatttccctgccctggggattgagctctctggagaaggctccttggccaaattcaattaagcaaatatttattgagtggtcactcccccagagcttgacgctggggtgcaccgggtgggagtggactgggcctgccctcccaggactgattgaccaccgcataggggaaaacgtctctactcgaccaaccccgcttgagtgcaggtgcaggggcctcgggagggacctcagagtggtgtcctgggctggggggtcaggtgagctcgtgggcaacatgacatttgaactggagcttgaaggacatgggcacagctaagctgggcattgtgggcagagaggagagaatagaccgaggcacttgggcagttaggtctgatgggagcacttagcatgcctggggagtaggaggaggtatggcgggaaaggccggtgggggctgcacggggctgagggagctgggaagtggaatgaccccactgctggttaactgtggctatggtggagaccacggcttcctcatctgtaaaagcgaagcagttccatgaccccatgagctggggtgggcctggagaagagctagctttaaagactggggaaggctccttgcagtctgagactgtgcttccaggcacttctccctcgggcacagccagggcactgggtaaccacccaggcaacccccttgttaggattgagttgcctgtttcggggatgatgcttagctagtgactctgtgcctctgggatgtggatgtttgagagcagtaatcgtggcagcctgggagcatccatctacggggtgcagtgggggtgtggatggcctggcggtgcttggataaaatatgcgccttgagcaagcctcattctctaggaatgaggagatgctggcatctggtttaaaagtcttcctgtgtgttcctctaactgacgttgattttctgagacaggaggtgaataagacataatttctccccctcggaaattggtgtcactttcccccctaagtcagctccctcatttctggggatgtttttgctctccctctgaaggggctgtttgttactcatctttgtagtgtgcctaccctccccacccaacacacacttggctttggccaaggcccaggttgatgcagcgagaacagggcctgccctcgtggggtgtgcagtctgtgctgagcagggtgagctgctgtgctctgtgcctgtcgcctggactgttgcagggacctggcatgtgactgtgggtttgggacacagggaatggattcttccctctgtccccagcctctcagtccttttgttttctagaatctcaggaggaacctcagagacctggaggccccaccagagtggccagaacctggtgcaggagtatgggtggggtctcagtctggccctcaggagcttctagaacaattccaggaatttgcaggtaactggattgacttcacaagggctgcccagggcccccgcagagaggccagtgggacaggaatgctgaatatagcaattcaggaatgctgaatttagtcatcttgtgtgtgaacacatgtgtgcggcttcctcccctggaggcaaggaaggcagccctgtgctgtctgtcccacgctagcctcagaatacttaagacggtgtgtggtggcaaaggcactctcactgctgctgaccatggcaggtgcacgggcacactggaggaggcaggtcagcatgctgctctcccgaaccctccagcaaggaaacctggggtagccaagcctctgagcacctgtgagcactgtgcttggctggaaggagcacaaagcgaaatgaacagaggcgtcagtgcagatgccaagggtcagccccaggcagaatcccagagcagaggctatgctgcggcctgggcagaatgaagagggacgtgggagcacccagactgttgtggctccggggtggtgaggtgagcattccagtctaggtggcagaagacctggagtcaggtcctggtcccaccatcctaggtccagcccctttttctctgaacctcattatcctcatccatacccaaagccaagagtgccctgccctgtccccacaccagcccctgccacacattttggccctttcgtgcgaacaccgccaggggaggcgcttcacaggattgaaccaacagggaccgcttgacagatcctagagcacataggaggagacatcagccctctggactgagccggaggagcagaacctcacgcgattcatccattcatttgttcagctaacatttaccagcgcctgctgcatgccaggcactgtgccaggtgcaggggtacagcagggacgtagcatccactcacagtgctcacaccagacgggcaggggttgacagtaacacatgttactaagtgctgcactgtggagaacactaaagcagaaggtgggggacacgagatgggggtgggggactgacacagtgccatgcagaagtgctgggtgagtggtgtggctgagcaggggagagacagcaggtgcaaaggcgctgagcagacactccctggcccctggaggccccaccagagtggctggaacctggtgcaggagtgtgggtggggtgtcagggccaggtcctgcaggactcagtgggccccaatgaggcaggaagaccttggcagggttggagcagagaagagactggagctgccctcccaggaggagctaatctacactttgaaaagatctctctgctgaggtgggaaaataggctagggtggggtaaggctgggggccatgaggggctactgcaacatcccaggcagagaggctgctgacccaggggtgggagctctggaggccctgagaaatgcaggtgggagatttgtttttttaaagctgcagcttttaaaggacagctgcagttttggtctgaaccagtagaaagatggagctggtattggctgagaagcaagatacagaaaaacccattctggagaggtggggaattaggaggtgggtctgagacctggagagccattgatgggcacatgtggccagagggagagcaaggctggaggtggcaacctggagcccctggcactgaggtgtgtggcaggccggggaccacgtgaggtcacttagggatcaagggtaggtaggatcagaagaggctgagctgggctcctgggcctccactgtggggaggatgagttgagaagcatcgagaaagagagattgaggattgacgggcaagtgaggtggaagcacagtcacagtggcgcctcgggaggctggagaagagcgggtcccagagagcaggtcccctgtgtcaagcaggcagggcatgcccagggactgagcaatgcaggcacagctggccacatgattttgggggcccccatttgaaaattattaagggcctgacatgatggcgcacacctgtaatcctatactatgggagactgaggtaggaggatcacttgaagtcaggagtttgagaccagcctgagcaacatgtaagagcctgtctctacaaaagtaaaactaaaattatgcattccagaacagcaacagcagagcattaaaactgtatggatgcccaagtgagtgcccaggaagctggctggtcacagggacctcaaggataatattggggatgtagtggcccctgtggagaaggaaggcctggagggtgggcccgcaacctgcctgctgcccagtccccacagcatttctcctcccttccctgagtgggcgggtgggttgcgttggactttcagggccgctggagtcagtcacacccagcctgtgagcttcaccttggcaccatggcccagggaacccaaagtgaaaactgcagcaggcaattgcctgctgcaattcttcactaaatgtcttgcttcttgccccttggtctgtggacccttgggcaagaggcagcaggaggcacatcttgaggttgaggtttagatggtcccatcagcaggccctggacctacatggccacagcttcacacagcaatggcttctttgcgttcatctcttttccaaaggaagctgccacatcacagagttttgagttatttgcttctaaattaaggtgtaactctcttttagagacgtccctggagaatccatcaaaaagtgctaagaagcgagactgttaaaagccacagtgcagggaggggccttacacatagtgtcaagcccgggggtgttccttctagcagcctccaaccagaaacacaccccgtccccgagggctcagccaggcctctcatggccatgggggaccgtggttgtggttagagcaaacctttcaggagacccttggcccctgggatggagagctgccaggacagaggtccctttgtgaggtctgcccctgtgagtcacggaggccaaggtcctttgtgaggtctgcccctgtgaggtctgctcctttgtgaggtctgcccctgtgagtcatggaggccaaggtcctctgaggtgtggagagtggacctcatgtgcccagtgccttagtaggtctgggcagccccgcatctgggcagcatggtccctctcaccctggttggtcataggaagggtggctgaggaggaggctgtgctggaggctggcatggcagtgagggctggctcttaggctgtggccctgctccagacagggctggtggggcctctatgtagaacagcgccatgttcctgaccatgtttcctatgccctttcctgctgctatttttttccccttagcactcgccacagcgtgacctgctccctatttgattcattcatcgtatgtgtttgtgtaagctccatgagggcagggacgttgcggagtcaccattgagaatcgccacccagggagtcgctgtggagggactgaatattcgcagacagtcatgcctcagtggccctgtccagccccttttgccctagggctgagctgtgtgctcgtgcgctgcagaacccctgctccagctcaaccctctgctcctaagaggttgtacctttgggtccccagagatgtgtctctgggcctcaggtttggccaccaaacacaaaccaccctcaggtggatgctaccagctgggccccgtcaggcccaactgtgggttactctcaagccagaggcaggtggacagatgcctcgggctgacgccgggccactcagtgatgcaatgtgactcagtggggcctttgtcagacacggggattcacagagtgatgaccttcagaggcatgtctatggaaaactgtcctaaggggatgagccaagaccctgaaggtagtaaaggaacatgatgatggtagagtggcctttccaggtggcccctgtgccccaagatcaaggagtggcctctcaggccagtagaggagctcagggcaggggaaggcaccaggcctgggtagaagtccagctctgcctgtgatggtgaccctgcgaatgctttccactctctgggccttccttgcctttgagttggaagctctgggctgggtcaagtgtacagatagtttccttccttatctcaactctggagtgaccgtccaaagcatgctgtgctgaagaggattctaaggctgtgctgcagcccagagggaaagagtcatggtcgattagtgatgtctgcagcgggcacgggaggcaggatttagatgagcttgccagtgactggtgaacctcaccactgtaccccctcctatctagcagctttaacccaccctatctctccttacatgccccttccttagtgacactgatgctaaccccttattgggaaggactggcctccgtcttcctgagtcccatgagcagctcaggtcattgcttgctgactgtctcttctctcatttgatgcctcactccctgtagtgacctcagggtccaaccccatgcttcgttcatggcagcctctttctgtacactgaagaatgaataagtgaatgagtggtagagactcaaccactctacaaggccgggagcctcctcttggatgtacacctgatgttgatctctgttccagcaaggagcccctagaagccttcttggaattgggaggctggatggccacggaaacaaggtgctaaaccgtgtggtttcagctccaggtgttgcaggagtggggtcagcaagggaggagggggcaaggtgactaaggagggctgaggcatgtaaagtaccaggctctgtgtttgtggggcccggtggtcctgtctgaccttggctatggagcagctaatcaggcttccccagaggcaaagctgggaaaaccttccaagctgccaagaggggccttctgaagacccttctgactatgggtgggagaacttggcacctacagccttcaccctgaccccagcaggccctgaccccctgtgaactggtggtacctcacccctactcctcttgcacccccacactagtggccctacccctaactgtggccaggccaggggaggagcaactccaccatgagggcttggccctcatgcctcctcctgcccagctctgcatggcatgtccctctggccttagctgccccagctgcatgtggcctcaggccagccccacccagccctcttgcttcctgtggccctgtagagtggctaccaggacccctgctggtgagggcgggtgcgggtggcctgtctccgagctgggctttcctccagcatggtcaccccctcacccgctcagttacctctgatatgctgtgcaaacatatttctcgatgaaatgctgggaagaaaaataattagagtgttgcctccattatccaatttcggattaatcaaactctctttgtcctcggccaaaatctattcatttcccttaaacactgggccagtgccaggcattgatttcctctatgataacaccacgcacgcaagcacagccatgcccagccttgccccaccccgtggctgggacacagaggcactggtggggctgcccttgtccccccaacactgcccacctcctccaaggagtctcctggccacactgacacccccatctctgtcgtggctcctggagtgcttggcctcagtctccagtgtgtttgtcttgccacgctggctgttctggggctctccctcctcccaggatggtgtggaatggatagaggaggtgtggagggtgtggccactgcggtccccagggaccacagggaatgggctgcagccccaggctctgggtgggccagggtttgggggattatccccatcactggcacaggaagaaggccaagggggagggccagggcttctaagggggctgaggggccatgcaatgtatgtggggtgggagcacacttgcaggggtagcaacagaagcccagccccaaagggcttacaagatgaggggacatcctggctcccgggcctgagggcttagtagtggggcagcatcaggatcggccaagtccaggtgggcgggggctgtgcgtctacccgtgtccacccagggaaggccacgggcctttccagaagacctcccagaagtccccaactatcccctccgtgagccacgttgaccgattcctcactcagtcactacgagggcctgggattgatttattggcacctgcttggtgctaggtccttgtgggcacatgggatacatcaatgaacaaacagaccaacagtccctgccctatggcacagtgggaaagaggtgggcgataaacactctaagtaaattatacagtgtgctagaaagggaccatgcttggggcaaggcagcacacgtggtgtggctgtgtgcgaatatgggggtcattttccatcgtaaataggatgggcagggaggcctcctaaggaagggacatctgagccattggatggggagagggcgcggaagcgaagtccacttggctttctggacaaagagttttccaggaggaaggaacagccagtgcacaggccctgagttaagagtgagggatggtgctagagaggcagctagaggcagcatggcaggagtgggggagggggagcatgggcgtgggagtcagagaggccaggcattgcacagccctggtgccctggctggactttgactcggggtctgcccatgtcaagcaagcgtcgggagcaaacatgagaaggtttcaagcacaagtgagacatactctgcctcatttttacaaggatgcccctggctgctggtggagcacagggcacagggggctggagacagcaagaccagagaagtcatactgctgcaaaacagatgagaggctggggctggctagcgggagtgagtggtagaattctggacagtcagggcaattaagggttcccctgaggctggctgggtccagccacaacctgtggtgccagcctcagttctcaaggaaagggacgcagggaaggcgtgctgggcatgtagtggacaccactcatgcccctaggtccccaaggtaggggatgggattgtgggatgccacacatggaggcagagggcaggaggttgcagggcctcaaagacccagaaggtgaaatcagattccccactcaagtgagggtttgatggagtcagcagtttccttccctggggaaactggggagccaggagcctggggctacggctctctccaaggcagcaacctctttgatttggctcttaatgaaggccccacttcttctctgctgtcatggccaccctctcctccataggtggaacctttgcatattgatttatttatttactcctggcccagagaaatatctggcttgatttcctcctgagtcagtgttcctcaggcgacactatcaccctttgtctggtcagccgtggtggctgtgggccaaaagacaggacaggtggctgagggtgtccagagccaggacagcacagggttacagggaagggcctccctgttcatctcatctccccggtcatctcatctccccttcctttagcagaaggacactgggaggcccagccggggcatagcctggggttgtctgtaggatggggacactgtgttcactaaccgtagtccttcctcccatctgctcggactatggcttcaggataggcagagagctttgaggaggcaaagaaaggaggacctgtttctaaggtgagacccgttgcggatctgcaggtgcaaggcccatcaggcaggttgtggggagagtgtagagaagccaacccagtggcctgggccctggttactgtggagtggctgcaaagagcccacaaacacggagtcacatgtcctcaagccatgaatcagtgatgtctttcatgtgcgtatgctctcatttttcaaacactgcaaaagctattgtgataaatgaaatgcagagtcatttacaagccttgaggaaatcttggcgcgcaaaaaccctttttacctctgtcatcagcactcactggattaatgggtgctctcccttctcactgtaaagcatgctggcttgtgtcagtacagggttggccctccagggcagcgggcactctctagaacccccttgcccttccacatgtatccctttgagtccgttgtgattgtcccaaacctatttgtgccagttgtactcattgtaatcacagcctggaatactgtgtaaactggtgggctgtgactgtatagagggcttctgtggaaatgaaagtggttgctttggaaaagcctcagtaaaagccgtggttaggtttggtgtgggcaagccaaccacgagtttggggacaaggagtataacagcctaaagttcagattccgggtcctttgccacctcacttgtgttggaaaaagtaaacgagatgtcacgcaaggtgtgctgtggtttaagcaagaagtggcataaccccagaaccggaaactctgatttaggaagagtttgtgtctctgaaaattgacagatatatgaatgtatgtttatctgagttaagtgaaaataaagtacacgtgtgtcatttcttaggtcttcctgctttaattcacttttcagtagatcagccagccagcagtctcaggtttgattgcaacttttagccatcaacagttattagaaatatatgttataggccaatcaggttataggccaatatgttataggccaatcaggttcatgcctgtaatcccagcactttgggaaggagacgcaggtggatcatttgaggtcaggagtttgagaccaatgtggccaacatggcaaaaccctgtctctactaaaaatacaaaaattagccagccatggtggtggacacctgtaatcccagctacttgggaggctgaggcaggagaatcacttgaacccagcagatggaagttgcagtgagccgagatcgtgccactgcattccagcctgggcaacagagtgagattccatctcaaaaaaaaaaaaaaaaaaaaaaaggccaggcgcagtggctcacgcctgtaatcccagcactttggggggccgaggcgggcggatcacgaggtcaggagatcgagaccatcctggctaacacagtgaaacctcatctctactaaaaatacaaaaaattagctgggtgtggtggcgggcacctgtagtcctagctacttgggaggctgaggcaggagaatggcatgaacccaggacgcggagcttgcagtgagccgagatcgtgccgctgcactccagcctgggcgacagagcaagactccgcctcaaaaaaaaaacaaaaaaaaaaaacaccccagaaatatatgtgtaataatgtcggaatctgcaggttggtctttttcgttgtgtttttttgtttttgtttgtttgtttatttgttttgagtctcgccctgttgaccaggctggagtgtaatggcgcgatctcggctcactgcaacctccgcctcccaggttcaagctcctgtctcagcctcgaaagtagctgggattacaggcgcacaccaccacacctggctattttttttttttttttttgtatctttagtagagacagggtttcaccatgttggccaggctggtcttgaactgacttcgtgatccacctgcctcagcctcccaaagtgctgggattacaggcatgagccaccgcgcccggcctcgttgtgtttttttgtttatttttgttttgcatgtgaaggatcattccataatacttggaaaggttgtaaaccaggagtctacaacagagccaaggccacaggggccaagtatgaggaggaggctgcttgatgacactgcagaactcccacggcaggccagcctggaagcccctctttccccaggactaggattcacaaggcccttggagccccagcccacccaagcggaagagtccagggacaacctgcagggaagtgtgaggttttctagcataagaggacatgggggatgggcctgaggaccaggagatgctggtttcacagagctgaggctagctgggctctcagcctggggtgtgcagagtccacagtgtcttccccccaaaccttgcccccagaaactcccattttaattcaataaggtgtgaagtggtcaagatcatattaaggtggggcgtgagctggctgggatgggaaagggcacgtgggagactgggagaccaggcaggaggctccagggaagttgggagagtgaaggaggagggtgggcaggagaagtttcaggaagaggactctccacacagacagaaggaactggaaaccataccaaaggaggggtccttaggggctagcctgcagctcggagaggggcaggtgtgatgcacatttgagaaatatttgtggaaagcagaagcaagagggctgtgggaggcctggggtattgggggtagtaggggagggtagacccaggcagaggggtcccaggggaatccagtagagctggcccacagagtcccagggatatcacgggctccaggaggaggccatgggtcagcagcgacctcaggtcctgaggcctgtggactgcagggtgacccctttgcaggctgctgggaaaggtcattttaggtaatgctctcaaaagggagtgctggggaagcttccgagctctgtacaaatattttttggtgttcctccatctatccatccatctgttctgcgaatctttcacagagcacctgcttcgagggaagcagagctggtgcttgggggagggagggtagagcaggagcccagaccaacctgcggtgggtaccctggggaaaccacacacaagccattggaggcgaaggtgggaggaggggatatgggccagatgtggtcagggaaggtgcctgcaggaggagccggcagccctgaggctgaaaaaggaccagtttgtggggcatcccttccatttcttccccaggggaagtccagtcccactgccgaaccagcggcacaccacacctgttcaaggtcgcgcgggccaggtggcaggcccagactgagtccactggggttccagggatcctgatgctgcagtagtcaggggtcctcatcagagaaggaggttctccctgggcttcacagggctgtgttttcagccaggtggggtggaacagggcactgtgagtgtggtgggtgggagatgcagccagagaggcaggaaccttgcttcttgtggagttaacaaggagggaggggtgagctatgcaggcgatctttccccagagggcagttcctgggagggtagcttgtccctacccatgtccagtgtcactggcattaaggcaagtggggtttttatcttccccggaagatgtggctttttagtccaaaaatacaagcagtccccaacttaggatggtttgacttgcagtttttcaggttatggtgcaaaagcaataaacattgagtagaagccttactttgagtactcatacaaccattcattctgattctccctgtcagtacggtattcagtaaattccacaagatacgggttagattcttttgtctacctgcaggctaatgtaagtgttctgagcacatttaaggtaggctaggctaagctgtgaggttcagcaggttgggggaagtcaacacattttcaacttaggatgggtttatcaggacataaccccatcctaagtcaaggagcatctgtaggtgttgtatcaaaagccttaaaccatcaggccttcttgcagacagccacactggccaggatgaagcagcatggggaagccttgagcactggatgtgaacatatccttgctcatttttgccttcatccccacctggtcctgagcacctgcgcttcgtggcccatgatgcaatgcagccttgagagctgcagccccgcccttcactaccccaaggcccagtggggagctggacagagagccattcagtggggatgccacagacagtgtcgtgctgggaaggcagggaagtcaggtccctgctctcccagatgagtgtgggcgtggacaccaaccctggctcacttgccagaggacgcactgtctgcggttttgtggtcaccctaccatcgcatgtccaggtgacatcgcacgtccaggtgccattgcacactggaggttatgatgcagaagtgctgctccaggaggccataccaacccccatcctgtcctgggtcccttggggccacctgccactaggtggggagcctcatctggagcccctgagttttctggaggcagctctcaggctggaacccccacctcagataggtggacatggtttccaggcagcttctccccaggctaagcccgtctgctgcatctgcggggtcagctctgggaatcaccccaccccttgatgtcctcagcgattcctcactgctgccattctacatttttctctgtgtcctcttctccatggtgctgagctttatttgaaatggcctggctgccttatgtgctcaccatctccccagcgagaatacaagctccttgacacacagactcagcttgttccccaccatgtccccctgtccccaagcagggccacacacagtggggctggattctgggagagcaaagtattgatcatagcaggttgagtgactgatcagttgcccatacagatctgagggtggaaggcctcaggcctgggcgcacgtgctgggtgatttaggagcaacgggagaagcagtggaggatgctctgctgagcagacaaatggaactgagccagggagagggtgacccactttgctgagataagagatgggctccagcctgaggacaaggggtgcagtgtttataccacagcccaacagcctccatcccttcaacaccagtaccagtgcctccgccctggttgtcccagcttgtcccagcagagagggcctctggccctggttccccatgtaccccacttgtgtccccaggaggcacgggcagtggggacagagcagggggctgcaacaccatcgaaccctaggaggtggcctaaggccacagctatgagtggcactaacccttccccagaggaaggtaatcctttttgtttctctctcaatccttctccttcaaggagaaaatcccagtttggtgccaacgtggctctcacaccctccagcaggcgctaatccccgctgtttaagcaacagccagtggccttgcctggcccctcggcagggtcccgcccctggctagtggcagaagcggttcctctacactgttttgtatttagattacttctgtctacggcgggtgaccctggctttccactgaaagtaggactatgaagtcattatgaagtacattttttaagtaaaaaaggcagtcaatttaaagaaaaatgctgagtaaaaacagcaagtgatacccaggtgtggccaggttaggcaggctgcagtcccgtggggcccagttggagggcttggtgggagcagaggcctgcagactcccagccaggccaccccgggaaatcacctccatctttgcgctttgatttctacagccgtaaagccgaggccacctcccaggcctgcttttagcatgagatgacgtgtgtgagcaaagcactcggcccagcagtggcagcagacggggtggcacggaggtgcagctgtcccctgcgtgtctccagccacgggcctctggacctaggttccctgggcaccttcctctcctcccagtggcctcagccacccgagcaggcacactatagttgaggaaagcacagcagagccacagctgggacccagagtcccctccctgaccccaccatgcccagcttccctgagaaagaccctccccggggcccagcccacagttgcccctgacctcccatgaagatgtgtggaaatggctccatgaagagcctgtgaggacactggaccatgaccagaccactggagagaggggaaatgcagtcatggggctgcagcatctgtggagcccacttcccactgggtggggccagcatgacaggattgaaggcagtgggacagaagaactgggcaacacaaaggacacctggctcctcagcaacagagagctgccaccgaggaggcccctacaggtccaggccaggccctgggaaacccatgatgggacacatggctggggcaggacagggagtgtgcagcttgtcagctggaagcacatgcggctccgataagtcgggcgtaaaagggcagtggaaagtgcttcctcattcggcgaggaggaaacctggtaatctgcaatggccacaggcacaggcttttccagaccttcggtttctaaaatagtatcatggtgggagctgatgtagggacggcggctccagagttgggggcagcacccactctttaagagatgatagaatgagcatggtggctcacacctataaccccagcactttgggaggctgaggcaggaggattgcttgagcccaggagttcgagaccagtctgagcaacatagtgagacccccatttctccaaaattaaaaagattagctgggcgtggtggcgcgtgcctgcagtcccagctactcgaggctcaggtgggaggatcgcttgagcccggggggttgaggctgcagtgaactgtgatggtgcactgcagctgggtgacagttaaaataagataaaaatgcctcaattgagcttataaccgcccaaggggttcaccttgcccgctgcctagacagagccgattcttcaagacgagaattgcaatagagaaagagtaattcatgaagagctggctgtgcaggagaccggagtgttattattactcaaatcagtctcctggagcattcaggaagcaaagtttttaaggataacttggtggatggggggtagccagtgagccaggagtgctgattggtcagagatgaaatcatagggaattgaaactgtcttcttgttcagtctgttcctgctcagtcagttcctgggtgggggccacaagatcagatgagccagtttattgatctgggtggggccagttgatccatcaagtgcagggtctgcaatatttctcaagcactgatctcaagagcagtttagggagggtcagaatctttagccttcagctgcatgactcctaaaccataatttctaatcttgtggctaatgtgagtcctacaaaggcagtctagtgcccaggcaagaaggaggtctgctttgggagagggctgttaccgtctttgtttaaactataaactaagtttctctccaagttagttcagcctacacccaggaatgaacaaggacaacttggaagttagaagcaagatggagtcagttaaatctctttcactgtctcagtcataattttgtaaaggcggtttcaagcttggcctgcaggttcccatactcacgcagcaagtcaagtgatctgagttatatgaaccatctacacgcccaaaatgtgggttcagggtaccccagtgcgtttcctcctgctggtccctgcatgctctgagctgtgggctggcttggggttggagccttacccactctgccccacatccttgtgtgaggaagggcctgtggtcacaggcatcagtgagcctggagatctgtcactgcgcgggcctcctccctccccagaccagctgctgggtgccaaggtggagctggcaggtacaggagccgcggctgcctggataaaaggcgtctcagcaaactggggtcaggatgggggtggggcagtgctgagtcatagccccgcttggggcatgccaggcagctcagcctccacaggggactccaggacagggtgagtggcaggtaggcgcaggcagccctggggtcagctccggtagggtggaaaggacttgttggtctgaaatgggttccatgactcctgttgccaccccaagcctgggacagtggacaccactggtccccacattgaggctagagagtcctgcaggttcagggtgtgtggtaggtatctggggagggctgggagcccatcgggcattaggggtgtggccttgctctcccttgctggccctgtggcctgggctgcctgccacctcttggggtcctagcttctgttaccagcaaaggtggccatctgagtggcttctattgggcctcaggcatgactgcctgtgcctctcccccagtcacagtctgggtacagttccgtctcctcaacaagcctaaactatctccctgggggcagggtctgtgtgttgaaccatcacttcgtcttggctcactctttccgtcgcccaagctcagcatggggcaggctttcctgggaggtgaggagggagggaggcaggtagctagggacctggagagtgaggggctggactgccgtctctgaggaagtcaggcacagtgatgagggagctggtctataagctgataagtcttcccgcccctggcttagccggcttgggcagtgagaccttcggtgaccttggctgtgggctgtcttcttctgcctcagccgggggcactgactctgtgctgtgctggctgttgtggaggaggccttgagcaaagctttggggacagcctggaggttacgggcagggcaggctggctcccatggcctggtgtggtcctggcgagctcaggctatggtgggtgtgaccatgggtattatgttgccccagctctatgcctagcagcaggctgagcctccagggattgtgcctggggagggaagtggttcctagagtggagggcatccaggatgcaaaggtcccaagagaggtggcagcactttccctccatgaccatgtacccatcctgactcagggctatcactcaacatctgttacaggaacagacttgagagggccacgtctggaaggagggtgatgagggcaggccgggcctgctggacggtgggtgagaagggagggtcttgagggggatgtccatgtgtgggctgaaggatctgtcccgaaaccacaggaagcaagcggccctcagcagagggttcctgagtgggctcagggcttggagatcgtgccttaggaatctttgggtaggtgagtcaaggaccaggatggagctccttaagagcctacagccaagagatgctagtttcctgaggctgctggggaggaggcaggcaggtgcagactctggcctgagcacagcccactagggcttcttggcctctggctgccagcatgtcgaacctggtgcctggccctatgtcgcactaagtcctaagcgacctcctggtgaatttgccacacccttcacgctgcaaacactacacatctgctgggggcgggggccagggactggatactagctggtgttcactgatacagtccactcatctgtactgagccctggccataagcacagcagggtcctgtaccacagggacagctgacagtccccctttcccagtacctgccactttctcctaatatgtcccctctccaagagcagcccctgcttcagcctactggctggtccctggagttccctgatcgtctccctgttcccacccagccgccactccatcaccaggcactgtgcaccgtacagctcacacatcttgcagagcctcactgcatccacttcccccagccctcacctgtgttgctccccttttatcacctggatgtttgcatccaggagcctcctctggtctggcttcagcgcagcagccagagggatgctggtcacacagggcaggtcatggcacttctcacccaaaccctggctggctcctgactcgcccttaagtgacctcctaccctcttggcaccagccacatggcctccttcctgcccctcagactggtcaggcatgctcccacttcagggcctttgtgccggtggttccctcatccctgatgcctgcttgcctccctccttcaccacctgttcatactcatctcttaccaggaggccagccccacccacctttgctgacttgcagcccgcatgtgccacccccaaccctgcccacctggagctccatttccactgtagcactgggcaccttctgccacttgctgcttatttactgcctgtagtctgactcctgccctcccacctgagcaaaaatagggaatagatcttcatctgcctcattcagcagccccagcccaagtgccagaatcaaagccatggtttagcaagtaagtgtgggatgctggagagcccctgacccatctcccttctgccccagtcgcctcagcctagctccacaccacagctggttcctcctctccagggcatctctgctcccaggatgccacatgcaaccacatgcagatgcccacatgcaccagtacacatgcagctgcacacacgcacaaccacatgcagacagaggcatggacctgtgcatgcacacccaaagatgtgtacatggacctgctcacagacatgtacatggatctgcgcgtgcacatgaacagacacatgcacacactggcatacaagcaaccagacacagacacatccatgcacctgcactctcacagacacaaacagggacctatgcatacacgcacacataccgcaatggacctgcatacacataggcacctatgcatacacgcacacataccacaatggacctgcatacacacaggcacctatgcatacatgcacacgcaccacaatggatttgcacacacacagggtcctatgcatacacacacacaccgcaatggacctgcacacacacagggacctatgcatacatgcacacacaccgcaatagacctacacacacacagggagctatgcatacatgcacacgcaccgcagtggatttgcacacacacaggcacctatgcatacacgcatatgcaccgcaatggacctgcatacacactggcacctatgcatacatgcacacacaccacagtggacctgcatacacacacacgcaccgcaatggacctgcacacaggcaccacatactgccacaaacatgcaggtacacacatggcttaaaacctttcagtggcgtcctgtttctcttcagtgaagaccaagggctcagttggacttctggtgagccctgccccttcctcttgcctggtacctctctcctcctctccctcagtccagccactctgaccttccttcagttcccctttgtgttagggatggtttgtccctttcatccctaacacacatccccacacaccgcagggccttacagcatgttcctcctctgcctggcacactcttttcctggcccattcctctggtatttctagccatgcccagaggcactgtggtggggggtcctgggtgttgagctctagtgatccatcagtggtttctgggccagggaacaatgtggtcatcaactcttggcctttgtctcttggccaaccatcatcaggttccatcctgggacttggggagtcctagcatgtccagtaaagcccgggttagactcagagagagggctggctagagccttgtgtaagagccaagaagtcaagcctcagaataggtgggactgtcataaggtcccatttgaaccacagccaggctcccaacgcaaggcttccttacatccgtgcacagccctgtcccatgcgtggtgcccctgcacagggcgctcatacccccaaacacaacacagccccacagagccgcagggagaattctgggtggggccttctgcttgtttggttcaggtgatctgaaagacgagggtcctcaagcaggggacctccccttggttgtgactgttcgtcactgccccatgcaggtgacagacttggccctgatgcatgtgattgctacctggcctcagtttcccctttccttgcacattgccctgtcgttgccggcgcacactgatcgaagactgcatgagcagcccttagctccaggcttccagacaacagcagttcagggcccaggctgccagcccagtgtccccaacctgctctcctgattccccagccttggagccagggagcacatacatcccaaagcacaaatcacacatccttggacagagcagcttctctgcccaccactggggacagaaggggcgcctggctgtacctcagattttcaaacgtggaattgagaagaacagtcatgacaacagaggacacctcccactgggttggacactgccttctgaaaggagcatgttggcttcctgctggaatgatggtgctggtagggagaaccctgggtccccaggcagtgggctgagggctttggacacctttccacacctaaggggctgtcaggtcgtcagcagggacaagggagcagccacagggtctccatcctccatgcgctcatggttcgtgtgcatattacacatatcatgtacatgtcatctttaagcagatgttctgcccactgtgtgctggagtgggagggtcatctcaaggcttccattctcagatgtaattttcagcctcactgggattgggctgagtgactgtttaatcactgccctcttggcagagatgtttctagggcgttccctggtgcacttctcatcggtggctgcctggtgaagcgggaaagttcctcagcctctccattgattccttccctccctccctccttccaccaaccagtgcttactgaacacccactgtgcactgggcactgctctgttcccagtggggaacgaggccaggacgggccctcctcacccgcactctggctgggggtaggggcgacggcagcacacaaggtcatgtaggtcacacattagctgagggctgctatggaggaggaggacagagggcaaggtgacgctcacagcgacaagcacagcagggcagtgactgctactggctgtcactctctgaggaccaggcttgtgctggacgctttactcttcacagatacctgtggccagtgagggacaggctctgagatgggagtaagtcgccagaggccacacaacctgggagaggcaagcaaggcatgaaggatgagaccaccctgagagtggtgggggtaatatcagggtctgaccaagggaaagaggcggcattagagcctctggctgtcagaggctggcagggctagggagcaggtgtgagaggccaccaccactgccaggagagaccagaacctctgcccagggagaggacagcccaccaggggcctgcttcaaagcaggatcgccaggactagtggtcaaggtctgtgaggggcaagggacagtgaggggcacggatggctgctgggaggatgaagtgccatttgctgagggtttagcaggttgagtttcagatgctggtcacacccaggagttgagggtggggccttggctgttggggtctctctgcctcgggccttcccaccccagggcctgtcacagagttgatgggtggtattaaaggggcgaatgctgcctgtggcaggatggggaggctgcgtgggtctccggacagggacataggtcagggaaggagcaagaggggtgcgtgtgagttgggtggggcctggtgccaccctgggctcacagccggggaagaagcctgagctttgagctgcccctcgtgtggggaggcctggcctaagcacccggcaaagtcacaggggcatcctagggtgtgcccctccctgctggcaggaaaggtggatggggaggccctgactcgcggggttggtgaaagattctgcctgaggcctctaggccaccctgccttgccctggcctcggtgattactactacccttgggagccactgtgacatctggtctcccaggtggatttccccgcagcaccacgtgcagcccccagctccttggtctcagcccaagcccccctctacctccttctgcaggagtgaggcagcccctgcccactgtgcttaggcacctcacggtgctcccacagcctgaagcctccaccttgctctggtccctgcctatctgctggctcctgggctggcccatcagagtgccctcaagggaaagcaggggccaggtctccctcctggtgcttttcctccctgtgatcagaagtgacccagctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccatggtgtgggccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacagtaagtggggccgggggttttcctctgcttgttcctgctgtcgtgggttcctggaagcaagaggactcgtgaggtccaggacagtctgcagccagaaagggaaccaggcgcaggcctggccctgctgcacgataactgaggcagctccagcaaggtgggggcagagggaacagggtgtggagtgcaggtgtcatgtcccatgcctgaagtactcagggtgtggaggccacagggcaagagagtgtgaggctccgccgggcatccatgatcaatccatgtgatagtttggcaaatccatgaagctcctgccagcaccagtctcctaccagcatataggtccaggaacagcagccacccctgcaaccccatcttgagtctgcaaatctggcagagatggggttaagagctgtttagaagggataatcccaggtcctggtggaaaggggacgacgtaaaagcaggtgttgggattctttcacagtggcatgggcgcagcccgagggagacctggacccagtgtgaagcggtgggggcttgagagtggagttgctggagagggtggggagccgggtgaagcagcagggcagtgtgctgaggcccagccaggacagaaggtctagcacacgaagggggccacagccaggagtggcagcggtggaggccgtggcaggcaagggaggggctgtcttgcccagcaggattccctgagcacagatttcaagtctgcccttaagagagaggcctttgaccctggggatgggggagtgggggcaaacaaggagtcacgaagttgtgggtaccctggggctaggggagggtgatgctgggagacaagggctcagcctctccacttgggagcactggcctccgaggtcactccttgcttcacccagtcctaaggcaagctttattctttaggttcagcggagagcaacaatggttctagctttggacctgtgccccagccagggaacctggacagctctaggcagtggccatggtgctaggagcctgagtgttctgagagagaggatctttggctttcctcaggcagctggggaggcgggcttgcctccctcccctcctcgcatcaggggtctccctggaactgtgcctaggtgttgatggtgtgcctgggggaaacgaatgacggacgggcaggcaggtgtgtacgcaggcggctgcgtccaccctgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcctcacccatcaccacagtggcaggcgtggcaaattccccgggcaccaggcctggctcccagttgcatcctttgacaggccgtgcccacaggtgtgctggacacaggaggcaggatacctgggtcctgagtcagtccagtttttcatggagggctttggctgtcatgtttgctttctgaacttgtcagtgaggagatgacccaggtgtcttcacagatgggcccaaggctaggcctttgcctgcctgcagccctcttggctcttactggcctgtgcctgccaccttgctgcctctctctcctctccttctgctctagccgtggtcagcttgttttgctccagcagtactgctctgtccagccttaagcttgtaatgatcctgatccctgcctctcgtacccctgcccttatcctccaggtctcatcccaagtggcgcctcctgggaggccttttctgacctagcccggcacctgcttactcctccatctagtgatgtgtgagtgagctcctcggggcaggccctagatgggctgggtggcccctgtggggcctcacatctctagctttccctctcccaggcctgtccctggggagagccatggtgggcagccatgggcagggacagcagccactggcctggtctcagggatccctgtgaggttccaggcattcaaggcactttctaaagggaggggctggcagccaggctggcacacccaccaccatcaccctggtttctgcaggcctggggaagtggttgttcaccagaaaaggaaattcttgatgagaaacccaagcgaggctggaaattcactggattccaaatgattctgacctttcatgctctaccagtaatatctggagatggaaaacaaacaggctgcagaggaaagacaatcccctcccgcgattcctcccgcaggctgggctggccccggaggtgagctggcccccagagtggtgccggcagtgaggacagcccgtctccagccgggccagggccagagccagtgctggcacgggctggcacagggctgccactctgctctctccttttggaacgtgctgaactgtcctccctgggccctgtcaaaggcaaggcagccaagaacaggccatgctcgttttcacaaaagccgaatgaaccttggggcccagtgccagggctctggacacggctcctccatagccctccttccgtgctcagcttccaaggcctcatcttccctgatgctggcagtgcctccccacccccacgcctggcgaaggagccacagccccccggcccacccgctggcttctgcgtcagcacgttgccaaggagaacgtcagtgtctctgggctcccgggtgtgagggctgcagtgagtgcagggcagcacctcagagcagggaaggcagatttccgggtgtctgtggagcatggcagcgagccacatggggagccacgcccctccatgcccacggttcccaccctcgtccgaaggaattggcagtcccttgccctgactagggccaagtcctgcaggtgtgtcaggcaccccagtgcccccaagcccaacacccagctggggcttcctcaggcagcacaggaggcctgaacacagcccagcaacacaagggggtttttctggcgcacctgtcccctgaatgatcctgtggggcagcagcgcctgttatttttgtcacagatcgaggcactgaggctcaggcacacagctggcgctggcgggcccccagccctcaagtccacaaggacagctcctgagaggccatgtgtcacaggacccaccacgggcctcccacttagccagagccatggcagaggctctgcccctcgtctttagtacattcacacaagggtcagtcagcaaagacagtcactctgctgccctaggagggaaaggcaaagtggagaagctggcacctaccagcccacactgagggacagacacaggtggctgtgaccagcagagcctgggtcttcactcggccccactggaggcacctgagggggtaggtgggcacttgttgcccaacctctgcccttgcggatcagctaatggactctgctggccaccaaatggtgtgggatccttcagaaggcaagattaaaaggtctagttgtaaagcatcaaatgttctcatgtggaaacccacagggagctcactgcccatttcccgacggagctgtcagcattcccagccctgtggcgggtctgttttgcacctgtgatggacctgctgtgcaggctcaaggctcaggctggggccaagtatgagggtgagcacaactctcccagcagcacagggaactgggggacaaggaggaggcagtcacaccagcccagctacagcttcatttccacaaagcctctgctaccagggatacctgccctgtctttctagagctggcaggcagcagttcccagcagtgtccccattgtgctttcatctaggacccacagtagtcacttgggccccacaggcaggctgggtcacagcagggttcaccgtgggaggcctggtgtctctgccacttatctgagagacagctggtcaacatgttatcagtgagggtatccaggggacgggggacataagaacatgccttttgtggggcaagttctgcaggtggcaagtgcttgagcagccagcctccaggcaggtggtctatgcctggccctggatagtggtcccttgtcctggggccattggcttcctgaggaacccctccccactccagggcaggtcagcagcctcagcacaccacgagggcaggtccacacccacccggcacagcctgtgctctgagcagagggcctggcacacagtgggtgctctgcagactttgtggagcgggcgggaggcggtaggcttgggaagagctggagctccagagccctggcttctgggtgcagagcagctgggacactcagcccttcccaaggagaccctatgggtgctggtccataacaggagtgtatgcagtaccctgaggaggggctgcccaaggccgtcctgtgaacacagcgtgttcctgccaccctagcgctgtggtttatcatttagcccaaaaagggtgcttgttttagtgcttttaaaatggagtttaaacatttgtgccataaaatggcgtgttgtgggtgaaacaaggtgtttccagtaagacaggcttatacctattgatgacagagctggttatatttgcccaaggagggaattacaaatgggcaatagccagacacagatgataccctctccccagcataccagggcttagattgagaagggaccttatatatcctttagtgttcctaaccagccggctttgcagatgaggaaactgagcctcagagaggttccttcacataccgcagggctgagactctggctctcagggagggtcctggcactggcccctgggaattccagtggcccccctcttcaccatactggtcccacatcctgtgggtgctggggttctccagcaagggccttgggggtatagactgggttccacccttggagctgctgtgtagccagccttccctcaggagagtggaggacagtgacacctgggcttgggagaggtgagtggctgtgaaggttgacactcccctcgtccccttgtctcctggcctagtcagtggcaggaccacagggagccctagcagaacatggcctcactctgcctcctgttcctgacctggtcaagggcatagctccaagccagaaggcctgccgcccttttcccgacacacacaggtctcccaagcagttccttctgatcttgcaatgtgccagggccacatgcagtttgtctgcagcatcctcaagttatcatgaccctggaacagcagagcctcctgaccagatccagaggcagggccaggctggcacactgggctcccaaggactggacagcccccatggcagtgcagcttgagaggctccacaggggtgggagacacagaggaccaagcccacagcagcaccctgatggcacctcgcatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccaggactcagccttaactggggctgcggccacctcagtgggccttcagccgctctgagcctgtggccagtgctcagtgaatgatgggtatctgctcgcctagggtcccaggctttatgcgtgaccccatgggatgctggctcaagcccaagatgggagggggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgctcctttcctgtcacactgggagcttccaagggtggggccatttcttagcccgccttgtgcagtggctccttgccctgggtaggtccttggtcagaggtcagccacaaggcaagaggcggcagggccctgggctcaagccctgctgcttgggctgcccccacacctgctctgcctgcagggccttttcctttggcccccaactcctcatcatcatgaacctggtggctctgtcgttcagtgcatcagccacccctccatgatggtcacctcctgctgtgtcactagaggccattcccagggcacaagctgtcactgaacacagcagtgcagcagccaggaggccaaccccatcactctgtctcttccaccatgatgacgttgtcaggtgccttggcagaacctccatggggatgcccatggtgttcctcagatctctcagacaagtgttcctgccacaacaggaggtcagccagcgtgggctctgctggggcctcctttatgggaaggcaggagtcagtctcttgccctagtgctggtaagccttgagggaggagggaggagagaacaagagagttctcttcggcaccatgccaggcagggctgcttcctgcagaggagagtgctgagacccagggctagtggtggcagagcctccctctctgcatgccagggcagtgaggggctagagctggctcatactggctcacaagagctaatttttcaattttcaggatgtttgtgagctgtttgacattatatttgtggcttcaaagcagccaggtaggagtaatcacaccccaggaactggcaaatactacaaaacagttctactcctccccagcccccgcctccatgccagttgttagacctttaccagtgcaccacagccagtgactcccaagcatggcggggagagtctgccagccaggctcagtcactggtgtatggcaggattgatccgctactgccatcttactgaagaacccgacagtgtccttgcctgtcagtctcccactgtgcttccccagtgactcccagctctgaccctgtggccgcgtgggttgcatctgttcgtgtttaccccgctggagaaagggaatttgccagagcggctcttcacttgcctgcctccctcccgctcttcctcggcagatttaagagaatcctactccacagagagcaaccttgcattggctaacacgagaccacaagctgggggccatctgatgttctccatctgagaacaagccctgtggcatccttgcaggaagcagtccttgttcacccagtatgtgtgggccctgggcctgacaaactcagtctagggacagaggcagtcctatcccttcctccctcaggtcagctggggatggcatcaagcaggccctggaggacctgtgtagccagggctggcctcaggctggcttccccagtgcctacaaatgctggccgcatgctctctgtgactggccctgagcctgccctaggaaacagttttctaggtgcagagaagccaggaacaggtgcctcctctgtcccaaagaccaacatttgcaggagagacgggggcctagacgttgggagcaggcctgcacagattgggatgaacgtgggggtggtgatctgatctggaccttgcagaatccagtcaaggctgtgggggagcagtggggacagtcaacaaaggcaggactgagggggctgtcgggggccatggagagcacagagctatgcacagtgccctgcagcgggatgacggaggaccaggcggtgtaaggtctaagcaggcagggcaaggtcgcaggcacagtgtccagtccccagtgtggcccagggtgggtgtcgctgcctgagcgccctgtgatgacggagccagggttcagccccaggactgtgtccctcccagtttatacacctcctgctctgcctcgtgatcaggctggatgctcacaatgataccctgtctgaactgttccaagagcttcagggcagagctgcttcccaccccacatcccctcaacctgcatcggctaggcttgcccaggccagtgggtaattaatttcctgagcgcattagctctgctcagtacacacacatgagaacagctctgggttttaagacacagattactattgttttaagggatttgtataatccagtaactgaaaaacaattttccactatctagaacagactccaaggtggaggctaagagtgctgggggccttgctgacttggggatccctagtaaccagtgtagatggggggatctgccactcaggggagtcctgtgactggccatgaacaagacaagcagtgaggacaggatgcagcagcaaggctctgtgctgaccggatgcatagccctcttcacctgaggccccactggctcagtctagtttctggagggattggaatgacagtcagctagggtgcatggccctgggcatctcaggggggacacccagtgttggccagggcagagtgaaaggtgtttcttctctctgcatgtggctcccgtctggatagtggacaagcttaggccagcccaggagcctggctgcagctcaccctaatccctgcttcatcacacctcgtggtggacatgtcctcagctcaggtactttctctaatttcattaataatgaaaccagagtcgactgggggccctgggccttgtatcctaaggttcccagcccaggccggccagggccacagccccacacaccttttcctggcctgtggtgaccaggggagaagcacagcagcatcctgaccaagggggcccagagcctcgaaggcaacttggctcagctggaggagtgactatgggcaaggtcctgccccacagggccacccagctcaagcagtaacaacccaaatatgtttttttaaaggatgaatatttttgaaaaccatctttttggccataggcagaggttccccactgggatctctccccactacccccagtttctcatgtccctcccaggaaagagcctgagcctgctgcagaggggttcacaagcccttgagcctacaggtgtgggtccgaggctgcagtgccagcggctaggagtgcagagtgcacccaccttgctgaacaaagcaaaggcaaaccaggcaagggtgtcggccttgggttcctggggatcctctggagctgaaactaggaggggtttctcacactgtgctttcttcgcatggtgatggcgtgcaagctcctggccaggcctgtgtctgtgttgacagcttccaatctacaacacacctgtatcatgctgtttgttaatttcccttcagcgactgacactggctggtggggagcaggggtgcaggttacttaaaagcagcaagatttaacacaaaaacaaataggagacagttctcagctgaaacagaagtggactggggctttggaagaggccagtcctcccagttgggcaggagagcttatggggtcaaggtgagagcaggtgggacccaggtgctgagggtgcccacggcctccctttctgggtctgggtgtgaagccagggagcaggacacaggagctccaggccctttcggagcaaatgctcccaccatcttggaattttctgtcccaggactgggagtctttgagcattgttaaggcaccacctccagtcacgtgactcccgccacatatcacacttaccctggggctctgcctcctcagcaactttgaccaacacccttgggaatacagaggctcccatttggacctaagaccctgcaagtcagtgatggttgagatctggtgagagcaaaaaagcaaaacagagtgacatgagggtaaggggggtggcgccttgggcctgtgctggagaacagcagccacccacctgcagggctggacaggggtgccaacatcctggaggctgcacacagacttctgggagagctctgcccagtgggtgaagcccagctgaggcatgagaaagtgctctgtgtacagcaccgtctccatctcacactgggccctggcactgtgggtggggccctggcctggctgtggcccagggtagtcatgtggacttgtgtccatctggactgcccaggtgaagactggcccagcagcacagttcctgagctcctgcccctcccctggctagtgaggaggtagggcagttctggaagtactctgaaggctcaggctgtaggataacatgtgtgtgctggctgacaacagaatagtggaaatggaaggcccagagacgtgagcggttggcagagcctggcgcagggcatgctggtgcactgcatgcacaacctctaagcctcccagcccgaaggggctccccaccacacagatgaggaaactcgggtttcaggaaaagttgtccctgtggcaaagtgggggccttctgacctggacatcccgctgctgcccaggggaatgggcagggctgggaagcagccacccttgccattactacgggtcaccccaccccctccacactgcacacacagggaaaccagggagggcagacaggactgcccaggcaaggtggcaaagccgaactgctgcggaaggcagggagcagcacgctcagctgtttctggcaggttcagagcaagggcttttcaggccattagggcctgagctagggctttagcggcagcctgttatcttgtttaaacagcccttgctgtttgaggtgccaggcttagctggtgctgttactatgagcactacagttgtcaccaggcatagttgcaggggggagggggccaccggcaagcagaggctctgacttctggactcggctggaacacacccctgccctggcccccatcccagaggagccccatctgtcgctggcctgggacctacaggcctgagtactctgtaaaatgggcccctcccaagctgcctgtgccctcctgagctgcctacatgggcagctgagcagccctgtgcgggtgggcaggagcggtggcctttcttatccccagggaaaagtcgagggcctcatgaaaacccagggcctgagagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcaccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtctgggtgtgaggcctgtgccccccgccctgatccagcccatctgtgggccaggagcaggtgcatctgtgcagaagggtggggccaggggcacacaggtggggagcagccaggcaatcccaacccctgcccctgtacacagctgccacaccaaacgcctgcagcatgtgccatctggccttgcctgccatccaccccgtgctgggcagagcaggggagagcggtccccaagcagacagcactgctcataggcaggccatgggcaatgagaacaggggccaatggtgctaaaagctgtgcagcaaattaaaagggttggggttgtgactagggcttacttcaagtgaaggagtctgatagctgaccagctacacaaacccaaaagagcagcccatgcagggtagcacagcaaaggcctcgaggtgacagagacggaagcaggagtcaggagacagccgggagaggcctggattacacagcctgccatggaaggcactggagggtttgcacagggggcaaccccagagcagaagcaggtagatggatcctgaggagacatgaccatggtagaatgggaaggagattgtccaggaggtgccctcatggggcagaactcagagccatagcccaaaactggaccctgcatgcaatgtcccagggccccagcttcctgcctcataagctgtgtcatggcctaggacctttcttcccaggcaggagtcagctccacctgctctctggctggcacagcctggtgctggccaccccaagtgttagcatcctctgcctgctggagaggtggtgtccctatttggggactcagtactctgaagtcagggttttgccatgctcttctctgtccttcgaggcaggagacatgctgtgcatgctacaggagcttaggaattgtctgagggtgaccagtgggggtccagaggaaaggtgctaggaagacatggaggcttccaggggaggctgggcctgaagctcagctccatatccgatgtgtcatcgtgggaagagcagtgtcttcatgaggcctggacagtgcctgggtgggagatagctccagcctccttggaagacctattgaccacgtttctcttgtgacgcacttcactgtcacccagaataactgctgtctcacagctaccaggacccgagcctctggggtaaggtagagttcaaggagaaccaaggcagcccaagtgagcctggcagcagagccgagggcagccccaccaaagccacggagccagccctgctggcatccagaggccagggtgggcctgccctcccatggccccgagctctgcccccaccctttaggattgcaccctgccttgttaagggatcagctgctgctcctctcaggtctttttgggagtcctgaatctgaagtgagcctgggagaaagggagtcagacaggagaggggtgggtgctgagccaagtgagggtctcaagaccaaggggaccccagagcatgggtacccagggcctacacttgggaggcctgtggctgggccaggaggatgaaccagtgtggagttgagagccatggagtggcagagaatgggtgccaggagctgaggtgttcaagctggaacagagccctccgtgcaggcagggccgagcctgtctccctcagcatctcagatgctcacagaaccacgggggcagcagggttcagtgttaaaggccaggctagaggaatggaaacagctgccccagccctggaagctgtgggagtggtggttgccctgcaagagaaggctcagagcataggcaggccttctgctgggaggcaggacccagcagttgagcaggtaccagccccccacctctcagttcctgaggctggccgtcagcaccatgtgccctgtgctgtccccgcagactggctccagggacagacaggagctcactgagtcattaaccctcaatccaattctccaatctgtcaaggtagcattgaggtttgcgggaggaagagggaagcactaaccagattggactgtaagtgaccctggtcatccagctctgtccccagacacctccccatttcctgaggctagtagcagtgggaggatgaccaggcctgaggggtggttcgggctgtctggtgctttccttggggcaagggtagtgggccaggcaaaggggcctaggcaagccaggtaacccctctgagcaccactttccacatctagaatggaaatgttttgagcctcgtgagcccaggagcctctcacagtcacttctcggaggtgaacagaactggagggcatcacggcagcccccacacaagaggaagtccagactgacgaggccacagggtgacaagagcgagccacgttctggggccctcccaccaggaggcccaccccacccatggtgctccagccaggaacaggtcaccagaggtcctcccctctcccctgcccactgccctgtctctcagggcacagcaaggcaggtccttaaagagacagagggagagcagggtaccctcgctaccagagaccctctcccaccacctgagcagatgggcagtagacagtgtttggccaaccaggctgtgtgcccctgtgggcacctgccccagctcaagggtcagcagcttcacctgccactggtctgctgtggtgtgagactctgagggtgagggtgtccaccctggttgtcatagaaacagcagtgcgtctgcagagagttcatgccaagctcagcagagggaggaagcagctggcctgggaggcagctgttgtcattgactcctgagagctcagtgttgggaaggacccaagggcccaccacactctgaggctggcgagcacacggggcaactcaggcctccctgcccaccatctttctttgggcagctgcaccatgttgtctgtcctcttgtccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtgggagaattaggtttcagaacacaagacagccagtacctcccaggccccttcctcagggagccagcagggtcgtgggcaagcggccaggctccacagggcaagcccctttggacttaaccctgtttgtgacagccctggtccctgacagtcctcagatcccggtggcagtgggcagtgggctgtctgaaaccaaggtgctccttatttccaaaccagaggtgtctgatcacagagtgtgtcactaggagcatgttctgagaagccagggagcctggtgcccaggttcccatccttagaccagtcctctgtcccttgcagccttagtctcatccacagcaagactggagccttgggggtaaccaggaaaggacaggcactgcccctggcattcatgcagggaccaggagggccagaacacaggcaccctcagcctcctgtcttcaccccgcagcccaaaggagggctgcctgacctccgggcctcacttctctcccagcaccaagaaagaggttcccagctgcatttctggtttctgaggggcccttctgcttccccagctgccacagccccaggccctgcctgggggtctctggaggaagcagaagaggcatccttcggccccgccccaagcacaccaggctctagggcccagtgctcaccaggccgtttgctctttgcctcccaagaccgtgggaggtccagggacctggtcagtggcaatgccttccaccaggtacatggttgaagaggtgcggggagcatgccagggtgcagccaggaggccagatgaccacaaccaggggtatgacagccctggacacagcaggtctgtggccacggcaggagggcgagatggacacttagcaggaggctgggctgagctcctggtggagtcagggtgggactgtggcagggagacccccttctccagcaaggacagggccacttcctgagaaatggagcatcggacaaacaccagcggggtgggaatggcaagtgctcaaggtgagcacgatgcagctgcgacctgtagactggctgcaatggggagcctggccaggagaagccagagacggacaccaaggtcagatcctgaagcacagaagaccctcagtggggatagggacctggctgcagggagcaaggtggccagtgtggacccatcaggaaggcaggggcctggtctggggaccccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagttgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctgagggtagatgtaggccaagagcttgcacctacaagcttccccaaaagggaagtgaactcaggaattcctgatgaggattccaggactggctggggaagcacggggttgcaagcgaataagctatttcctttgcgactgataccatccttggagtggatttcctctggtgccttccctgttccacagctgcagaggcatctagcacagggggccaacaccacaggcccctccactcggtacacctgccaggacctcggcgcatcatcagatggtggggcccactcgccctctccccactagagaagtctgggaatgcctgtgtcccagaccccctcggcagcactcaggatggcccaggcaggttgcagaggctcctgcccaccaggcctgtcacacagagctctgggaaatggagatgggcagtcagtgccagccaagggcaggcacccgctaccgatggaggcatgttggtcactgtgtcagcagtgccccatgtccctccagccacaccctgcccagcagacaggcagccccaccaaggtgtccccaagcttccaccacaaagggaggcccagaggggtgagaggcttggccggtactttgtgaaaggtgacagcatgaagctcatctctgtatgaaacctctgcctcggcccctcagtcagggtgctgccctcagagcctggtactcggtggccctggtcaggcctggtggctcagctgcaggctgggtggccgcagggctggcctgtccatggtgaatggagcgcattcatgtctacaaccccgccccacagctctgctctcggcgtgaaaaagctgaattcacggttcggatgaacactcccagcttttctacagtgggctgacttgagcttctcagtctgtaacagaactgaggacttgctctacagatgaggaaactgaggcccagggtgggacagaccggccccggccccacccttcccagcaatgcggctgcatccccatgcctctgtgcctctgccagcccctcctgcaatgccttcccttcccctcagcccccagaggtccagtcaaaacgtcctgctcttgtattacccctcgccccctgcattcctgtggtgtgtcacctgtcagagttgtagctggccagcactatctgcagcagtgccagctgctcacagtcacttgtgcctgggtgtggggactaagctgtccatgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaaagggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtacgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgcagggtggcctcccacacctcagtgatgcctcggtgacccctaaggcagaagatgcgtgaagcaggcatgaggccctgagcactgctggccacccctgcaaatggaggggccccacctgaagttgggggccggggctcatgtttgagccattttgactgggtctttttcagtttattttctaaacctcagtttatttgaagcacagtacatgattgctcacttcaggaaattctgttcaagttttcctagcagagttactcattccttcatctgtgcaaggggagggtggtggtcataatcaccaccctgatccccctaccccctgggccctgtgtgaagatgacaaggcagtgcggttggctgagggcctgggccaggccaagcacaccaggaaggtgccgcgcatgtgccagatgggccctgaggccgctggggtcccacagcaaacaacaaaacagtcaaacaggtgccagcctctgtcatgtgctcaccacgtgcccaggaccacgtctgtgtgtgcgtttgcctgggtaagccttgcttcgtgaagctgccatgacctccgtctcctcactgaggggcacagggcaacaggctgccaggtgaggggctgaggggccttctgggggccactggcctactcgaggcacagtgagttgtgggaacgaggagtaacttggaggtggagctgcgggtgcagagggaaaaagacacctgggtcatgaagggctggcctgtccgcctgaggggcccagaagtgcagtgaggggatgacgtggctacgcgcctgtgacagggcacctgaggacatttgcagtgcaggagggagagcgcttcagagcaggccagtgtccctcccacccggcccagtccctggtccctgggtagtcactgagctacctcatgcaggaccatggtcttagcaggacacctgtggtggcctgtgaggcagggacaggaaggatgccccactctgggctcctcagggagctgcaactacagtgcaggatgggctgtgatactcagcactgtggatgtctgtcaaggcagggtgtaatggactggaggtcagaacgtgtgaggccctggatgagcctctcacctccccacccccagcccaggcgcttgtcccacacagctgccttggatgtcattagctggaaagccgtgagtgcctgatggggaaggagtggggtgtggggaggtgtttaggctgtgacaaagggatgctaactccaaaaacaggcccccagtccagaggcctcttaaaatgcaaatatgccgcacctgggagggggacaggcccctggctgagatgaggaagcctggaggatgcctctgttccctctcccaccgcaggcccatgagctctcagaccagcaggaggctgatgctggaatatgcgcgcacctgctgggggatctgtgcgcctcagctccaaagtacaggagctagactccagtgtccatgtcaggtcccatccagctgggatgcaggaaaccaaaggcagccctcccatgacccagcactgagggccagacctgttaccaggaacgttggtaactggaagagcctggtacttggggctgttctgtgccccacaaacagagggaccggctgtaaggagactggcctgatggggaatgagaggggctgagccagaggtgccgacacggtatgttttaagtaaggtccaggtggctgcaggcgggatggaaacacatccaccattcatcacatcggccattgcatctccaggctaaggggccacaggagcctcccaaagagccaggctgacctgggccctgtggccagcaaagaagtgttgctggctgaatccccatctgcagcatcgagacctctcccactccgtccggctgagctggccctgcatttgggtagccttccctcagctgcctcatgctgggacagagggaagcaggtcttccgatgagacctcgcaggtgagaggacgtcccagtgccaaggcgaatcacagtgggtgtggcgtggagagggcccactggggtgccagtggtagccacagggcaaggcccagcagcttggggttcttcccgtgtcagcacctttgtgccttctcacaacagtcccagcattgtacagatgaggaaactgaggcccagagaaaggaaatgacttgtccaaggtgcagcatgcaccggcagtgagtaaaccccagaccctgtgttcatggccagggacatctgcccctttgtgtcaccaggagaaccttggtggagaatcaggagtgagaggcctcaccacccccacaactaaccaggcgcaggctcctctccactccctaccttgccccggccgctgacctgggaatgtccttccaggtgccggacctggtctggccagcagtctggcagccacgttcaggggaaataccccagacccgcaggccagcaagctggaagccccttagggatgggctgtcagctcccctgctgtagtgagaaagccacggcctggggcagagtcccttccacaatggcaagtctatttggacctgtctgagcaggagctctcttctcacaaatggccaggaaatgacttccacaccaccccagggactgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccaccccccgcggctgccttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggggcagggccacatgactccaaagctgcatccagctctaccccagtggcccacaggtgggctgcagcaggacaatgtttaaccctgccaggccagggagggcaaaaccccatgcaggccaggccaggccaggaaggagaacagagccacatccaccaagggcaggaggacccaggggagcccacaaaggccagatgggtgcaggaggcacagccagtcatgttttgcagggtgagcagagcatggacaggtcagagggctatgaggccaggccctggaggccagcagaaggcatgctggggcttcttgcttcccatatgcatgcttgagtcacagtttccagagctacagcttcaaatagacggctctgttttcagtggtggtgatttgagtgtcaggatgccgctttgcccacctgtctgcactccaggctgcaagagtgcaggcaccgctgtgacacaggctcccgaggtcaccaggcaagcaccagggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccagcaccacactgtcccatgctgggccctctgaccttctttatagccttcctgttctataaagattacaggatgggcacccaccatctcctaagcttcacctcctactagggtggagcccatgtgcagtgaaggctcagcctgcgtcagggacgctgggatggagtgaggcggcaagctcaggtgcttcccacgctctgaagcttcctgtctgagcccggaagtgaggtatgtggttggtgcctcctgcaggctttcctgactcctgccagacagggcccagccaagaaacaagaccaggaaaccaggcgtctacacagagattttgttattatttgaggcccatcatctcctcggtgcccactaaatattagtcagtgtggttcccatggtttgtctcaaggaatagaggaaaccaggaagcctgagcctgaaatgcctgcaaagcaaggggagtcctgggcacaagcaggggcctgagctgagggaagggcccacactcgggagatgtttgtctgtcctgatgaggctgccgcagtggcggaatcctgataagagtgtactgtgaggcaccgtgcccacctccagctgccttgtgagataagtacctgagtttccatgacctctaagtcaggaacaggaggctcaaagaggtgtccagggtccccaaggtccactgagaggcatcagcagggaagcagtttagacaccatggaaggggctcctagtgcattgggacagcttgactcaccccaggactcacgggggccacagtcaggagtgtttcatggcgttggacaagaagagtggctgccttggccttggagagagggggtccacgtggtctatcggcccctcccactgctgccagctgagctctccctacacacaggtgccctgcagaggaccagtctggtttagatctgaggcttcagatgaccagtacacgtgaactgtttccgcatcagtgaggtggccctcctgctcctcctcttacctaaattccactgcctgcccaggaggtgatgggctaagctgggtattaaaaccatctcaactgtcatccccaagtgacccatcagggctcagagaggcagacccaggcctagcacccactctgtgcttgtcccctcacccttgaacccccaggtccataccctgctggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcagtaaattaataatacgtgctaatggtcatatctgttatttaactgatgcaaaatttggggtcagaagcatagcccccaattacagcatcatttctatgagaaatgacagctctgttaccacagtcctctatgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgcagaaaggccagcacccccatccccagacctgaggctgctcactcctcaggactcctgttattccgaagctcattctaaagaaagagcaagattggtttggaaaaacagtcttccaggtggagtgcagggttccagggtaatgacgggtacctctgggtatccttcctttctctgcacagatgctgccagagctgttcctcagagaactcaggggctctggagagcagggtttctatgcagcatcctcctgggcacccctgccctcaggcagcctcctttgggcccaccctgtaggagcagcaagccagagcacctggttgtggggcttggagcacatatcctgcctctctgtgcctcagtttcttcatctgtaaaacaggagtgggcagatgtgagaacagactggcagctcgtgtccagctgtggttaccagcgtcattgtcactgcagtcattggtgatgctgttgcttcgtgcctgagtcatcactaccagctgcagttaccacttgcattaccacggtcactggtgatgtagtctagtcagaaaagttcctttttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactgtgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtgaactggggagtcagacaagagcatcatgcttcttaaaagcccagacccctggctataacacatcgaagattctcagaagagaattgaggagcggacaggcgccacactccgttgtggtcactgcctcttcctggcccaccacactcctgtcctctgcatgtactgagagctctgtccaggatgccagggtcctgcctcggcagagaggcggtgccagatgccccacagcagctggtgggagtgcccacagctggagggcaggggaggagcctggcctctggctggtgtttccttcccagctctcaagaactggagactttggttacagaagtgaaggctgctccctcacagacttcctagtgtccgatggtaccacatggaaggatcagagttttgaaggactgggccagaacccagatagggcacaaggctgccagcgcctgcattgagggagctatgatgtgacgggggctcctgcagaagatggccttccttgtacaggtgtggggcagcctgtggatgggcagtgggaagatggggggtcctcggagctggaggtgcccagcggtttaggaggctgtgcttggcacatctgtagccccaaagctatatgttgagatcactggcacccagaggagagacccaaaaggggcaagagaacatcttccaagcacttgccactggcaaggagggtgctgccggctatttccgtgggaggtgggtgaagacatttaacctgggcttccccagcagaaggaggtgccattgcagggaccagtcttgggctgagaccctagcaaaggcttcctctggcagggctgcaggtctagggtctgtctctgcctgctgcgggcctgattaacgccagtactttcctttccccagagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacattttttttttgttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagcccagcattgtcccagtgtgctatgtgtgtagctgacctgtggctggacttggtgccatctggaagggcagccggggacacctccattctgaggtcccatattccaaaccccacccctatacctccacacatttaggtagagtcattttgcaatgaacatcacaaataaacatcacgagaggaaagaaactgcaaagaggggaaacctgccaggtccatgcagtcctggtgtggaggtctgggggtgatgatgactcctgcccctcccgctgcccccaagaccccacccaacactgacccaggctgtgccataccctggacccctcccaccatgtggacacctcagccaatgtcagagtcatcctgcagagtggaagaggtgccctgagggcctggagggttcctgtgcccccagtagtgtagggcaaaccttgtagggttttggagaggaggggtccctgagcatgcagtgctcgctgactggcttgtgtggttagaggtatctggatatagtggaaaagtgccgatcagaagtcaacggagtgcattcaccgagggcctgctgcgaaccaggcacggagccgggctccttactaatgattttatgtaacaccccacctcagcaggttgccagaggtgcccattttacagatgaggaaaggtgcctgaggtcagggagcagtcaagccaggattcaccaggccagggagctgttgctcccactggaggagcagagacgctgatctttcctcctgctggagtccttgcctggcttggcacctgcacaggatggaagcctacagggagcagcacagaaccaccctgcagcctcctcctcaaagcaggacctcaagcaaagtggggggtcggcaggcacacacacgcatgcatgcacacaagcacatgcacacacgcgcagatacgcacgcagccctggtgctgtcaccgccccatccctactcctaagcccacgcagggactcccttcacaccttcctacgtcaccaaacagccagaacccagaggggcttttgtttctgaagaaataacgtgtgacttaaaatcgttgagacttattttgtgcttttaatgccaactgtgaaaagagcagtaatttcgccgtgagcatctttaatctaaaaatacatggctaaagggagaaagggattgagcctcccttcctaatgtgtgcaaagatcagaggaggccttccctggagggaggtttctcccggttcccagaacctagccaggagtctccagttcccccataggctgcagagaaacctcaggcgctgtcgacctctctggccccgtcctcccctgcagttcacctgcactggttctcctcctgagcctgccttgttccgctcttgcccccaatgatccctttgcctagcatgtccttccccatcctcacagctcaaagtcacctgggcagcttcttggaagtctcctccttccctgcattccatctgtcagggctccagggtcgagtgggaaggggtgttggaaactccattgagcagctcaaggccagcgcctctgacccacctcattcctccaaacaatgccccatggagaaggcgcatgctgagctgggatggtccaggagtcttagccaacgggaggtaagcaccaggactcaccaaggttgctggtgagaggaggctagagtaggtggcagggtgcctgaaggggaggacctggggatggctgggccagccctgcccactgcaggtgactaatcccgccttgtcctacttcacgcagccccagcctcctttcccaggacccaccatcatgtggctccctgtgggatattgccatcctcacctatagcccacgtggtcaccctggtggtgcaatgggtcaacaacagtggtcacgataatcccagctctcctcagtgactgctcactggggggcacactcatgggaggccaagatgcttgattccattctacagaagtggaagcagagaccaggagaggcgatgacttatcagcatcacacaatgtgaccccaccaggccaggacctgaggggctttactctgtccacattccccagatccccacagtggcaacaggccctggcaccctacttccaacgtcagccctccagaacaaatggtccatctggctcaggggacagtgccaggaagggctgcactgcaccatgaggacttgaggcaacactgaggctggacctcaccctggatgagctcacctcacccagatgagcctgacgagatggggatgcctgacaggccgggaaccaagaggccagagtgtccctatcagtgaccatcattcctgctaagtccaggaatggggtacaactacccaccaaagactgtcaggctgaggatgtgcctggggttctggtgcaccctgccctgagggcaggcaagacagaaaagggcctgctcctctagggcagctggcctccacccctcaccctgtggcatcaaggggaggaggaggaggaggctgctctgggtccatcgaaggaagctgggtgtccacgggtggctgctgaagagggacagggtgcagtggtggcccacccaaggccactagcctggaatgagacatacggctcactgcagtgggagcacctactttgcttctccagcagcccacgtacctggggttcagatgacattgggtgcattctgggtggtatagctgtagacccccagatttctccctagcttagatgctatgactccagggatgtcccctgaacccccaaatgacttggatcaaactgcatccagacatttcacccgcggcaccctccccttcccaagcccagttctcctttccaaggtcacggagccaatttccagaggcagggcccaggcgcatccttgctgcctccctcctcctctcgggctggtgctctcctccgggctgggagggtcatccatctccacccccgggctgcacacgtgtggagtcagggtcagaacaggccccatcatgctgctgctaaagctgggctggggtctcagagcctggcacaaggagagggagactggaggcagggccagaacagactcacaggtgtgcccagtcaggaccagtgggatggtagagggatacttccgggggaccctgagctgttcaactgcaccccaaaatctggttagagaagaattgtcaatttcagccacagaactctctctcccacaaaaatgaaacctgttttctcatggggttctactccattcctggacttagcaggaatgatggtcaccgatagggacactctggcctcttggttcctggcctgccaggcctccccctctcatcgggctggggagcagaagcagaccctgtgcatcactcagggcccagctggcagggagcctgggctggcagcctgtgtgtgacatctgtctctacaatcctattttctcctctcctgacacggcaccaccacggcgcatgagtagccagcctggaaggaacttagaggaatgcgtgtgggtgagcgcagcagcttgggcccagggcccctgcagggccagggcccacttgggacaatcctcagtcctggggtgccccctcctggttactctgggaaatcatgcaagtcagacttggccagagcaaggattctgaaaccactctcccagacacccatgacacaggggaagaaactgaggcacggtggccagaacaaaacaggggcccaacacatactgtcaaatgaatgaaggaatgagcaagcaggtaagtgaactgtagcaagaagacaaccagcaattgatcctttaaagtatgacataaaacctactaaacagccaatatttgttgagcgctagccacatgccaggcgccctgccaggtgcagagggtgccatggtgaaaacggccttccagtgtggccactgataggaaaccataccaatggccaccagcattcactgggagccagctaagccctgctcagagactgtcccagctaagccacacaggtgacacccacgttcccacaggtgatggtactgcccaaggtcacacgctggtaagaacagagccactgaaatagatgccctcgccaccccccaggccccccacccagaggcccatgaaggacaccacctggggcacagtcacactcgctaatccagaggccacgacactcagtgtacccccagaacagatctcctgggcgtctgccacattgcctccttcccttcctccctctgctcattgtccaactgtcccctgcatacccggtgtcccaggcctcccttctgggcccttcacagatcatgagcagcactcagtaaaccccgcgatgaagggccgaggctccccaccctgaccctcactgaggcttctgttcgtgagcttgtcagtaccacagccccctactcctaatggtgcgcccagtgttggtggatggcagaaaaagacaaggggaggagatggggaaaagcaaactcgtacattttagaagaaaatatggcagaatatcttcatgagtcagggtaaagaaagattatcttacacggcactcaaaaaaaaaaaaggccagagggaaaaaaaatcatgaaattgacttcattattcaaatgaaaaactgctaaggctgggcatggtggctcacgcctgtaatcccagcactttgggaggccgaggcaggaggatcgtgaggtcaggagttcaagaccagcctggtcaacatagtgaaaccccgtctctactacaaatacaaaaattagctgggcatggtggcacacgcctgtagtcccagctactcgggaggctgagtcaggagaatcacttgaacctgggaggtggagtttgcagtgagctgagaccatgccactacagtacagcctgggtgacagagtgagactgcatctcagaaaagaaggaaggaaggaaggaaagaaggagaaagaaagagagaggaagaaagagaaagagacaaagagagaaagagaaagaaaggaaggaaaagaaggaaagaaagaaagggaagggagagaaagaaagagaaagaaaaagaaagaaagaaagaaagaaaggaagaaagaaagaaagaaagaaagaaagaaagaaagaaagaaagaaagaaagaaagaaagaaagaaagaaagaaagaaaaagaaaaagaaggccgggcatggtggctcacgcctgtaatcccagcactttgggaggccgaggcaggcggatcatgaggtcaggagatcgagaccatcctggctaacacggtgaaaccccgtttctactaaaaatacaaaaaatcagccgggcatggtggcgggtgcctgtagtcccagctactcgggaggctgaggcaggagaatggcatgaacccgggaggtggaggttgcagtgagctgagactgcaccagtgcactccagcctgggcgacagagtgagactctgtctcaaaaaaaaaagaaaaagaaaagagaaagaaagaaggaaagaaaaagaaagaaagaaagaaagaaagaaagaaagaaagagaaagaaggaaagaaggaaagaaagactgctgcaccagtgaatcaacaaaggcacagtgagaagccaagaaaacagcctggtttgaaatgatatttgcaatgtaggtaaccgacaaagggctggaatccaggataaattacacactccttcaaatcaataagaaatggaaaaacaactcggcaacagaatgaacacactctctccagaggcactgggcaggagaggaatctgatgaggtgtcaggcagagggaagatgtttcctctcaccaggacagggacagtaaagccatatcacagtgaaacaccatagcacatccatcaggctgggatatgccccgggctctctggaggccagaggctgggctggaagcagttgcaatatccagcaaagctgaaggcaaacacattctccctggcccagcgatgccctccctggcagatgctctaggggactctccttccagggtaccaggaagccctgggcaggaacagccatggcacagtccttttgcagtacaggagtacaaacaaccaacaagcctgccagcctgggatgggtgagtgtatcatgatacattcaaacaccggaacagtgtgcagtgatggaaatgaatgaaatacagccagtggcgcaacatggattcatctcaaaatttctataaatctctaatgttatttaggttttttaaggttttggaagtaacagagggatacatacagcaagatccacttacatagttttaaaacatgcaaaacaagattatatatcgtccatatgtaattatatctgtggtaaaatataaagatatgcattttggggacatagtcaccagattattagtagctcaaggaaaggcaggaggaagagtgctctgggtggggggaggttcacagggtgcttggactgtacctatgatttcttcaaataaaaatttcaagcaagtataaaatatggatatagaatgtaaagatttggcaaagctggctggtggtatccaatgttccttatcaccatctctgtacttctctgaatgctttaaataggtcacaatcattgtaagaggactggttgagagcagcaagtcccctgtctccacactccaagaatgaggggactagaccctcgcttattcctcaggttcctgcatggtgagcacagggcattaatttagctcaacccagcactggtcccccatggatcaccctaataccccaggggctctcaaccctggggcatgcatgactgtcattcaaggtgcattttcagaaatatgtgtgcagggccccacccccagagactgctcctggtggcctgggagaggaccaggggcacggtggtgtttttaaaaaaccacaggcctagtgtgctcaactcccaggccagatcagctggaagaagatgtgcttcaggagccaagcaacaatcctagaccctcacaggctctgctctgttgggcctgcctatctgcacctgatcccgtagtcatttctctctgagccttaacccagggaatgctcacgcctggccttgaatgtttgcactccatccttgggcaggacgctgagctatacaccaggccagtgtttccacttcaacctcatttctggcctctgaggcaggtactttagacatgggaaataacctgtccagggcacacggggagtgaggggaagggcagagggaacccaggttcatctgactcctgggctacaatatctgtttgtccaccttgagctaaggtatccgcttcaaggcctcctatcatggcccttgaaataattccctcgtctaaaaatactcattgcatcatgcgaccaggcaggtatcaatctgccataaatcttaactctcgagccgtggtatcgggtagctgttaccctggactccccatctagtcagcagggccagtgggacaggaactgtatgcaacattgcctctgggacgggccttctttatcccttaaatgtgtgctatggtatttcacaaaagaaaacatttacaggacatccccttttaatcatcagggaaatataaattaaaaccaaaatgagatactactacacacccaccaaaatagctaaaataaaaagacagaaaaaaatctatgattaatgaggatataaatcacctggaactctcatatactgctagtggaagtataaattggtacaagtattttattcattttttttagagacaggatcttgctatgttgctcaggctggagtgcagtggttattcataggtacagtcccattactgatcggcacaggagttttgacctgctttgtttctgatctgggctggttcacccctccttaggcaatctggtggtccccccatctcgggaggtcgccatattgatgccaaacagtgcggacacccgactggcgtagggcactacagcctagaactcctaggctcaagcaatacacctgctttagcctcttgggtagctgggacatggcatgtgcagatgcaagtattttagaaaaccattgggtagtaccttctaaaagctgaacataatcttacccaggccagccattctcttcttaggtatgtttcaaaataaatgcatatacatgtccatcaaaagacatttataagggtgttcatagccactctattcttggtagccataagctagaaacaattcagatgtccgtcagcaacggaatgggtaagtaaactgttgtatactcacatagtgtaaataccatactccagcataaacaagcaaaaatcagtaatacatcccacacgtaaatctcagaaataaaacgttaagcaaaagtagctacaagcaagatattacaagctggatgtttccatttatgtaaagttttaaaaggggcatcatctatggtcttataaattgaagataccatttatcattggtaagggtaatacccagtatgggcatgtgggaagtttctggagaggtggtaaatactctctacatgtcttgattggggtggcagttacaccacatgttcactgaaaacaacttgaccaaatgttcgtttaggatatgcgcttttcttttttctttctttttttttgtcttaagacagagtctcgcactgtcgcccgggctagagtgcagtggtgcaatcttggctcactgcaacctccgcctcccaggttcaagcgattcttctgcctcagcctcccaagtagctgggattacaggtgcccaccaccatgcccagctaatttttgtatttttagtagagacagggtttcaccatattggccaggctggtgtcgaactcctgacttcgtgatctgcctgcctcggcctcccaaagtgctgggattacaggtgtgagccaccacacccagcggatatgtgcttttctaatatgtatgttgtaatttaataaaaagtggacgatctacaccctggtacatatgtgacctggagaggagaccgacggacaacttgagtgcccgacagatctgtgtgcaggacgcaagcctacctctaggcacctggaccagctgcatgtatgccttgtacaggttcccccggcagactgggctggggtcattcagcaggaaggacagggcaaggacgatgtcgtgctctagaaaggcgtatctagggaagggagggtggacagtgacataagtgagaccatgccctgagaggctcaaattagaagagtcagggtccctgctggagtctgatccatgctatctggggtagaccacattcctctggctttgtgggagcagacaaaggctacaggtgcgtgatccatctcacctgaacctccaggggagcgagctcagcaggcccagcccaccttggccccttgttcttctggtctcccttgcctccacatctatgtacaccagttatgcttgttgttatcattatataagttcagtaaatattaggcaagccaattagatgagaagaggattttctttttcaaatttgtttatgagaaaaagttgaatgctttggaaggactcaaaattgagccccaactcccaaccaaaaaaaaaaaaaaaaaaaaaaaaggagatgattggctgggcgcagtggctcacacttgtaatcccagcaccttaggagacctaggcggatagatgacttgaggtcaggagttcgagaccagcctggccaacatggcaaaaccccgtctctactaaaaatacaaaaaatcaaccaagcttggtggcacatgcctgtaatcccagctactcagaaggctgaggcacaagatcacttgagcccaggaagcagaggttgcagtgacctgcaactgcaccactgccctccagcctgggtgacagaatgagactgtctcaaaaaagacaaaaaaaagagatgattgtaaaagattctagatagctcacacctaatcccagtgctttgggagactaaggtggtagaatcacttgggccaggagttcaagaccagcctgggcaacatggtgagacccagtccctactaaaatgttaaaagttagccaggcatggtggtgtgtgcctgtgttcccacctactcagtaggctaaggtgggaggatcgtttgagcctaggagtttaaggctacagtgagctaggatcatgccactaaactccagcatggatgacagagctagaccttgtctcttaaaaaataaaaagattctaggccaggcgcggtggctcacgcctgtaatcccagcactttggaaggccaaggtgggcggatcactaggtcaggagatcgagaccatcctggctaacacagtgaaaccccgcctgtactaaaaatacaaaaaaaaaaaaaaaaaaaaaaaaattagctgggtgtggtggcgggcgcctgtagtcccagctactttggaggctgaggcaggagaatggtgtgaacccgggaggtggagcttgcagtgagccaagaacgcacaactgcgctccagcctgggtgacagagcgagactctgtctcaaataagtaaataaataaataaatataaattaataaataaaaagattctagaagggttttgcatacaggttatttcattaatgtctttgagttcttgctctactttaaaaaaaccaaagctgcaaatcagacgatgttatgagtatggtttaagcaaaaaaaatatgataggaaacaccaaccagtggtctcatatccgacaaaaagcctgggtcccacatggggattgatgaatgccttatcatttgtgttttgggttaaaatgaaccatttaaaggaaaccatttcttcagttccttgctttgtaatcatttcttttgattaaccaactgactgctgggcctgaatgcatctgaaagaggccttctgaggtcacgtctctgagggctgggttcaggaatgaatgagaatgcatgtgcaaacccctcagccaagtgcccacaggaagtgcccaaccagctgtgccactgcggcatttattataaataaaaataaattttatttattttatttatttatttattttcacttatggtgtgttttgaatcgtctggaaaaagaaagtcaccgttggacacacaagttgcaggggtcttccctgaccacgggggcttccttggtccgtgtctagtcacccactccatgtctctcatgctttgatagtcagttgtgtttgcctgtgtgcctcctcaccagaggcaagcaagagggcagggaacaggctgccaggaagctctcttgtccgtgggatgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctgaaagctattgacattggttataagatcaccactgacctcaagggaaatttagaagttggccacatttctgagaacgctgaaggagtgcacgggccaggccattatcaggtccctggtcagggatggtcacttcaccatgtcttcctgccttgctaatgtgggcacagccaggacccctggcttaggcactctaggtgctgctaaacaaatccttactaccattcattataagtaggttgatgcaaaagtaattgcggtttttaccactacttttaattgcaaaactgcaattacttttgcactaacctgataattgctcaggcttcagggacctgtcctctcagcatctgtcccccctaactggggattactacctaatgtccacatcaggtccagaaaagtagggaggaaaaaccagcaagaaaggtgacttgactcctgtgtgcccctaaccttttaaagcaccttgcctgggtcatctaagatctgcagagtgaggctgggattaggattgttgcccagatcacagagcaggaaagagtgggccccccaaaaggctggggcttgtgtccctacttcactggtctgtctgcagtgccagcctgcccttcttggtacaaagcatgtgaattagggtgctagccatggcaccacctccacacacacatgcacggttcacacagggccggggctgcacacaggatcagccaccaaggcagcgagagcttggggactagcagggctgagtgactttgggttttatgagatgccctgcagcctctgcctctctgggttcaagcaattcttgtgcctcagcctcctgagtagctgggactacaggcatgtgtcatcatgctcagctaatttttgtatttttagtagagactggtttcaccatgttggcctgtgtgcctcctcaccagaggcaagcaagagggcagggaacaggctgccaggaagctctcttgtccgtggggtgtcatgcaaattaactcctcaaggtgacaagatgccaagcccagggctgctatcctcattcccccttcctgtcactacttctgtgggtagaagaggcagaagagtttcaacctgggcagttcagggcagctacttagagcttgatgggctctaagtaaaggttaggggcacacaggagtcaagtcacctttcctgctgttttttttcccttcaaatcctgaaccgatttgaagcctctctgaatggctgcctgtttacaccaaacaacccccaaggcagtcagcaccttgcctttcttgtcttttcttccttctgggcctgtgcacactgggcagtggccccctttatccgaaagacctgggccagggcttgggggtgtttgtgatgtggggttctgtttttttggggggtggggacgggggctggtggggagaggttccagtgaaaactggaaaacctgctagaaaaattctaaaagagctgtaacactggggttttgtttctaatacaaagtaaaactactgatcgccagtcaagagggtgaacccagctgatgtgggaaagcacctccaaccaccctcaccctgttgccccaacacctaactaaaatactctataaaattttttttaagtgtaaaaagtgaagctgtgcttacacaggaaaaggacacttccaggtgccagaaaccaagaactcagccatcatgaacaggaagtgaggccaccagaccagatactcactttgaggatgttattttaacaccctcacagggacaggagccaaagccacagcccctgtggggatctgggttggggaactgggctctctgtaaaaagctaagaagtggcaaaattgttgcagaagtaagatctgaactttcttcccaccttgaaagtgggaagctcagctaggtgcagtggctcatgcctgtaatcccagcattttaggaggccgaggcaggcagatcacttgaggccaggaatttgaaaccaggctggccaacgtggtgaaaccagtctctactaaaaatacaaaaattagctgagcgtgatgacacatgcctgtagtcccagctactcaggaggctgaggcacaagaattgcttgaacccaaagaggcaggggctgcagtgagctgagatcgtgtcaccgtactccagcctgggtgacagagtgagagactgtctcaaaaaagaaagaaaagaaagagagagagagagagcgctcagagcttggaactaacataaaataaataaaaatcagtctggaacagagggccccataagatccacacagaggcaaccaaaaccaccccacaaagagtcctgctctggctaaatagaagcccctgcaaaaactgatgcggcagacaacactccagagcactctaagcagctcaagtgcatccacccaggggagaagtgcggctcgcaagcgtcacactggtttccagaacagcatcccacctgcccacgctatggcttgccgtgatgtggagcacctcggtggtctttatgcgcaccatactgttgctatccttcagcaaagctttcaggttctccatacagcctagaaaaaaaaaaaaaaacaaacaaaccaacccttgaatttttgccagtctcagaaaccaaccaacccagaagtcaataagtgggccagttggggcaggaatgtaccagagtttctgctgctttggggcactggggaatcatgttggttatgcagcatttcagagtcactgaagaggctcatgtctcatccaaccctccttgtgattctccctgcacacttcctaccagtgacttctcacaaagtctgtcatgaggttaagaaaatggcctttgccatttctttgacctcaggagagatatggggtcaaattataaccctgtgtcaaactagtcatatgactttgagtgggttacacctacggatgccagatttagcaaataaaaatccagctttggccaggtatggtggcttacgcctgtaatcccagcactttgggaggccaaggcaagcggatcacctgagatcaggagttcaagaccagcctggccaacatggtgaaaccccatctctacaaaaatacaaaatattagccaggcatgatggcaggtgcctgtagtcccagctactcaggaggctgaggcaggagaatcacttgaacccaagaggcggaggtttcagtgagccaagatcgtgccattgcacttcagcctgggcaagagagcgagatgccatctcaaaaaataaataaataaataaataaatacaaatctagctttatttatttattgggcaaccctagacttacaatccttctctgaaccatgcttttcttatctgtgggttgagaatggactctcccctgtaggtggcctttctaaggattaagataatccaggctgggtgtgatggctcacacatataatcccaaaactttggaggctgacctgggagaatcaattgaggccaagagttcaagaacagcctgggcaacacagcaagatcttgtttataaaaaaataataataagaaattagtcagccatggtggtacttgtagtcctagttactcaggaagctgaagcaggaggatctcttgaccccaagatttcaaggttacagtgagctatgattctgccactgcactctagtctgggagatggcaagaccctccctcaataaataaacattttttaaaaagaacccgggcaccgcacctatagtggaactggcctggagtcaggctcaaacaatagcaacccttattactgaagttctacccagtgcctgaagccatgctaggaccccagtcatggtcacctgtgctgtgtcacgctcacctatgttcatggccttgtagatacactcggggtcatgcatgaggtcacacaaggccatgagggctttctgcctcgtctggaggtcctctgactgcagctcctccttcagcttgggcagggcccgatggccataggcagtggtaatctgggtggcattgatgttaatgggaagctccaaggagttctgggaatgggccatctttccccaactacagaggcctttccaaatgaagctctgcagaaaccactcactaaaagagaccaaaaagctgtcattatttctattatgatttaaaagctacttctcatctgatcctccaaactgtgagggcaggcaaatgggtatttttactttcattttacagatgagcaaactgaggctgagagcaatgaagagatttgctcaaagtcccagtgaaggtaagtaagtagcagcccaaactgcaaactccagagccctcccacacaatagtgcttcacagaagaaaccactgatactttcatctggatcttcagtcaaaggcattaaaggacaaaacaaaccaaacaagcaaactccaagttggtcactctgtttagtgcttaccttgtgccagcaataagtagtatccaattcaactaccccataaggagggggctggtattatccacattttacaaatgaggaaactgaggttctggccaaggagcttactggaggccatgaaactggtaagactagaagccagtgttcaaatctgggtctagctcattcactgccaggaacccatattcagatgcttctgacacatccatgaaaaggaattaatgttaaaaggtgatttatggccacgcgcagtggctcacgcctgtaatcccagcactttgggaggcccgaggcaggcggatcacaaggtcaagagatcgagaccatcctggccaacatggtgaaaccccgtctctactaaaaatacaaaaattagctgggcgtgatggcgcatgcctgtagtcccagctactcgggaggctgaggcaggagaatcgcttgaatcagggaggcggaggttccagtaagccaagatcgcgccactgcactccagcctggcgacaaagcaagactccgtctcaaaaaaaaaaaaaaaaaaaaaagtgattaacttttattgccgacacacacacacactttcagcaactatgggcagtgtaggttagtagttaagaactggctccagattcaggcctgggtgaccttggcaagttacttcctctatctgtgtctttctgcagcttcaaaggggagatgataacagtacctccttccctgcctcccagagttgtcatattaacgaatacacgtaagcctggcataccagggcttcagctatgttggctgtggttattattacggttattatcatggttagtagaatggacaggccacaggcctgtaggaatctactccagtaaaaggtaagccagatgctcacgcgggacaccagatgacaacggtagaagtgggggccggactgggagggacgtggccatgtttgagttgagctcccctcacaggaacggtgggtgctggagacaggggcctgccttcttctaagcggcgtgggctgggagagtccggccggagacaaaagaccgtgattttgagtgtggggacacggccccgtgtgaatgggactgggtgggtcactgggcccccctgtccccgggcccctagcccaccaccgccgcctcacctgcctccgcagccctttctgcttccagtagcccgcgccactggccaacctattcagttgccaggcgacatcgttgccaggcgactccagcagcgtccgcggcgcc

SEQ ID NO: 106 - DNA, 137674 bp, Homo sapiens; identical to SEQ ID NO: 103

SEQ ID NO: 107 - DNA, 97 bp, Homo sapiens
ccagtgctggggtctcaggaggcagcgctctcaggacgtcaccaccatggcctgggctctgctcctcctcaccctcctcactcagggcacaggtgat

SEQ ID NO: 108 - DNA, 2234 bp, Homo sapiens
acgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacctcgcatattgtcagtgcaggaggagatgggaagattggccttggtaagattcacagcaccttcgctgccaagtactgggctcatgaacaggaggtgaactgtgtggattgcaaagggggcatcatatcattgtgagtggctccagggacaggacggccaaggtgtggcctttggcctcaggccagctggggtagtgtttatacaccatccagactgaagaccaaatctggtctgttgctatcaggccattactcagctcttttgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagcgttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaacctgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccaatagcccgctagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcacagaaaaaaaaagaa

SEQ ID NO: 109 - DNA, 1468101 bp, Homo sapiens
ctgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggtaagaaagtgttggtgcagctcgtggttacttttaccgtttcagttctcaaatgtttccccttcgctttccccctctccggtctctgtgtgtcttgttggaggtggcttcagttcattgccccttcccgctacccttccctcacacttgctcagttttctgaaaggatgtggatgctcgaacctcgactgacttgtgctgttgttttgcagtgattcgtggaatgtggctggatgcgtgggggtctcgagttgacctgagtgtgagtgtgtgctgggaactgcagggggattctaagtgtgtggggaaagggagtttaattgactcttatcttccatattttttttcccggatgtacatttgctccatttaaaaatttatctttgggggagcagagaagctgtcacctgtgagatgaaaagaactgggctggggggtagggggagctcccttcggatcgaacaggtggttttgcaacgtgagccggctgagttcgccgcagcttagtgcgatggtgacgggggtgccggatgcgcccccagccaccctctcttctcacatcttcttggctttatgatccttgcgtgtagtctttgagacggtggcaggaggggctggcggcagtgtcgccaaggactgattgtcgcgtgcctcgcctcctcggacacgctcccggggcctggcgcggcggcgaaactgaccccggggcgcttgggaaacgcggggaagcgaatgcgcgcaggctgctcccgaggtctgcttagcagatatccgccttgcctcgcctcgcctcgcctcgcagtcaactccgagtagccgcgcaaggcagacagcgaaggcgccgggactactgcgggccgcgactctgagaaggactgccgagcgggctccgagatgctggtggccccacctattggcaaccagacgggccgggactggccgcggcgagcaggggcgggcggggggctgcgcgtcattatcatgcacagcgctcgcagcttcaggctccaactctactcacttgctaatccgtgagagctgagcgggagacaggctcttgcagccttttctgcgttaatgcgacgatttctttttcggaaattcgcttaccgagccagcaaggtttctttgctgggctgcagagaggtccctttgggggaatttttctgggcacaggacttttatctgtacgcatggcttggtgttctgcaaattgaggcgacagatgggtcacagcttctcccctttctgtacccctgcttctccaccgcacaacacgcatacacatacacacacgcacgtacacatactcctggtaggggaatctgctgcaggtggcgattgtgcccgcccaagcgagggatttctgtctagcgtgcgcgcccacagtggccagcccctccgctccagggggctccctctcttggtctcagaggctgtctttgtaaacatgtctgccattctctatcatttatatcagtagaactgtctgtctctgtgcaaggggtaatgaggtcaggattcagaaaacctagcgtttgtgcattaagtaagtcaagcactaatagcttgcctgctggatcccgttttgcctgggggctaacagtgcctacagattcagaacttttcagcaagaaattatggtctcattgagtggttcagcaatgttctgatagagttcagaaatgaactatgctccttttagagaaatggcatacatttatatctagttgtaaatgattggagcaggaatgcagatatataatcataatacctttatattcattgtatgattagggatttctgatgtaggctcctcatctctcaggagggaaagcctgtggaagaatgctttttttaaatcgcttattctgtggtctgcatgataaatacattatttacaaatacctacagcttttgctatcccttactagttaaatattattttgcaatgcagtctggacatctgtttcaaaatagaacaaaactgttgtattttttagtttgtatactgttgtctgtcagagtggctataatcacatttaaaaattaactgtgtacaaattacagatttctttagaaagttggttgtatacattaactgtgtatatcctactaacagatatagttacttctgagacaattaatttgacttgaatataattagtacattagatgagataattagctgttttatagactacctaatattgtcatgaggctagcaaattgtttcaaaaactttatcttttataatatatcgaaaaacattaactcctaaattaaaaaaataaaaaatgatgacgggtagtatgtgtgtaattcagtgcctccacccctactctcagcaaaagtatagtaaattcaaaaccgaatgtccatattaaaattgtaaagcaccagttaacatgaattggattagtttccttacttgtttgaataggaaaagaattaattttctttaggaggtgttgccttcatttaaatatttaatgtgagaaatatgtttctggggaaatatattagttcaggactgaaggaatgaatgtgatgaaactggagggaaagggaatatttcacctctagcgatggaaggagatatgcagaaatgaaaggttttcccagcctcatgtgatgtgttcaagcagaaagtagctgcaatatgtagttcaggcaaactggaaagatgaaaagacactgctctaagaggctttttatatattgaattattttggtattgaaccaacttatatatacatgaaaatcatctccttctttctctctttctcttcagtttttacctcatgccggtagtttaataaggtcaattacacattttaaactctaatatgttttgttaaacatattgattcactacagtgatgaaacataatggttaaaccataatgattgaaatgaaaatgtatttattttagtcaaaaatgcacaattttatgattactttgagtttcaaatatttaaaaatatttaatcattacgtatatttttaatacacatccacacacagatacacaaccatatagtatttaaaaatgaatcacttccattgtgatcttctttgccccaattaaagaaaggtcttttgacatataaaaactatgcaattttgaattatgcttctactttgagcctatgcattgattgagtaatttcatcagacccacattacttgattgcttagaagtttcctaatgatctgcatgctgtaggaagaaccaaaaagtcgtgagtggaatggcaatgatactgtgttttatgaggctattcagaagtcgctctgatttatgtagctagaaagctccaaagtctttgagattagccacgctgactgctattttcttcatacatcagtcgtcccacactctttactccctaaacacaacaggagtttagagcactgctttaattcagcagggattaggtggcatttccagtcaactgcacagtttgtgttttgcttcatatcaactatggaagatctcatgttttaacagtttaatatatgctcctttctttatctggttcctgtgctcacagaactgattgtaaattagctgtcctcagttatacatctctacaagggaacactcaaacagtgtacttattcatatattatacaaatcactagcatatttttgttgttttcagtcatagtaaaataccttatgtcaacatggagtagaaaagatgcatttattcatgtttttctcacaaacagatgatactttatcctctgaaatcataatcagctgtgatattatatttgagaaacctaagataatccacagaatattttcactatgagaatgttcaaattaaagtacaaaatcgggtaaataaaaggtgtcaacacattaaaaacaataatagattgtaaatgtaaaataccagttattcttacttctgcactaaggattattttgacaattacagcatataaaagcattcccagaagatgtgctgttcttttaccatttttttttttcagttgactacatgatttgcattggttaatgataacccccaggactcctcaaggattttttggattgtgtaagatgtctcaatgatattttatcctttttctacttatagtagttgtttgttcctgaagttcttgataactgtgtaaacgtctagaatgtactaagggacttggctttactattcttctctgtatcattaatacagttatttgaagcacaattcaagtgtgtattaagttagacaatgttgttattaatcaaagataccaactatgacatgactaataagccattacactaagggcctttgctttctacgccaggtgaaatgtacatccactaaatatctgttataaattttaagccaaataggaataaaaatccaggtgattaacttttgatttattaaaaaataaaagccaattgaaattgttaggagtgatggaagatacattttattccattctgatatctcaggctaattttatcatatggtaattttatcttaaagggccattgcaatttcaaaagcacactttttaatccagaagttttttttcttcacctacacctacgtatatgactttattttaaaaagtaagatattcacatttctattggatcatcatgatattttagattacagacagcatattggtgagtagcaatacttagaatgtattactatagtataatgtttattagaaaatacatttatggcctataaagatatctttgccattaggtgtcactgcattctgagctgtatttttttttttagtactacttgaaaaccacatgaaatatttttaaaaatctcagaaaaaaatgtcattttaatgaggtttgtgatgctgtaagaaaataggtagtttttattttcaaactagaaaaataaatatgatccctgtctcttattcttgtaagaatttaatgctaggacatatcaacacacctgataccctctaaacaaattagattgctagacctagtgatacaattttttttcttatatttaaaataggagagaaatatcttcttaaactaatacttattctctatgaataaaatctaagacacctggaaggatgcaagtgtgtttaatactgctggagtaaacacacattagtgaataaagtagtttgttaagcagcttctaacggtggtagctctgcttacctatgggatacttgaggtcccaaactgattgttgtttttgagacaaaacatatgaaaatagagttgtggggaaaaaaaaacacatggacacaaatacatctaaaaataatgtcaaccattgagttttatgaatgaccatatatgttttcagataatttttgcctggttaattgtatgcattgtatcgattccttgcatagttgcacctccaccactactatcactacaagtaccacaattatagggtttatttgttcatgtaaaactcataactattctcacatagtaatttatttgttttgtaaaaaggcactatcttccttctagcatatttcattataagaataatggaggatgaaatttagggcaacttttaatctgataatttagttttaacattggcaaactcacattattagagaatgcaacactagtttaactgaatgaatggtttgtcttatgttagattttgccctatgccaaagttcattaattattggaaaattaaatgattagacagatgtctaaaagataagaaaaaatactaaacagttctggaattgattattagaacatctatggattcatgtcattaaattggcaaattttagcatattgatgtggacacacatttcagagaatttgacaaacatatgggcaatgttaaggtataataaaaaaaagtattctggattagaatttagaaggtattggactaaatctcaatttataaatagctaattgaatacattggaaagttatttaatttttagtcttcatttttatcaaccctaaaataagatttagactaatgttcatttaatctctaagattatatgaactaaatggagaacaattgctatatttaaggaggaacagaaaggaattgggagaagagatacagtcaagtgtggctatatttaatagctgccttagagtgaccttcaaaaaaggaaatacaaggggaaataaggaacatgaaatcttaattacacaagttaagaactctttaaattgaagatgtctttgttgcaaacaagaattatgtacatttcttcatcaggtattctggataactagtatctgattgagagagctggatttgttttttgttttcgattttgttttcgttttgtctattattagtaccaaggtgttacctacagcatcactcctatagaacactgcaaaattagtgtttaacactaattggagggatgaatagtcttatgtatcaactatcattgtgtatgtacacttgcctttagaatttgcaaactgggagtgcatcaggaatattaacatatgctttatatcactacaaacaaaagtagagtataaagaaagcaaccaattcaaagttcttcactatcctggactcctgcttcaggtttttatgcttttatcctactgttgttcaccaagtagtcatcaatgtgaagctgaggctgagttgaccccgaaagcttcttgagtagatacagggaagccaagtgaacaccagaagctaagcaccaaaggcctacttatggtcttaaatattcttaaatcactctgtagtcaagttccttattaacagatttttaaaatgaaaaacattaggtagtaaattatattacaatagcaatttgcatatgtttttctttaaactaaaataattaaaagtactattttaaaaaataatctcattttattgagcagagtacctgatttttttcataagtaagcttaaataagatatttgcttcattaataaagtcattataattctagaagttaatattcctgaaagtatatggtaatataagcattactaccaacatgtagtatgtgtgctaattgggagaatattcttttattcagcaaacattttattctgaatttactctgtatgaagcattgcttttagtctctaaaattaaaatgttgaaccaacaagctatgtttttgtatttaaggaacttacattctcatggaagaggcaaccagataagaaaatatatgatgtaatgtcaaatattgataaatgctatgaagcaaaatgagggaatgaagggtgacaaagtatgttttcattggaacagagacttgatccaaagaaaggatgtgaaccatgtggatatctgatgaagaataattcagtcagaggatatagcaagaatgacggccatgagataagacactaagaaaatctgcttagtttacttaagaaatatattcaaaggcaattggagtatagttcagtgagaaaagcaggaagtggaagtaaatggggtctgagagggcactgaggaagattctgtagggacttacaggccatggtaaggtatttaaatcttctaggtatatttgggttaagataaaatgtgtgatatgaaatagtttgtattttagaaagataacattctttgcttaagtgcactggatagagtagaagtataaattgacaatagcaaattggatcaaggtggtagcttagctaaatgtacagttatcagattgtggacataatgtgaagatcggaaaaacaggattttctgatagatgagccaggtgggagagatccagagaaagtaaagaggcttccaaggtattttacccaaatacatggagtaaatgtgttactgttgactaatattcggaatatgggggcatgagcaagtttagggtacaaatcaaaatgtgcatttattaaattttgtattagacatcaaacttgagagtttaaattggaagtttattatatgatcctgaaattaagaggtgagtttgggatttgagctgtacatttggggaatatatcattgtaaatatagactcctgtaagaatagtcataatcaaagaatcaaaaaacagtagatgttggcatggatgtggcagtcagggaacacttctacactgctggtgggaatgtaagctagtatagcaactatggaaaacagtgtggagatttcttaaagaactaaaagtagaactatcatttgatgcagcagcaaccccactactggatatctacccagaggaaaagaagtcattattcaaaaaagatacttgaacatgcatgtttatagcagcacaattcacaatagcaaaatcatggaaccaactcaaatgcctgtcaaagaatgagtggataaagaaactctgatatgtgtgtgtgtgtgtgtgtgtgtgtgtgtgtgtgtgtgtgtatatgagatggaatactactcagccataaaaaagaacgaattaacagcatttgcaatgacttggatgagattagagactattattctaagtgaagtaattcaggaatggaaaactaaacattgtatgttctcactgatatgtgggagctaagctatgaggacacaaaggcataataataatacagtggactttggggacttgcgaagaagggttggtggggataaaagacaacaaatatggtgcagtgtgtactgctttggtgatgagtgcaccaggttctcacgaatctcccctaaagaaacttacttatgtaaccaaataccacctgtaccccaataacttagggaaaagtaaaattaaaagaaagaaaataataataaaataaataaaaataaaggaatggaggggaagacgtgcagagagagaagagttccaagactaggtcatttagcattccaaaagtttgagtccaaggagagcagcggatgcaggaaaagagaaatattagtagcctgggagacaggaggaaaaccaggagtacatggtattctggaagccatgtgagaaaagtaattctagaaggagaagtgagaaaccctgttgaattgtatgtatgcaaatggagatttgattgctgggcttgaaaatgttgaggacaaagatgactttaaagaaagtgctcttagtggactacaagtgacaaaatactgattgtagagaacccgaagatttaatagaatatgaggaattctatgagttttgtcataagaaagtggtaaggaaggggatattaggttaagggaaggatttccttttacagctgggcattggtatatatatgtaattttctgaatattcagtcctaagagaattatcagtaaaatgatttaaaattgatacacctttttctttcaacttatataattcctgagtttggatagaaaacgttcaaatagaaaggaaatctgtttttttttctttttctttttcttttataaattggatcaagtgacaccaggccaaacacactgaaattaacctgagagacaagtttagagtttagatttcatttagtttcccagattgccattcaaatttcatagaaattttttatctgaacttaagagcagattacattttacatagtattgctataacattacaaatgtcataaatatttagtcatttggtaatgtactaattccaggaacacacaatatttctattctgttagtggtattaaaatgcataaaattcttgttataatagacaaatttaaatccattgtaaatttcctctgagtgcattctgttatgaatttgatttgcttcaaacatcactttggaaacatttttttaaaaagtttttaatgtgtagagggacaaaaaggatatatgtgttgaggatacctaatccagaaatctaaaatccaaatgccccaacatttgacacttttcaacactgacatcataacacaaatagaaaattccacacctgacctcatgtggtggatgcacaaaattatagaaaaaagttgtatgaaattatcttaccttctggctatgtgtgtaaggtatatatgaagcataaatgaacttaatgtttacatttagtactatccccaagatatctcattgtttatacgcaactattccaaaatctgaaaaaattctgaaaaccaaaacacttcaagtcccaagcatttcaggtaaaggatactcaacgtgtagtaattacagggcaaagtttatcattgcagcatagaaattaaatagatacaataaattcatttggcatatcatattcatatgatttctgtgacacatttaaatatttccttttatggatcttttacttatttgtgctaaacaatggatgatagattttcagtcataggtggacatgaggaaaggaaatgttctaaatttagtaacctcagaattcagccttttgaatatgaatcttagttctttcattagtattaatataaccataagttgtgtattttgattttgcacctaaaataataatatctgtactaaaataagcatgctaatagcaggtgaattatattttttgtgttctttgttgttgtaagtgttatgtcctctataaaaacatttcatcatatggaaacaatgtgatatggatgtcagatggttgtttctgctctgatacatctgttaattgatatgtaaatatggaatatttgaacaatgagagggtaggagtcttatagtttgagaatagcaatgactcacaaaaaaagcaaattgtgttctggctggagcctaggaacttaattgatgaaatacagaacattgaaagatattttctatttactagttcatagcttcttggggtggtgaaatatcatttgaaggaaatgctgcgtggacttaaatccaaacttaagttggaatgaacccctaaaactggtgaagtgtttactatatataacttcaacatcattaaaatgtcatgtcattgattgacttagtatcttaaaatccaaagaccaggtaataccttagtagctttggtgagacaagagaacttagtcctggccatgcacggtggctcacgcctgtaatcccaacacttcgggaggctgaggcgggtggatcacctgaggtcaggagttcaagatcagcctgaccaacatggtgaaaccccgtctctactaaaaatacaaaaattaactgggcatggtggtgtgcgcctgtaatcccagctactcaggggctgaggcaggagaattgcttgaacccaggaagtggaggttgcagtgagctgagatcgcaccattgcactccagcctgggcaacaagagtgaaactccaactcaaaaaaaaacaaaaacaaaaagcaaaaaaaaaaaaaaaaaaaaagaaaagagaacccgttctgttgttctgttgtatgacatttaaagcgaattaaaatccagaagactgattcctgcttctaataatctctgcaatctgacaaccaacaaaattgggttagtggtttagtggcagttgctgtcttgctactcagaatccagatattctttgctgcttctgtgaatggaaataacagaaaccattgaattttctttttagatataccaacaactctcagcatagcccagtagaagcatggcctatataagaaccattatacatttcttcttaaatggtttttcaatttttaacaccttattaatgtgggtgatgcttcatccacagatgtaagagggactgctcttctgttctcttgtggtgtagtcatggtgagttttggacattttctataatccattaatttcaagctgagaaattatgactcaaatctcatattccatttgcagaacatatcaatttagggttacatgaaaccataacgtgacatttttgggtgtgtcaccagattttttttacacctattgtgtggttataagaatacagatcattgaaacaagacacgtttcatatccttagaactttcaggagtatctgccttctaagaaaatattataacattaggaagctgaaggtagaacaattcagaactcccagctgaacgactgtggtctactatggcactggagattgtgataattcaataaatgccatttttatagtagcctaaaggtgccataaaaacatatatttcagaaaaagacatagaaatgggatcaggaggttatcacatacaaatggtctttatagtagaaatctcatttctcagctttctgatggttcaccatattgtagctataggctacaaagtaaatacaatcatgccaatttcagatctaaggaagaattttttattattttaattcttttattttttaaaaatagatgtcagtaattctcatgcaagcttaagtaatgaaggaggaggcgttaagatgtggttatttggtaattaattaagctaatgagatcttttctaaatttaatactgtatatcagatattgcattaagcatgatttcttgggtatagaaaaataaaattgccttttttactctcacttctgaagttaatagtacactgttctttcatattactaatctatcctcactgctgtatgtataaaacatcagtgaaaatgacagttttatgacatttgacatttatgacatttgacatttatgacttttgaccatgacagaataatctacctcatggcagaagtaaaataaagtttctttacaagtggcataactattattaggaaaacatatttatatagacttttaattatataggtgtaattgaaaacagggaaaacattgaaaactgaacataacagattgttcgcaaactaactgtccagtgcttctatttttctccacaagagttcatgctgtggttaataaacagttaataaatagcaaaactggctgctttgattttttctttttatttttcctgtctacccttcagtggcaatactaatgagcagtgaaatggccaaaagcaagaaaaaaggagcaaagggttttagataatctataaaccagaaaatcagtccctgactgctcgtatgcacaggcttgctgagaagaaatagttttattttctcaaaatatcacccagattctgaagatagaacttgctcttggctgctgagttagtgagacaagtgaagcttttgggccaccaaagaagaataagctgaatgacactgactgggagcaaagtgaagaatattatcactgaaaaaaactgccctccaggggtaatgctgctgacaaccagggccccagtgattggctcagttgcttgcatcatatttatggtgatttttaaaaataaaatgcaatataaattgcagctatactacttaaaaactttagataattatgtataaactgggttgtattgatattcctgtcaatacacattgagtcttgagcatctacattgtatataccctgttgacctcctgttgatggtatattatagaccatgaagaggaatttgaatattgcactcttaaaaaggaactgtgaagcacatgacaatgataaatgcaaaaatctgactagcaattaatagagggaaaagggaaggtgatgtgatggagaggtacatagtttcaacattattgatggtgttttatttattaagttgggtggttgtttcacaagtgttggatatatatgtgtgtatatatatatatatatatttttttttttttttttggtaagcaatattatatctgttgttactctgctcacagagaaatcgactggttcagttcacttccactttagttagggaataagttgttttcttttaggcccctccatcaggtaggttggctaagtttacaaccctctttggagggaaagagagtgcatactatatgcctatatgccaggactttttttttttttttttttttttttgagacagagtctcactctgtcacccaggctggagtgcagtggcacgctcatggcttactgcagtcttgatctcctgagctcaggcgatgctcccacctcagcctccctaatgtttgtattttttgcagagggaattttctcatgttgcccaagctggtctcaaactcctgagctcaaatgatctgcccacctcagcctcccaaagtgctgggattacaagcgtgagcaccatgcccagccagcaggactattaaatagcaagtcagagaagaattcaggagtctgtcttcaagcacagtgatccctgtggtggattcaacaatccagttgcctttcgctaccatttagaacagcatctttgaatctttgtttcttatttggtgtaggcagggagctcccttaaatgttcaaatcaaagagaagagaggaaggaatgtacagagggaacaactggtttgatgctatgagaggtggtttggcatatttcgtgttttgaatatttcataatgcgtattttaaatgagaatgtataatatttttgttagtgatattacactacaattattaccttctatctcactcttggataagaaaatatgaacaattattttataatgtatccttagagatacttactcctaagaagtgaatttttcctttatcttatatgcatgttattcttggtttgattaatcaagaataattgataatgagtctaatctacctaaatgatttcttgatattttaatattatgtgtcattcactcccaattcaaagtaagatgtactgtaatgatgaaagaaaaaataccttcttgcagccaattgagcttcatgatgtggcccttgattgaatttccaatggaatagttcattttaatctgtacaaattggaagcaatgagaggaagaaaagtttccatgaaacatccttagaggcagcaaagaggttcttttagaatgtcaggtcattcaggcctttggcctgaggattagcaggggagatgcctagggaagctaataggttctcaacgctgccagaatctgcctcttggaaaatagttatctttaatttttggtgccatttaacaaaatgttgtatcttttgtgcttcctgtctggacaaagcagagaagaaataatactgtcatataagaaggggacctatgtttgggaagtcagagacaatattttacatccctgaatttcaaggactaattcagtgtctggcagaatacatacagttatgaaattttacattgtttgtcacatgtccatatttgctttcaaatcttagtttttcagttttaatcaggaataataacaatagctcccaccttggctgggtcatttttaggataaaaagtcattatgtctgtaaatatgcttattgaactctcaaatatgctgtaaatataagagaagaaatattggaatactgcatttgtggtggaaggtgttgcttaggagagaggtgagagaggttgcagccagtgtactgatcattcttttgaagtgggagtaagtacagaaaattcaatacaggaaaccaagaaagagaaaccatttcgggagagaaatggagttcagttttgaactcaaaatgattttggcataactgtgaagtgtatatctcagacagtggtttcacaatgatcccctttcctgcctcagatggagaaaataaagattatttttcatagtggtcaattctattttgacctaaaaaaggaaacagtgtttttctagtcatctttttctagcttttcctcaaattcaacgttaatagtgtcatttcctatttaaaatgtgaaccatttaaagtatattcagggtacttatgttcagaaaatactaattctacaccaggaggcttatgatctttagttcctgtgtctacttatgtctcagtttagaattaatttcgaataatattacctacttttttttctcttttttttgagacagagtctcactctgttgcccagactggagtgtagtgtcgtgatctctgctaactgcaacctctgcctcccaggttccagtgattctcttgcctcagcctcccaagtaacagggattacaggcacacgccaccaacatgcctagctaatttttgtattattagtagaaagagagtttcaccatgttggccaggctggttttgaactcctgacctcaagcgatccacctgcctcggcctcccaaagtgctgggattacaggcatgagccaccacccccagctgatattacctacttttgaaaatatttcttttttcttagtatttctgttttttactataagtgtacattttaaaatcaaagtctggtcctaatttaagagaatggcaccattaatttatttgctgttgatttccagtcaaaagagttttaaaacagaatgatctttgatggaatcttaggttgtcaaatataaaataaaaagataatttttatttcttgttcataatttcttttatagtttcatattgaatgtataattctcttacataaattaatagaattacatagaaggatcgaaatatgttttatagaattttgtgttctttagttacattttctctgaaaacataattagctagaggaaaggaaacttgtgctccaaggatggcagaagtaaagcctgaagtgggacagagatcccatttagaaccaaactaaaggaatcttgttgggacttcgggcctcttttttccacctcccctagaagactccaccttcattgttaaggacctgtgttttctgataagaaaagacatttgcaaatactgatctgcagatggaagaacgtgaaagcagaggcagtgtgcttgtgtgtgcgcaaaaacactgttcaaactgagaagtgggatagagtggatccacgtaagccaagtgttctttctgtctctttgcatctttgtttagagtctagcttttcagcatgttttttctaatatgtaaagtcagtgataacttcaataaaaacaatttaggtatgaaattattggaacttaatttgaccatctcattcttttttgctcttaataagtcggtccattgtaaaagagccaagagtggaaaattgagtgctccaatgggaaggaagggtctcagcatctttttcttgctcccaggcagtctaatgaatatcaaggtagattaaatataagaaatttagaatcaatggagcataacttgaatgagttgacccagtcaaaaattgtgatgattggtcatttttataaacagtcagagtaggatagagtaggaaaatataagcgttgtatttgatgtcaggcttatatgttcaaatcttgccttggtctttttctacttcctggctgtgaagtccttggatgagtgatggaattttcaaagtctcaaatttacctgctccacctcatctgttatatggatacattgcaataaaatttaaaatatggacttatggactattgcaaataaggttcatatttcaggaaattgaacttgcaacttacatgtactgctaatcagggtcctagattaggcattagaaagtgacatgagaaacatgagatcaaatagggttccctgtttatccctgttcctgaaagatttagatttataactatggcttttctacaacatataaatcaaagttgaaagcctttctggtaagtatgtggatttaaggttaactgttctttcaaagatgatatctcattataaatttacatgaagtagatggctaaaatgtttgctagggctgattctgatgtttagctctgtcttggtggcgacactcttttcttagctttggtctaatataggatgatctcctaaatgtattgtccagtttattgtccaaaccaggactcctttcggaataaaaaggataatatactattaagatagctcttggcaaaggaaaaatgcttgaggtgatagatatcccatttaccctgatgtgattactacacattgcatgtgtgtatcaaagtatctcatgtaacctatacatatgtatacctactatatacccacaaaaattaaaaagtgttgctgttggggtgaaaaagacacatttggactgattggaggcaaactggggcaaataagcaccctagtattagaatactgcctatgggcctgtgatcagcttgaagtttggctcagcctcaatgttcccctaggtatattctctttcaatcgccaataattctgtcttagcagcaggttattctttccttttatgctgattaaagaaacaaattatattttgttttggctatgttttatttttaattacttagaggacttttactttttccttcacaggcagcagaaaaaaggacaaatagctaagtataagttgtcttccttcatataaacatatttaactgatttttaaaaatcagaatctagtgcctgtaattgctccctttattattatttttttgtcctttctccctatctgctaattgagtgcaacttctagcagaactgattggacattggcaattgcatgaattcatacccaacctcaaatgcttttacaagtattctcacatggagtgtactgttttttaaaaatgtaaagatagtttaccaaaaagattaaaatttgctttaccttgagtcccaagaggagaaatcatcaagtaaccaacagttttgatcatttttattttttacagaactctattataaagtaacaatgacttcaaataagatgttagccttaacggttaaggtttcataagtgtatatacatttttaaaaggctatttgttatagataataactataagatattgtcttgcatttttgaattaattcttctctagataccatgttatctaatttattcaacctctacaaacttttgtctcaggtgtgccctttctgtttcatgtagaagtcattagattctcctaaaagttttttttcctatctctgttccaaagtccagttttacctgaagaaatgattgtgtggtagcctgcattggtctcttcccctcattctcttgctctttcattgctggcctactttatgtaaaccttactccttgttttacttctggcatcccaggttttttgtggtcttatcactttctatgttttccacatgaaactggctttgagagcatcattctcacactgtgctctgaagcttgccaccttcctcctttcttcttctctggtgattttggcctgatccttaagtcactttcctttagaaattacatgatcataggctcattcatggaaagactgttagagattgtccagagcctaggaccctcttttgctcatgagcacattgagaggttaagtggctcaaatgcttcacaggtaggaattttttgaatactctatgaatttttactaaaaataggaattatattcatatcatcaaagtaatattaatgtggcctattaatgtgggctatctaggagatagaaatagcccgattatgtagaatttgttaattgttttcattacatgggatccatttttacctgtgctctactatattgtattagagtacaataattaattcctttgaagcctattgaatataatgtaagaggtaactaacccagtgtttggagaactattcctacaacctgctaggtgcagtgaatatatcatcctctaggtttctcacagaatttagaacccagcagagtttactccagttccaaatcctatttcttttcatgcagatccaaacccttttccacagcttgcactctccactcttctttcctactgtctctcctgcccatcctttctctctgtccccaggctcagattggaactcttttcttcccagattaactaaaattaattcagtgtctatcagaaacatgtcactatgtatacatgtatttgcttgggaatattttaaattggtgctaaatgataattttgtgttgtaatcctcttatttgcaaaggctacataaaatattcttgattatattcttgcatagcctataacatgttcttaggtttcctatgctatgtttatcctcaataataaacttttatatacacatacatacatacagacacacacacacacacacacacacactgactttgcacagcatcttctgtatcactgtaggaagccttaaagtaatactaaattaacaaaaagatgtgtatattgcaaatgcaaataacatctctatgatttattcaaattatagtgaaaatctatatatgctgatatggatatgcatttgtcaccaggactggtttgttgaaggttttaatagtcaaacatagtttgtaattatgttaaaaagacatgagataatttttcatagttttcacatatcatttattgaacaaataccattgtaataatattagtggaaatcagagttcaaaattatcacactatgtaagaaaaatctcttccaaaaatccaactatacaaaaaataaatcagctttgcttttacatatttccttctgatttcagtctttgtgcatgcacaactgagcatgctgtaatatatatacagtatatgattatatgttatatttaggcacccatctctatcattatttcagtagatgttactaatcttggagctttaattgttaattcattgaactaaaagtcatggagcttgtcacatgtgtctcagctcaaatgccattttacccaaattttagcacttatggacaattaattttaaccttctttaccgtagtgtttttatatgtaaaatgtagatatgaccacctagcttgaagggtcaaatgaaaaatacattaagtaaatgaaacagattttgaaagaatgaaagtgactggcccacaatgaattttcagtcagtattagctttccttcccctttcttctgtgccttccctcaaaacttcataaatataataaatgtaatagactttatttaaataattgtacattttacttcagtctgttttgtgcacatttgccaaatatcttgaggctagagttaattgatttttgtaattatgtcaagtgaagaaaactgcctatgaatatatgagttatttatattcccattttcaaactcaaacaaagagatttgctattagtttaacatgacagaaaacacctagtacaaatttttgttattttttttattctttctccttttggcttcagaactttcataaaataggaatctttccagttactgataaacccataatctttttactgcttggactcattttaagatataactcttctttcatgaccatttaactttatacttttatatctttaaagtcataatctcttcaatctatattgttttctgatttttaatgttcatgtttcagcaatcaattcttaatttcttaatttcttttaactttatttaaacaattatccacattcccgggtctactctttttctaaaacttctaatatatactgtactgaaaagtttgttttctcccatgtttatgtaagataattctacacatgaaaagtatgcttacatgaaaaaaaatagagggagatagaagttacagggatttaggtaagcatttaattctcctggcagttttacatactggaactgatttaccaactgttcttttataaaattaaactagacttgtctttcagaattgagctatcactgcaattttaatcaacaaaactagttcctagatttataactgattaaaggtcagtaacttattgagacatttggaggcaaatcagaacaatgagcataagtacactgaacataagtccacaatactaatttaaaggcattttaatgaaaaatgacttttattgtattgtagatttagaattattattactaaaatacagctaaagtatttctatggtgtataaaggattactgaactagtttgcccacctttggtgccactatcatgaatgtaataaataaatacagtctccttaaccctactttatctgttagtaaaaatacccagtgggattctatagaagtatagaatatatagaaaggataaagtgaaaatgactacatccataatctgtaatgaaaatgatttattacttgttattcatggtcacctataaaaaccaaataatcagagtaacatttattaagtactcacaatatgccaatcattgttgcaagcactttctaggcattatctcattaacgtgtagcaataatcttaataatgctggtgttatacccattttgcagaggagataaaggaagttaaacaatgctatataatttgcataacttctctgaggcacagaagataaataatactgtccgatatctgtgcttatttgtccccttattaactgtgtcaagaacagttttcactgggtttgtatcctttccatgcatcctctgcacttcttttttcctcaggtagtccccttgccaacaagaagccacattctttcctagagccctctctgattttctgatcactgtgatccaggttactccacacatttctactacattgccacattgtagtgtttggcacctctttgctgccagccgtaaaaaatttaaaaaaggcaaaatatttcttctactgagtggtcattaaaatatcctagtttttgtttcttttttggtgctttacaaatagctataattttaaggtagcttttgctgcatcacacaatgtcagtgattactctgaaatcactaataggctcagtgtctacccctttaagtatctgttcacttctctccagtttgtcagtatcaagtagttgaagctagcatgcactttatttcacattattcctagataattaaatatcagtttttaacaacattcctgcctgtaatcctagattttgtgtgtgtgtgtgtgtgtgccttctcaatctctagtcccaagttaaacaatttcactcagatccccattttagagtgtaccacatggtagggagtaactacacatatgtcacatgtattctatgttttatctttctttctaactgagagataagagtgcttagttagccatgattccttggcctagtgttatggaaatttgccagatctttatagtaaactagcccagtcctacataaaacatttaaccaatattcttcccttattatgaaaaaaagattaaatttaattatttcacagaaatatttcaactgttatagtttcacatttttaaaaaataaaatttttagaacatatgtttcaatgtgtttcttcctgaaattttgttgtcctctaatccgcaagacatttcaacattgtttctgaacacgtattctttggctgttcccctcacgtagagaatagaaagaaactaaaaaagaaattaacaatgattaaaataatacatgaaataggaagttaagactatagtgcattatttacagtaagtcatttttatttggtaagatgatgcgctgtgttaaggtcatcaggaaaggaaaaaaaggaaaacataaaagattatttttaccattatattttcagtttgcttctaatatatgttaatgtataaagtgataaatgctcattcatttgaaaaggggctatataagatagagacagggagaaatgtcaaatgtcaaataatagcaaaaacaaataatacacacattcaagagggagaatgacctttagaatgtctaacagctgcatgtggtctaggtctctgctggaacaggataaggactgcatcttatgccatgttaaatgttcttctctgcaggagtaccagagcaggggaaaggtgcaagagagtgacaggtcatttcagctaatgtcagccagatatgtggactttatcactaaagataccagagatttatggaatggaacactttgaagttcagccagagtggttgaaaataaacattcagaagtaatcacagcataacggacttgcgttcattaggaaaatgatgacaacttgtttctgttatatgtggttatactcctaccatatttgcattaacctctgctagcttctcaagtaatcatgccaaggacactggtatctctttcactagagacgatagattggattctaaatttactatagcattaaacttgtatttttccctggattgttcttgaattttcttgttttgaaaggtaattttatgcccgtgatcacaaacagcataataaaatgtaacctgagaaaaacctttgttagcttaaggaactaaaaacaacattattttgtttttgtttctgttgggtgttcggaataaatttaaaaagcagaagtacctgtaagaaatgaatcttttaggagtgtgcttttctaactgctacagctaaggattagttaatacctactgggaagtgttttctcaatattaatttctgttttcatgtttcctctttatgtccttgtaaattatttgttcatttttatttttagcagaaaagagaagattggacttgaagctggaataaattattatttcacattatttttaaataatttactctctggatgtccctagtctcctgggtagagtttgctctgtgtgcacgtgtatatatatgtgtgtgcacacgtgcatgctaattttacttcataatagtcattttttccatgtctagctttcactattcaagattattaaccctaaattgttaatattccaagaataataattccaaatggttaagcatcacaagtggaatagtaccaaaattcttaaactttttttttctgaggttctgatcctctaggaagctgatagtacagaactgtgcttgctggcttctttttaagccctctctatttaaactttggagtttattataaaaggaaagaaaaccaaagatgacatctacatactttatttccctattttagcttccccagagtcatgctgaattgcatgaactcaattcaatcatattgatgtttctccctgcttgctcacttttaatactcatttacttagtgtctgtcctgttggtcatttgtaagataaaattggcagaaaattttatgtaattattatttcattgcatttaaatctcatcctgtctactttatagagttgttaggaggcccaaatgaaaaattgcaaagcacaatgatatatattgattattttgatatttagcacattttgtagaatatctacatatgccctgggtaaacaatgataaacaaaatagaaaaaacactcaaaaatcttgtcttcctgcagcttacctctaaaatggaagacaggcaataaaggaatgatgacatatggaggtctatgaagaaaaaacaggagcaaaatggggtagagagtgatagaggatatgaatttagattagggggccaatgacattgtgtctgaggaaatgacatacaacagagactaaaactaagtgattattcaggaatagattattctagtgggaagaaagagtaagggaaaggagagaagagagagagggaagagaaaggagaaaaaggaagaggagtatgggaggaaagagagagagagagagagagagagagagagagaaacatgctagacattttgaagaaccagcaagaatgttagtgtagccaacagtgaggcaggcaaaggtgagtaaggtagattagttcagggaagaaaacataacattatttaatccattgtgggccacattgcactatgataacactatcatgtcatagagtctcaccattgtttaagatgtttaaattttttaatacgaatatattctcacaccctccgttttttagtcaaaaacctctccctgaatatcctgacaacatgacagaggatctgctgttcctcttcagagttagtttccttgcttggaaggctccttgacagcagtaaccagaatcttgcagtggtttggatggctggttttagtagtagtgacctctgtacaagcgtgtctcactttcaatggaatgtccacaaggcacagattacagattacctctacatgttaattggatctatcatactacttgggcaatatttataaatagagttggtaagatttcaagaattcctcccctcaagaaagaagaatgcttagataaatttttattcatagagacaataattggaaacgtcttattcattattccaaaaagaatcttcttgtggtttctataaacaaagtagctaatataatataaacttaagtttaaacttgactttatattatttcttttgtgaaaaaccattttatatatatacatgtcattataaaatatatatataatcatatagcctgtgaattacagtggaaattctaagttcttgaaacaaatttctagctagtaactaaagagaaattagaatgtgaaaaagttctgaatttttttcaaactcatcttctcaaatgtatatgaaaatgatctcaaattaggatatttacatttctaggaaaatgtggtgtcctttaaaagtatgcactggaatttcacttatcaaaattcatttaaaaactctttattgagcaattactactctgttcaaggccatgtgttattcactgtggaggtactatattaaataaaattgtagagtttgtcctacttgtagttcataggagattgagatgtataaagaattgttgcaaaacacagatcatgcagtttgaatcattattgccaaataatgtgtcagactgaccttgatttactttttgaataaagttttaaatggttaaaatatattttaatttctattaaagttagcacaaactctatatattatttttaagtagaaaggcaagagaaactatgtgctaaccacaaaaagtgccagtggataagcagtctgaaatttagacattagaggtgaaattcaggttacggcacttagcccgatctgtcttactttagttagctgagcattgatctgtcttctagtatttgtgttaccccagaaggaaaagaatttgccttacatattttgctgctcccatgaggaatggcgctttgcttttcttttattgagggtaagcaaatacttgtgaaataatagaaagataggaaaggaggaaggaagaaagggaatacatgcagacacacagtatctactagtttttcatttgttatttcttctaaattcagaaaactggaatgactcaatagctgacacaatttatataaaaaacagtcaaattgctactgtttagagagcagaccctattgagccagacaatttttttaaaatcctggtttacataacactgtaatcttctacattttaatttatacagtagagttaattcctatttcattggacttttaggcttactttgaataagatgaggtatttacaaatctaacacacaatagaggcaggaacacctgctgcatgatttcctagcattattttcccctacctctttccagtatgtcctgatttcactgtggatatctacagatattgctgcactaggagtacagcatgtgacccagccttcattaaaccattgcatgtgattctcttgtcagtggtagttggtaagggggtcacacatgtcctaaactggcagagtttcagagagtctcagaaattatgcttgaagcttagaaacttgaacacacgtttacccattttcagtgatagtacttttctcagtccctttctgctgctataggataatatcacagactgggtagtttataaggaaaaaaaaatttacttggatcatggttttggtggctgagaggtccacgattgaggggctgcatcttgtgagggtcttcttgcagcatcatctaatggcacaaggcagaagggaaacagggcattcgtgagagaacaacagattgaactcacagcctcaagccccctcataatcagcattagatcattcatgaaggtggagccctcatgacttaaacacttcctgttagaccccagctcccaccactattgcactggggaataagtttccaacacatgctttctggggaacacattcaaaccacggcgttccacccctggtcccccaaattcacatccttctcaaattgaaaaatatattcatttcatcctatagtcccccaaatcttaacccattctaatatcaccttaaaaatacaaagtttaaagtttcatctaaatcaaatatgagtgagacttaaagcatgatttattctgaggcaaattattttccatctgtgaaattaacaagttatgtgcttccaaaatacaatggtgggataggcatagggtagacatttccatttcaaaggggagaagcaggcaagaagaaaagaataacaattcccatgtgagtccaaaacccaacaacgaaaacaaaattcttaaagctgtggaataatctcctttgattccatgttgctcatcctgggaaaactggggtggggttggcccttaaggcctcaggcagtcctgtttctattgctgtcctgggctcagtccactcagcagctctcacagatgggagttttgttcctgcaagtctacttggctggaattgtactctgggggctgtatagttctggggtcttgaaggcagccctgcctcccatggctccactaagcattaccctagtggagactctctgttgtggctctattcctgtaacaagtctctgcctggtctcccaggctgtctgagacatcctttgaaatctggatgaaggccagaatggccccacagatattgcattctgctcatctgcagagtcagcaccatgtgttgcttgtgtgtacgtggtgacacaagctgcagctgagcccactggagccacgattaggggtcagttgagccaatgttctggtggccaaggaacactgcactggaatgtagtgggcagagtaccaagctggccatgggcagtgaatgctgaggccccacaggtgcctttctggaaactttgtcctcaagatcttagtttgcctctaagatctcagaaatgcctttagggtcattctcccattatgttgaatagcacctgactgccttctatttgtactaatctttttagcagatggttgcttggacactcttggtttgctctcctaaataagcctttttcatctttacatggccaggctatgaattttctaaatttttcccttctgcttcccttttatttataaattatatctttaaataatttttctccatttgcatcttactatacatggttaaaactagacaaacaacttcttccgtattttgtttagaagtttatcccaccagataccctttttaaaaacatttcatttatttagttagatatggggtcttggtttgttactcaggctgaagtgcagtggcatgatcattgattagcatcaaattcctggtttcaagtgatcctcctgcctcagcctcctaagtatcttggactacatgcatgtgccaccacatgcaactaattttcttttcattttttagagatgaggtctcactatgttacccaggttggtctcaatcttctgggcccttgcaattctcccatctcagtctcctgagtagctgggattataggcacaagctacctagactggctcccaccaggtatcctggttcactgctcttaaattctgccttgcataaaatcctagggcctggacacaattcctccacattctttgctactttataacaaggatggcctttactccgttttgcaataacttgttcctcatttctgtcttagacctcattggaactgcctttgccatccatatttccaccaacattctgattatgaccacttaagtaatccctaagaagatttaggctcttgttacagctcttgttttcttcttagcccttgctggaattgcccttaatgttccatttatagcaatctgtgcttttgttagcctactccttcaaattcttcctgcctctatccattatctagttccaaagtcacttccacattttcaggtatttgttattgcaagaacagagatttatttcttatagttcttcaagttgggatgctcaagagcatggtggtggtatttggtgaggacttctgtactgcatcatcccacggcagaaggcagaagggcaagagcacatgagaggaagagagcaagaggagtctcaactcgtttttttttttaacaagcccactctggcaataatgaacccactctctttataatgacattaatgcccacaaggtagagctctcgtgatgtaatcagctcttaaaggtcccaccactcaacactactacaatggggactaagattccaacacataaattttgggggacacattcaaatcataacagtactgtatgtggatgaaaaacctacacttgctctctctatcttggctttcagcctgacaacaaagccagcatgcagaacagagctgagccaagaaaatcacagaggaacagagccaagttttgatagtactgtgaacctctggatcaaattgtgcctggagcctgccctccctctagagttttcattatacgagccaataattttctgttcaaagttgatttagttttcttttttattctacattaagaatttgaactgatacaataggtagtcaataaatctcagcttcatgacctcttcagcagttgactactatattggaaagggtcacattccttgtggctttttatcttgttgtttgaaagaactgtggtctaagaaaaattatgtttaaagttttaacttcagagttagcatcaagctacaccctttgcagaataagagtggtatattacaaagtttggcatgaagttactctcagcctgagtgggttggaatcccaatccttttagacacttgctgtgtgacctacagtgatttactcaacatatcagaacttgttttctcatcacataaaagatcttggtattcttttctcacagatttattgtcaaataagagaattgctgcaaagcactgagagatttgcccagcatgtaatgaactctcagtaatcattaatcattattatgatttatttttctttcagtctgactttggggaaaagttatgttaggaagctgctgaatctcaattatgattttcagtattaagcaaagaaatcacaggtatcttgtgttatgagtaagtcaatgcatttcccaattgatctgaagcactttttcttacttatgcaattaaaggaagtctaaagtatacaataaaaagttatttgtattttaaagggtataccattactggggaatattttctgccaaataaaaaataatgagttactcagagagatggttgaatgactagacttgaatggtaataaaaagccaaatgccaaatttgcacataaaaatcatcttagaagtgtaccctgagtgattgattccaagcattggtttatctgatgcttgagaagtcaataattgaatagtttttaaagagctatgtggtggtccatggaaggaaagtcactgttttttactttattttatgaggacaaaatttatgtgtatacactgacaaacttacaaatgcaaaaaaattaaattgctgcataattttattatttagggataagaatggctaacattataatgtatggccttgattttcattacatacacacaaatatttgcggtaatgtctatgttatacaagtacatatgtgcatgtgtgtacacatttatttgtaagtaatttagtgttctggcttcatgtatgcttagtaattcttagatgtcataaggacaccataatcttcatatatttagaactgatatccttttctaacccctttttcactcaaagcttcattatgatgtctgtttcagtgacaggcaacaacatctagcagttgggaaagccagatccctataaaaatgcttgaagcctcctttattctccaacctcctaaccaattaaacatgagtcccattgtttctgcttcctaaatatctcaaatctgtccattcctccacatttctacacttgatcttagccaaaaggttaagaagcaatcgttcctccacatttctgtactattccatagccagagttcccatcatctctgactttggctgctgcagtaacctcaaaacttgcatattggtgtccactacccctactcacctattctcctcagagtaatttgagtaatattttaaaaattaaaaataacatcatgtccctactgtgcttaaaatctgtatcttactatttggcctccatgggtcttaagataaaacagtaaacgttttacatgacttataagtctctagatttttagatctctacctcctcaccaaccattgctactcttatcttttgcttttttagtttctcaaaggtgtcatgctgcttcttcttcaggaccattgatttttttgcttcctatatctagatgactcttgaaacatcacacccatcatgccccacgattctaatcaaatgttatttcctcactggagtctttttggctttacggaccaagtcaggtctttcgttgttgtttttttttttttttttttttcatgaattttgcttatacttcacagcatttacctcagtagaaattaaaatgtgggggttctttgaaactttatataatatgtctctcatgctactatatacttcacaaggtcagggactgtatcttaacttgtcagagccatatctccattatttagcatagactttgctcgtaagactgcacataatcttttgtccttttattgtttcataaactctgtcttatcttttctaaaataatgtttttaattttggattgttgtttcactgttaagatagaaaacggtttatttaaccaagccccctgttattggacttttaaattatttttgtctacttattataaataatattgcgatgagttcaggaattcattgaattaaaggcattgtagcttaagttctctacaagcagagcctgagttggagattcttgggtaagcaatttattgaggaatgtgcccagaagaaaagtgaactgagtgaggaaagcagaatagggcagaggtagaagctaagtgtattagtctgttctgacactgctatgaagaaatggctgagactgggtcacctcagaaaactcaacaatcatggccgaaggcacttcttcacaaggctgctggagagagaagtgagcaagagaggagctaccaaacacttatgaaaccatcagatcttgtaagaactcactcactatcagaagaactgcttgggagcaaccactcccgtgatccagtcacctcccaccaggtctctcccttgatacctagggattaaattgcccaaggagatttgggtggggacacaaagcctaaccttatcactaggcaaataaatggttccagaagaagtctttcctgagccagattccaacgaggtatctggagtgaaaatagcaccacagtagttatcactcttagaaactaagcatctaggctgttacatccattattctttggccatgaactgcctgcgtgtgtgcatatgtgtgtgtctgtgtataagtgcacaggtgtaaacttacagtggcttgcctgtacatgggatctagaagaagcaccaacagtatctggtacaaaaaagaactagggatgctgcatggaagagatttttcttaagtattaagccttgggacatggtaggattttgatatatacttcagagggaaaatatgttctgaagagaaaaaacaaaagcacaataaggaaagtgctgagcatgttttagagaaattgaatagtttgttataaataaaatagaggtaaagtgaggtgtgagtatttggagacaaaaattataaagacggattgtacctataccataaaataacttaaattttaaactttatagaatatacattgtgaacagaaaagtttttcaatgaagagtattcacagatacattgcattcgtataattttgggttacttttaaaggtctaaatattgtctactgacacatagtttcttacagtattaattgagaaattatgatagtttaagtaagcacaaaattatataacattgttcctggtgttgagactcttacaatataggaacatacacaaaaacatacacacatatttgcatatatatagtatctctcagttttatgtgtattaaattcatgatacaaaaaagaattgttctgaaacatagctatctatctaaaacattgtatggtaaaaattcataaaacttacgtctatgttcctaaatgtcataaaaacaattgaaaattcatttttaaaggaaatgacatgcaaaatagtgtaaagaaaagcatattttgtgtacacgtagaaaatcttgtgttcataaacattatttaaaatcttaaattataatcttgactcctaaaacataaatctaatatttagttattctcaatttaatttttctcatttgtaaaatgctgttggacactctttattttacaggaggtgtggcaattgaagttaatgagttaatgtttatagatgctttttgaggcctttagatgaaaggtacaatataaatccaaaatattaatctttaggtgtgaaatactctaattacttcccattgccatagggacattattggagatttataccttcctctaaaatacctggaacaattgttatatgagaaagcataattttaggtgaaccattataattctgtagtcattaccatgtatcaaaaaataaagtatatgtgttatatattcagcaccttcttatttcccattattcatttattgatatacaaacattaagatgactcggaaagctgatccattatgctgttctatctatgttgctgctagaatcttttttatatacagaaataaggggaaaatatttttaaaaagaggttgagagagcagctactgtactccatatattggttttaacactagaccaattcaatattcattaactatcctatgatagcaaaggaagaaaattcgtcattgtagtagtattcttatatttaagtaatgaaagtggtaccatttatcgactatatatatttaccaggcatggtgcttatcatatttcatacattattatgatcctcatagtaaccctataaatggagatggaactgtggaatttaaacatgagcaaaggagacaaacaacaggtaattaattagctcaaggtcacagaagatttaaacccaggcaatgtagaatcctgagttttttctttaacccctgaagtatactaatttccccaaatgctaccactttattattctgtttatttcactgttatggatcctactgaatctagactgcacaagataattttaataacgaaataaaactcgaagaagttctcaccagaagcagaggtttcccttgccaagttattctacatgagctgcttatctggtttcttgccaaaccaatatgcataaacactgaaattgcagaaagaagaatgcaaatcacaaagctcgtttttattaggctcatgttgaaaacacataactgagcttagcacgtgtaaactgagtttaagaatggttgtggcattttcttgaaaactgggaaaaaatattgtatatttatactccacaaagtaaaccaaaaatatccctttgaagtatttaaatgaacaataaaaaataatgtattatttaagataattataaaataaagctattacttgtgaaaatttggagaaattatgattctagtttaaaagtggtatctcctttctcctttctttctatttcgctctcccacctcacccccatcatctcccatatacttgtacaatcacaatcaccgttcatgtaaatcaaatttctgaaaccaaaaacgaggtcttattcctgctcagtccaatctatttgccacattttcccgcatgagtgtcccaaagtaaatttgtatgatgttatttacagcatctcagagactccatcaacattcaattctgatcttggtgcacaaagcccttcttgatttggcacttgcttaatttccagttcactcctgccactctcagatgtgcttcctgatctttgactttccctgtagaaatgctacctgcttgttcatggcttggtgcctttcaccatgttgttctctctaactggaattctacatgatgaacacctactcattgctcaaaattcaatgtaaataaatagttctctgagaagtgtttctgaccttctccaaacagaaggatgatcacccctgtctagacgcttgcatagcactctgcatttactatattgaattataatttttattcagcatattgcattgcaattacttattcactaccatatttattatcagcctattaaaacctgtgcctgtggcttattggtcttgtttaccatgactggtacagtgcagagtaatgtctagacagttaaaatgggaacttctctgtctctgagtttttttctgagaccacaaagcagacaacagtatgggtcaagtatttttacattttagactgtctatatgagcttgtaaagggggttcttaaaccattcctgcagttttgtgataagcaaatattataaataagttaagttctaatacaatatcacctcagtattatatacaaaagggcagtatctagtatataaaatataaaatgtgtatactatacagtatatggtatacagtagatagtatatataaaagcgcagtaagctgctgcccttttttatttaatatatgtggcttatacatttgatggtgttaatttttcaaatcaggttagaaaatcttatcagtctgctagcacacttcagttttgcacctttattacttctgtcactgccatgttatgttactattgaaaataagccctgtatggtccaatgtgtcctacctaatgtggatcacttgctagtttagattcctacagcaagagatggcagttctccactgactttctaaggcttcagagatttttttcagtttatattcatatgctcagctatttcactgaaaaatgatgccactaaagtctagagctgcttctacccccatccacagcctacattgcaatccagcttccccaaggccactcaataataaatgtgatgataaatctgttacaagcagataaacacttgagaatcaaggttcatctattggacacctatggataaatgagtatttggggtatttaaaaaatttatgtggcccagcgtggtggctcacgtctgtaatcccagcactttgggaggccgaggcgggcggatcacgagattgagaccatcctggctaacgcacggtgaaaccccatctctactaaaaatacaaaaaaattagccaggcgtggtggcgggcgcctgtagtcccagcttcttcggaggctgaggcgggagaatggcatgaactcgggaggcagagcttgcagtgagctgagatcgcgccattgcactccagcctgggcgacagcgagactccatctcaaaaaaaaaaaaaaaaatgtttatgtagcaacttgaggataccaagatggtcatccattgtaccttgctggataatttttaaattgaggaataacaaacttatttaacattttattcattaattaaaaaatatttattattgtactactgcgctgggcactgagaattcaggaatgaacaaaatattccaagttgctatgctcagggaacttacaatctatttggggagacaaaaaatgcactaaaatgtaaatatgtatgtgtgtgtatatatatacacccataaatatttatacacatatgtatgtatatgtcaatatcatcaggagacttaacatccagttggagaaaataagttatatgttaaataaaattcaacagttaaataatgcatagaaatataaaataataattaaaagtcccaagagagaatggattttggtgtatttgtttaaatagtgaaactatgaattaagaggatgtgatcactctagcttgaaagggttattgaaggaaaggagacttgagcctgaagaagccatataattagagaagtcagtgatctcatcaatggctcattttagttaaagcatttagaagcaacagtcttacattagaactctagaatgtttaggaagatttactcataacctatacatatcaatagaaaggtgttcttggaaggaaattcattaaacaaaatctgatacatcaactaagactcaattctgagtgttccttcatagatttctgcctaaacaattttggtggagggaattttcagtaacaccataaagtgagtatattgattgtcactgtgaagaaaagcatacagattttcaggcaatctgttcattgatagatgtcttaataaacttcaaaactggcagctgcttcccaatatcctaatattactaattgtgctatattctcttcgtcacaaactatatcctgggaatgagttgacaacctatagaaagataaggatctcggtcccgtgtgttcactgtgtacaccacgaatgaatgggcaattgtggcatagtgtaataggcattcagtgaatatatttgttaagtgaatgaaatatataatatgaactgaaagatataaactgagtattccctatagtcctatggggaaatttgacatatttcgctataatgcaaaaataaatttaatttatcatttcttatttaagcttattatattctcaatatttctctcctgcttatctattggagttcctctgtaaatttaacttttttgtaaaacttcgattttcttctctgtgtgtttttttgcatggtgggtgatgttaccaactgcaaaaaaaaaagctcaaatcaaatcaacatatatatgtttgtaattatacacatgcttagtactattattatatatgtaatatttacatactatacataaacatacactatacacattataaatgtacactctctgtatttacaattaacccttgaacaatgtggagattgtggtactgaccccctgtacagtcaaaaatactcatataactttttacttcctagaaacttaactactcatagcctactgtagactggaagcctaactaatagcataaacagtatatataatgtgttatatataaaaatatgtgtttttaaatatatgtgtttatattatatatatatttggagatggagttttgctcttgtagcccaggctggagtgcaatggtgtgatctcggctcactggaacctctgcctccgaggttcaagcaattctcctgcctcatcctcccgagtagttgggattataggcacccgccaccatgcctggctaaattttgtatttttagtagagacagggtttcaccatgttggccagtctggtcttgaactcctgaccttgggtgatccaccagtcttggcctcccaaagtgctggaattataggcgtgagccagtgctcccagctatatatgtattatatactgtttccttacaaaaagtaagccaaagaaatcataaggaagaaaaagtatattttatgttaagcagaagtggatcatcataaaggtcttcctccttgtcttcacattaaataggtagaggaaaaacaggaagaggaggagctggtcttgctgtctcagaggtggcagaggtataagaaaatctgcatataagtggatctgtgcagttcaaacctgtgttactcaagggtcaacttataatttaataattataatacaatatacaatttttttaatgctaagatgaagccaggcgactgagctgatctgagactacattttctgtaggcatgccatctgggtttctttaagcacacctattccccttcctcaattttcaatagaaatgtgttatttgcccattatttgtaaataaaagtatttagagtataaaattaattgaggaccactgtgaaagggcttagaaattcttaactaaccactttcttccctatgagttttacatgtattgcatcattatatttccctttattacctaacatttttaagattcttggtttctattcaagttatcttttgctgcaaaatatctttttccttacaaacttagtggctcaaaacaagaagatttattttgctgaggaatctgtgatttgggcagtgctcgacagggacaactattcctttcttcactcggattcgagtggtgtagctcaaaggctacaggctagaattttctgccagcttgctcattggtggtgaatgctcagatcagttggaacctcatcagggatggggctagaatacctacctgtggcttttctgtaattccacatagtgtattgtctgaggtctcaggtgaatgtcccaaagagatagagggaagctttattgcccctgaagtcacatagccttccttctgccatcttctgtttattagaagcaagtcactaaggctggccttttttgaaatgtagggagttagataccacctttaaaaaaaattatctcaatagttttgtgggtccaggtagtttttgtttacatggataagttctttagcagtgatttctgagagactttagtccacctgtcacccaagtagtgtacactgtacccaatatgtagttgtttatccctcaccctcctttcagctttctcccctgagtcccaaagtccattatattattcttatacatttacaactttatagcttagctccctcttataagagagaacatgtgatgtttggttttccatacccgagctacttcacttagaataatagcttccagctcttataagagagaacatgtgatgtttggttttccatacccgagctacttcacttagaataatagcttccagctccatccaagttgctacaaaagaaattatttcattccatttatggctgagtagtattccatagtgtgtctataccatgttttctttatccactttttggtcgatgggcacttagattagttccatatctttgcaattgcaaattgtgctgctataaacgtgtgtgcatctgtctttttcatatagtgacttcttttcctttgggtagatacccagtagtgggatagctggatggactgatagttctacttggaaacttcgtactgttttccatagtggttgttctgatttacatttctaccaggagtgtaaaagtgtagacaccacctttaatggttaaatattgcagaaaatcatctcagctttctaagtcataaatgatattatggtaaagacaattttgaaatttcacagagaattttttaaaaattatctataacgatttcctgctattgccagtttctggatatcttctgcttatttaaagatgaaaaaagcccccaatacttttttgaccatcacacaaactatcttgaggtctcttgtaaattaaaacacaaaagttcttgaaagtaagcatcgttagccttctccttttggtttcttaattaaccccataatcagcatattcaatcatcaatctttttagtatacaaatgatacaaagtgacttatcaaaagtgttgttaataatttacaggtaatagagtaaatttatatgtttatgtacctcactttacttcttgggaaagacatttcgtgtcaaaaagcataatctgaacaaacaagaagcaccactactgattgggaaactacttactttagtgctaccttatcagctcttacctataagccatgtcagctcctcactggttttcatccctaagtgacatcagcagcagcaacagctattgtgttattgatttaaatccttctgagatcaattcaaaggaggagaggtctcatttccattggtttgtcctgtttatcttgtgtagggacacaagtctgagaaatcaaaattttattctcttgtttctaacaagccttacaacattatatttcattcatggtataatttgactcatattttattttctgaactttttttgttttgttttgtttgcgacagggtcttgctctgttgcccaggctagagtgcagtggtgcagtctcggctcactgcagccttgacctgccaggctcaactgctcttcccacctcagcccccacaagtagctggaactgcaagcaagcaccaccatgcctggccaatttttgtgtttttctgtggaaatggagcctcactgtgttgcccaggctggtctggtacttgaactcaagtaatccacctgccttggcctctgggattacaggcatgagccaccgtgcccagcctatttcctgaactttaaatacaatatcagggagaaaatcaacaatattttgcagtaaaagttcgaatattcatgtaaacatttgtactcttttcccattccattggaatagttaataaaatcagaatataaaaatttcatatgcaattaaaaaattcatgataagttaaaggagtttccatcttttagtttaatgatttaaagattttacttctaattattttagttgcaagtgatatgtatttatgcatatatctatctctcattatgcatctgtctctctatctatctcatcatcttttgatacttctcctaggctgaatgtttcacattttttctcttagtccagaaaatatgttctgctttcctgcttatatggggaaaatgaccactgccaatagcttcaagtttatttctctcttattccagaaggctggcagattgagattagaatctctcatccaattttagtttctgaggagcaactgatttgccaagctggtgtcagctttttagccctgaaccaaaaaattgtggccaaagaatgatgagttcattttaaataaatatatgactagaaatagcattcaatattaggatagttcagtgtggaatagagataattattccctgaaattataaagtgtgtgtgaggctatgcacatgcaatatgtgtgtgtgtagatatgcctccatattgtggtatggcagtggtggcttatttgctagtgagataaacaatatgtgtccactttgggatgttacatatatgcctaatcaatattttgaggatgagcctatttacttctctggttgatttaagtacagaaaagtgtaatgaataatacttggcttgaagatctagctatacttagaataggttgacagaaccattaatttcaaatgaatatggacctttattttgggtagaggattctattatatatttgccaacaatgcagaatgttgtttcttaataatagtattgagatctaaaaacatttacactgtactgtgtgctcagaaattacataagatgaaacattggtataacctataggaaggcgagattgagggatagttgttataaataagaggcttagcttgttaagaacaaagaacagagtttttctgttctttgagatgatttatgaaaagagacacctttcatacattagtgcattaatatatgaatataatattatattgtaatattacgtaattgtaatattacgttttatgaaataagctaatcatctctgaaaacagcagcagctttataaaataagtaatagtagcagactttaactgttttgttgagaccgattatttgccctattgccaaggcaggagtacagtggcatagtcatagttcactgcaacctctaattcttgggctcaactgatactccttcctcagcctcccaaatagctgggaccacagtcatgtgccaccatgcctggctacttgttttactttttaaaatttttagtggagatgaggtctcactatgttgctcatgttggtctcaaactgctgggctcaagtgatcctccctccctggtctcccaaagtgtagggattagtcatgagccaccatgcctgaccagactttaatattttaggcgaatccttctagttcttaacgtttcaaccttatagattttatatttccaagcattttacataaaccattttcagtgaaagagattttcaaattatttccttgacagggatgtagaattagtattcatttcacagaaagaacaatgatatgataacagaagtattcactgttagggaaaaaagttggaactcagagttcctgaggcatgtttgaatttattcagttaaattatgtttatttcagaaagactgaagagctaaaagagctagtttcagctttcttataattaaatcagtgctttatacctgttaggctaggtgtaaatgaaagaaataggggtgtagaaatacaaggtatgttaattacagttcattcataatgcattgcaaaggatctttcctaattgcagaagcatattttaagaaagtttcaggtattaagacatagtttatgagatcttgcacccaaacacataacgtctccaggccctaagcaaggtaaagataacaaccaaaagttgtccagtttaaattaagtaaacaaactctgtggaattatagtagaaagaaatttaatagcagagggtagataacaaagagattgaagataactaattacaatattaattagtacctttgttggccttaaattggtggacctaagagagtactctgaaaatgcaacatgtattaattgaacatgtgggaaactaccaatactagagtgcttttttttttgagtgcctatgattaattgtaatgggaagatggagaggttttattaatgaccaccactggctagctggctagtaagattcttgataaagaaatgttattattcttggctttttaaactacacaccaagctttaatctgaagtatatttcaaaaagttaatgttaaacaatttgaaaatgtgaaacatggaaaataacacaattatatgtttataagagatagggtagttttaatgacttcctaagcagaatggactaaaaatgactaaaagtttgtctaactctatactatcacaaaataattgacttgtccgtttttaatgagtatgcacgtgatcaattgtcaagttaataatgccaattattatctcagagatgtcagtctattattaacctgtgacagatattaactatacatattggtaaataataaagtgtgcaaggggaaattaattaaactaatatataaatgtgagtaaaggggagatgattgatatttttgtatatcaagattttacttttatttaaaacatattttatttttaaaataaaatgaaatttaaaatattttataataagcaactcaaataaatatatgaagaatacattttagcgcattattttgagaaatttatcatctgttattaaagattttaattagggaaatatttttaaaaatagatggtattttaatattttgtattcctataaaaatacaattgaggatgtttggaataatctgcaggggaaaacatttttaatcttttattataaagtaaaacacagataatgaaaaggaaacatgaaaaatgaaatagtttaaaaatttattgtaagccaaacactttcataaccacatcaaggtaaataaatggaattttaccagtaacccttaagttcttccacctgcttctatcccaatcacaaatttctctctgaaaaagtagcattctccctcttttttatggttctactatatgcattttgggaaggcatataaccattacatattacaatccattctaattttcattttcctttagttctataagtgaccgtaggtcagtgctcacaaccttttcatttttctgtgtcttgctactcattttgattgtctgaatgtcagttgttgaagtcattttttttagtatcatgcatgtattacctcattttttcatggcataaagcattggtgctgaaaagtctactcataatctgctattctttcccttataactatattgctgtttcctccaacaaatgcccaaaggatgtattgttattctttaatatccactactctctctctttctttataaaagaatttaacttgatatcagtctttctggatacttatttcagatagatagtgtgctcttcaatgtacaatttcacatttttaaaatcacttcagaaaagttttcttgaattataattttaaacatttgttctgtctccttactttcattttagtctccagggtaacataatatatgtatattgaatcttgcttgcctatcttcaatatttatctattttgaatctgttactttttatttgtttgttgacgtttaaaatttccttccttcttcccttctatctttcttaaagcataatatgttgtgataaaaattacattttcttaacagctttattgagatataatttacataccatgtaattcacccatttaaaatgtatactgcaatggtttttagtatatacatagagttgtgtaaccattacttacaattttagactatgtattcactccaaaaggaagtctatacttaatagtggtcactccaattttccccaaatgccccaagccctaggaaaccactaatcgactttctgtctcaataaattgcctgttctggatgtttcatataaatggaatcatataatacgtggtcttttttgactggcttcttttacttagcatattattttcaaagttcatccgttatgtagcatgtatcagtacttcatacttttttatggccaaataataatttatcatatggatataccacatattgttatccattcatcagttgatgaaaatttgggttgtttccactttttggctatcatgattaatgttgctattaatatttgtatacaagattttgtgtggacatatgttttaatttctcttaggtatataccaaggagtagaatttctggttcatatggtaactctatttttaacattttgaggaagtgccaaactcttttccaaaacagctgcattattttatatttctacaagcaatgtatgaatgcttcaatttctccagattctcaaaaaaacttgatattacagtcctttaaaagctttatttaatttgaattgacatgtaataattgcacatattaatggggtagaggttgatattttgatacatgtatgcaatgtataatgatcagatccaggtaattagcataaccatcacctcaaatatttatcatttgtttgtgttgggatctttcaacatcctctcttctagctacttgaaaatatataataaattattcttaactatagacaccctacagtgctatgaaacactagaactttttcctcctatttagctgtaagtttgtagccataaaccaacctctcccttctcttccctcccatttactatttccaccctctaataatcacagttctgttccctacttctgtgtcctcaagtattttggcctccacatatgagtaagatcatgcattatttatctttcagtgcctgatatatttcattaacataatgtcctccaggctcatctttgttgctgcagatgacaggatttcctcttgtaatgactcagtagtattctaatgtgtatatataccacattttcttatccattcatttgttcaaggacacttaggttgattccatctcttgactgttgtaaacagtgctacaataaatatggggggcagatatcatttcgatgtacttatttcctttccttcaggtaaataacaagtagtgggattgccggatcatatggtagtttatttttagatctatgaggaacctccacactgttttccacactgggtgtactaattcccatcaacagtgtattagatttcccttttctccacatcctcggcagcatttattttttgtcttttgataatagccattctaactggggtgagatgatatggcattgtggttttgatttacattactcttatgattagtggtgactatttttttcatttacctgttggctatttctatgtcttcttttagaaatgtctattcagatcccttgccaaatgttaaattggattattttattattattattattattattattatattttttgctatttagttgtttgagctccttgtatcttctggatattaatcccttgtcaggtgaatagtttgcaaatatttttcccattctgcaggtggtcctttcacttcgttgattgttacgttttctaggcagaggatttttagttttatctaatcccatcagtcaatttttgctttcattgccaacacaagttattttctgctttttgtgtttgttgtttcattatactaatccacttaggtgtgaagtggcatttcaagtggatttaatttgcatttccctaataactaatgatgctgaacatccattcatgtgcttattggtcatttgtaggtttattaggataaatgcctatctaagtcttttgcctatactttaattgggttgtttaaatttgttgttgttgagtagcaggtgttctttgtctgttctggatggtaaacacttttgcttttaacagattgattattaagtgtcttggtttggatctcttcaaatttgttctagtaggagtttttttcagatttctagatgcttttgtgtcttccatcaagtttgagttttggctaaaggtttttgttattatttctttaaatattatatctttctctttctcttcttctgatactcccagtaatctgtatgtttgtcctacagtttccttaagcttttagtttactttttctttctgctcctcaggcatgatagttcatattaacttaccttcaagttcactaactcttttgcctactcaattctgcttttgaactctttcatctccagaatttctttttggttattttttataatttttatctctttacttttagttttgttttgttcatacatagttttcctgattctctttattgctttatcaattttttttttcatttttcaacttaattaaagacagttgttttaaagtctttgtctagtttttccagtgtttgggcttcattagtatggtttctgtctatttactttcttcctttgaatggctgcactttcctgtttttatacactatgaggttatttttgttgaaaaattgacttttaaatattaaaatgtggtaactgtggagattaaattctcctccttcctcagggtttgttgttatttttgtttttggagtctctaatcatttgtctagtgacttttccaaactatttttgcagagaccatatttctcgtcttgtgtgcctccttgaagtctctgttccttagcttgtgtttaaacagaagttttcttgaacaccagtaattaaaatctaaaacaaataaacacacaaatagccatctttaccagcctttccagattggctgtgtgtggggcccctccttcaacgcttaaccagacttgcactgaacatatggatcagcccaagttaaaagcttaacatcttgttttgtcatttctcaacatgtgtcatgccctggtcacgcacatgacttcctaattgccctttccataacctccatatcgattgccctaatttcccaagaaaattccctctcagattttctgccaaagccttaagctgtctattatatttctcaaccataaacttttgcctcaggcatccgcagaatgttttgcagccttgcaatgttttcaagaaatgccgaaacttttccaatgtgagttccgatttaggcaaaaagagagacaaatgccatgtgctggctcttcaggtagctcccagacaggttagaacatatctacacaataatttgtgaaaaagctctgctctgctgcctccagaaccagggaccagcgttcctcactgggaacatgggctaatatcttcaagactgctacccaaccatcaatgagtggggcgaggacagataaatatgccatagagcttccctactgtttttaagttgactttttctggtttcagcatttacttggttgctgtgaacctttgactgtcttatagagttctgacaaatttggttttgatagtttctgctggtttttttatgtttctgtggggtacatgagcttgtagctgcctactctgtaattttgctgatatcactgaagtcttcatttctgaaatggtatcttatttttttcctgagtattattacattgtttctgtttttgcagtcagaatttctggtattctttcatgccttttactttttcttaatgttttagctaattttaaaagaatatattactcttctctgggtattattttgtttttcagtagtaaatatgaattagttttgttggagacatagattttatacattatacagattgtgtcagcaagtcaatcagaatttattatatgccaactgtatgtcaattatatagcatagaaagtaaaacaaacttggttcaattatttatgattaatgttgccctagacctgtctagacagttagaattagcagatactgctgtgatgattgcctaacataatacagacaaaatggagatgagaaatcttaaggggacttataggtcaatgaaacttttcttctgaacttaccacctcccacctttattacgctatcatttagaaaattgcttatgaagttcttctgcgcaaagtttatttctgaaaattgtgccctgcttgaaatccttgttttaagatctttacatgctgccttattcttgtcactcaataatcaattcagatgtcactcactcatggcgactcctcctcattatcctagctcaagctgccttttctaatcatcaatatatgatgctgttttttgaaatgtatttgttttcatgcttatcatctgtattttctctctagaatgtaagctcctttaagttggagatgttttcagccatggccacattacgtatgtagtttctaaaaagatacatagctcagaatggctgtagatttttctcttctttgaaatggatttttttttacctcattatttccttggactaattgataattttacataggcactgtctacataggcatgcaaaattttactacttaagtagtaagctagagttatattgtgtgcttgagcaattattagcatttagactatagatttttatgaagtaaatatttaaaatgttactacaactataattaaataattgaattttaaatttcttttagggtgactttcatactatgaagaaaaaaaggtcataagggtaatgtgtgctaacagagctgacttactctcatacactatttaactttacgttatgacatataagccaaaactctaccctttttcaagctgctttcctaacagagtgtttttcaaaacaaacaacaaaaatatttggaacaaattaattctcagtttcaatatttataattattccccaaatatagagaagttttaagatacgtaaaatagagataaaaactatgaagggtttgcctgttctctggaatttattgaggtcatttgtacttataggatatcaggtatgtgacacagatcaattctcttatatgtatttcaacttgttttcacaaacttctcattcagccctatagccatgccagacagtaaaatttttgttaactatatgcaaaagttgatctccatgtgcagattgttgaaggagaaaaaaacactggttataattttcaaaaactaaaatgctaaataaaatggcatttcattcatccattcattcattcataatattttgaaatctagatcttatatttatacttggtcataacattttatttcttttattgaggatatttctttgtattaagttggggaaatttatttgctaactttcatattttaaaaaaatgtgtcttcaaataaaattttatataaaatgacagagtaaagaaatttcctccaaatttattggggttttttggttcttctgaaacaatagttttattgtatttgatgcaaaatttaaaattctgctttgtatatatattttctggttttcttatgttagagttcactattttaagtgcaaaacaaactgttctttgcctttagctatatatttatatattttttaaaaattagaggtttaggaaaacgttctattttaatgatctcttttactaacttatgcattccttatatattaaaaacatacatgcccactgatttatgagattctcagccataaaaaatttatatgcatattacatatatgctacatatatgtattaaccatatttatatgtagataaatactctgtacttgtgtgtatgtgcagtaaacacactcaagcacataccgcatgtatctatatatgtatagatgtttatgcatgtatatatatcatatagccagacacacatacacctatatgcatatttaaatatattgtctactgtgttttgctgtgtctactatgcttttcatatttcagtgacattgtttctatagtaactaatgcactgaaaaaatcaatgcaaaaaggattgaaattttacaaaaagccaacccagaaacatgcttaaaaattgatgtgcagggggaggtatttgtcttgggtcatacattttggaagtgaataaagcaaaatgaaatcattactctgtaacaaactatgatctagcaaggttggaataccatattcttttctttaaccagcaaattaccaaattattatggtttctaagagcaacatgcacggatccacaaaacctataggcagtgtgaatctgtctatattagacacagtgtaaagaggattagggtaatggtgccaggctgagacactatttccaaactttggatcaagtgtctgtttaaaaatacttctatttggaaaaaaaaatgcctttctgctaaattttaaatgaattatacctaacgtaaatggtaagtgcctgggaagaaggtcaatttgcagttatttgctgcaattttaattctagacatttaaatcattaggaaaaactagaacattaatatttcatattttgttaaaaccatattcaagctagagtttaagtatactaatagccaaaatgtttatgataataaaacagatctgagttaaacaaacagaaacacaaaataatatttaaaatttgaaaataattcaaaatctgctctcttagctttcccaggtaggttacctgtatttcaaagtactttcactctgttggtaaggaaaaggatatacagttgcttttgtaatagccattcatacatataatttgatcatttagtatcaatgatcatttagtatgttacacttgcctgttatataattttcacattattagttaaataaatacataatacaagctttttctgtatgatgacatgaacagttagaattattttctataataaaaagattaattaaaggcttatttataatataaatacattgagtagttgactgttctttctcttgttagttctttgagtcacagtattttaaaatatgatattttaaatacagttttaaaatacatatttatttgacaaatctatattgaacaagtcattaaaacagagctccttctggacctctattaagacagggctgatcacaaataacatgatcacaaatagttataagacatatttgacaagtttcattacacagttatagacaaagtattagatgaaggaaaatctgatgtgattagaaatatttcagtgtatttcatggtgtaagtaacattccagcttacttcatggtataactggcatttcagacaggacttaaagtgtgagaagggatttaatgaggagaaaagaagaaaataacagaaggaccagcacaagtcaaaacagagaggcatgatgggttccaggaaggctaagcagtctgtctgggatgcctagagcatagaaggcatatcagataaaggcaagaatgtgcaaagcactgagagcggtaatgagctttcatgttgttcactggagaggaattacatggttgcatctgtattgtacatatctgatcggacatactatatataacatattgtggagagttagttggtagaagaagagattgaatatatagaaatttgggaagagttaataaaagcttagctatatgagtatctcttgcagtcctggcagtggatgaactcacttgggaaaagaataaaaagaacacagaaacacttggggaacaatattttagaaattcttcaaggaagaggaattagggaagtagaaatgggaagaaagtttagagataacattgggaacttaagggaaatatcagtggtacttcattaatactataacctaaataaaattataatatggttattgtgaattatatcaaaagggataactttgtgccaattgctagatttttatgcagatttcattagtctactactaacttattaccaatgaatttgtgttccttcaaacagaaatgtggtaaatgtaatgatgggaaaaggcttttctatttcatttgatgataagaaaaatcatgaatgttagaatatatattctaatatacatattagaatgtaaggcatatatgtgccattctcattagtatagaagtcatatatgtatgctgtattctaatatgcatacttttttgcattatgtacttgcatgtatcaactaattgcaatttcatgttttgaacaatagtaacatacgtctaaatacacagaaagccttacataggcaacatttttctgtatggaaaacaatgaataagtcccttaaaatgtgtagacaaatattgtagttaaattttttagtagaggaaagctgatatcctgtttggttggccttaactaactaccaaatttttaagtagtgaagtttttgttctttgttcttctttcacgattttatggtccctcttccttcagtactcaccaacatgtagtgttctcatgtgacttctattctttctcttaccaaagcatgcttccttccatctaatgatcagttggaaagcttaggaccactgtgatcaaaaagattgaaaaaataactttataaagtaatagcatgaaactagttttgagtcatacagtcctaaagttaaattctagctccatactgaaatgattgcatgaatgttggcaagttacttatctgacctataactttttcatctgttaatcagataattagatataatttatagggctgagtttaaggatgtaattcacaggaaaagcccagcacaatgcacaggaaaagcccagcacaatgcctggcagtttgcatttactaaacatgtgttatgcttactctttctccccttcttacagaggtttgtgcatttcaatagagcatagcccctcaacactagggaatgcatctctgctccagaaacatcaggcgctactgagaggcaggttagacgggtgtttaggaattggaagcctttctaccatctctgaagtggcacacctgctctgcttgcttgggaggccagcatggtctgtctagttgccaactcaatgaaaggctttaaaagcttgccaaaacattttttcctaggcaatttcccttaggcttctaattgcaagtgaattttaaaatatgtgacctatgatattgactatttctgaaaaaaaatctttatagttgggtaccagaggcagcagtcctgtgattctaaatcccttactgagcagagaattctcatctatctgaattgtatttctttgtaaactacctttaatggtttggtttgggcagcctaatctccctctggagataagaaagaaattctatgaatacagcaagtatttgaagacaggaagggagaaaaggagaaatatttaattaagcagagagctttacctagttttcccttactgttatttataagcaatacattggctctagatttatacctatgcagttccacaatctttattctggctcaagcttctctttttaatctcatactattccaagacaacttgttggaggtaactgtgccctacctctctcttttctgcatctttatccttcagctgggatacacccccaccactccttgtcctcttcataaaattgttttgattcttctaggattagcctgtgtgctgctgcctctgcctgtttatgcattcatgagttcgaataaaaacacaggcagataaacaaaaccaaaccattactgagtgccatatgccagattctagacatagaataataaaaaaaaatgcggttcttttcctaaaaaaattcatagtctgatgggaacacctgcatgcatatcaacaaatttaaagcaatgagagacaagtgaaagtagagtcacattccacagccacccagcattgttcaacggtatcatggaggcttcataagattagtgatgtttgaatggagtcttgaaagataagaaggaatatactaggtagagagtggaagggattggggcagaagaagcagaggtatggaagaccatattgagtctagggaatcatcaggtctttcagagcccatatctcttaaaaaatcacattggcaatcctgattcaaagtgatctccacaggaaacttttgtggggttttcccccttttatatcaactgtaagtcttcatttttatagataagatatagatatttttctaggttaaatatttgtgttctattttaaattgcttggtgactgataagttgcttgagggtaaggactaggtctcttctacttttttattctttaacacacccataactgagttttgtaattatttttatttattgtttactctgtaccaaggactcttaagaaatgtggttttatatttctttaactccaactaaaactccattaggttaggtactattattaccctcaatcacagttaaataaggcaatgcttagtgagatcaaatgacctttctaggaggcaaattgaattaaaagatctgatatcagagccataacttaacaaatactttatttaaccttcgcaggtaagtcattctacatgttcctactaaactctaaatggacaaagcaattctgaaattaaaaataatagttcaattaaataactctacgtgaagacagtgtatcagtatatggaaatattcaatgtaaattgtatattagaaaaaaaattgtgtatgtaaattgtatatcagaacaaaagttctggaaagcctttatataattgaaacagtaaaaatctcaaggatgattttcacaaccttgtattgctgtatctagtacatatttttaggatccaggtgttcatactctgaaggtgccatctggcatggtcatttctagaaaacagggctgctgtagctaactctacctggacaatctcagaggaagtaggttgtgatgggggaaggttggaaaggtagttgcgagggtcagtggatataaaaaagtttgcccatctgttgtaaatttttttaagtctccaaattcctttgttgccagtgtcctggttatagtggaagggcctcaagtacgcatgattcttgtaatctgggcttctggcttccataaatgccagagaatttgcaacagtaatgtggtatactgagcatctgccttttaatgcagcttcctctttccattctaggatcatcaactcagttaattagaggagtggcaggggttacaatgctagcaaattctgcagtattatgttatttgtagagagtgccctggaaatataatgagaagagaaaaatccaagtatttctgtttctcattcaaacccagatggaaaaatatgaggtgagacacttagaaaatcagagtaattgaacaacatactcagactggtttattggcatgaatgatgtccccttcacagtagttatcataggagccaaacaatacaataatgtcaccattgctcatgctgtttgggctcttgtgttggtgttatctttggattctgtgggctgtactatgaataattctcaacagtagcaaatcttcaaacagaaagagtctgttctgtttttgctattagcagaagttagaatgtgccaaatttggtgaataaagtgggtgatcaaagtgggaagtatgattttttttgccaaaaacaaagtagattgcaaaataatgaaacatttttgtcttaatgtggcttaaaacaagctctgtttattccaaaaatttttctaaaattattttgaaatactgcagaatgtctgtagcatgtattttccaattatttaattaaattaaatccacagattctcataaatatatataaatttcagttttctttgtaaatgtatagttacacctattattttacatttttgttgttgaacagcattacaaatattttaaatcttctcatttaaacaatcttaaactaaccaaaacaaacctatttcaaactaagttgaaatattttcagaagttaaaaaggatattttttgagacctaagaagttttaaatcaaaacaagaaaagattcagaaaccaaacacattgtactcatttaggataaaataatttgaggtaattatgaagtgaggagtcagattcgtattttctgaatttaattgtgtcattgtatatattattttttacgtcgtatcacagccctgtgtagtagatattattttaacatttggtcgattatccaagtttacagtcaatattcaaagttttgtctgactccacagcttttatccagctctaatacaagacttcatatattcccttcttcagaagagagaggagaaaaaaaactttgagtgacaattatttttaatttttacactgttaagtgaatatacctgagagggcattgctttcaaaatcttactactcagagtatggccagcagacaacactctgtgtggcagcatcagtgtctcctggtagctgactagtgaagtagagtattagatgccacaccagatgtaccaaatcagaagctatattttaacaagtccccccatgtgaattgctttagagcagtgatcttaagcatatctttggaagtcttttaaacaatattctagtgtcttctgcattttttacaggctctcaaacaggacaaaatttttcagctatgaggtgtgtctaaaagtatgaactcattttgacttcagaacaataagaactcttgaaggtcacctttagcgttttagttaaataacatgaaacttactattaaggaggacatgtttgataagagaaaaaaaccactactgcctaagtagtcatacactcttcaaaattgatacacaatgactgaaaggattattaaactatggtcaattactgatgatttataacacacaatttacggtgattcattttttttctggatacctatctttgaatatgctatttttaaaaattattttgtcatttagacttctattttatactgaattgaaataacatactatgttcctaaaatatcatatggaaaagggtttagcttagtgttcattggttgtgatattttttaacaaaattttcaaaataacacatttttaaagtgaattttattaattactgtgtctagaattaagtttacttttttttttttttttttctgacagaatctccctttatcacccaggctggagtgcagtggcatgatctcatctcactgcagcctccacctcctgggttgaagcaattcttgtgtctcaactccccaggtagctaggattacaggcacccgccactatgcccagctaagttttgtatttttagtagagatggggatttcaccatgttgcccaggctggtctcgaactcctagcctcaagttatccacccacctctgcctcccaaagtgcagtataatgtgtctaaatatcaaattataaaaaagtaaaaagattatcatcaaactacatttctacactcatggtaagatttttcataatttttcttatgaacatgcttaagcattttaaacactgcttgtagcctctgcaaaagttagcatgctaaatgtatgtttaaaagaactaagaaaggaagggaggaagaaataaacaggtttctgttatgcaaagttgagtgagttcaagatgtttatgttcatcaccagaacacgtgtaaaaatagctgtaattcattcataaagtcaattcttacctctgttaactttcttaaagcatagttgttttgatatagattatttcccttcaaatttatttatgtggaataattatatccaatacagaatagtattattcaataacaaaaaatgaatgttgcaataagtcattaagggtagagattattattagctaaaatcaaaagatttttttttcattgaggagaggtctagtatagactttaaagggtgaatcactgttggctatgtctctgtggttaaagagacttactgatgataccacctgtgttcagcagaagtagagagtagttttttgtggtagtaacagagggaagtgcagagctccaaaaacaaagggaaaatatttacttatttcgtctggatttctgccataggctatgattacttacctgtcaagattttctatcctgtcctaaatatgcatcaactctctgagtgagactccccctgtaatcccggttcaaagtactgatacacagaatatattttaaaactgatacattcaagtctgtatctaaactggctgttgacccactgccctgtttcctactacattccttcatcaatttttaagagtagtggtttcccagcaaaaaataagcagcataaataatgtggagagaatggaaatctactacattgttggtgggaaagtaaattagtatggcaattatggaaaatggaggttcctcaaaaaactgaaaactgaactaccatataatccagcaaatccatctcttggaattccataccaaatcagtatgttgaaggaatatcttcactcccatgttcattatagcattattcataatggccaagatatgaaatcaacctaagtgtctgtcagcaggtgaaaggataaagaaaatatggtacatatacatagtgaaatatcatgtagctttagaaatgggtgaaattattttatttgggatggcatggatgaatctagagaacattatgctaagtgaaataagtcaggcactgagagacaaataccatatgatctcatttatgtgtggaatttaaaaaacattgatttcataagaagtagagagtagaatgagagttaacagagactgggtggtgctggtggtggtggtggtggtggtggtgagggaatggaaagttcctggtctaaggtaatatgtctcagctagacaagaagaataaaatttgaaatctattccacaacaatagaatcaataatattgtattatatatttcaaagaaactaagaagaaagtaaatttcaaacgtcttaccacagaaactgagtgatgcatgttaatttgcttgatttaatcattccacattgtatacatacatcaaaagatcacactgtattccataatgtaatacaattatgacttgtttataaaataatattaaccaaaaataaataatcagcatataatagtgcttaagatgggtgattctggtgtcagctggatcagagttgtaatcacttctctgccactcactggtattgctacctttattcaacctcatttacaagagctgtttcctcatctgagaaatgagaataataaaaagatgtatttcaaagaattgctgtaaagattaaatatgaaacacttcatctatattaagttcataacaaatgttggctactgttatgtattattactatgtacttcccttgtactttgctcttatagacactatgtcttttttatattaccttattttaaaacttgcttatcatatcaataaaatagcataatactttcttttttgtagatgaagaaacaggctcagaaatgttaaatttatatccccactatcaagaagccagctaagtgccaatcttgcacatttaaatcctccatgtttcttagtttcccatattacattccttatctcaactccttggaatcagatagaatggtgtaagatctctaatttccttagttcccttgagagctagaaaacatttgacaaactaaaaacaaaattatctaaacctattttgtgctcttcaaaaataggcataatagtatacatttaacagggttgtgaggaataaatgaggtaatccatacaaccagcttagcaaagtgcctgccatatattacgtatggcaggcactcaaggaaaactgactactattagtatctaccaccttgggaattagtagttcccgaaaatgttgctgttgtcccaaaatgttttggcattattattatctagaattacatcaaaatttactttataagctacataagaaatcaaatcaccacatagaaaaatcaactcagaaatggataaaagacctaaaggtaagacctgaaactataaaactgtgagaagaacatatgagagaaaagctcctggacattggccttggcaatgatttttgatattgtaacaaaatctcaggctacgataacagcaatgataaataaatgggggcatatcaaactaaacatctctgcacagcaaaagaaacaataaaataagacagcagcctgtgtgctggaaaaaaaatatttgcaaaccacatacctaaaaatgtcttttatagaaaagtaaataaaagatcatggggattcattttgttgtcatacctctatagtccttcaatttcgaatatttcttgaattctttttgtggctcctaccattgacattctgccattaattttgtagaatgtcccttaatttgagtttgtctgttatttccttcctcatgattagattcaaattatgcactgttggcactgtgtgattacctattactcttcagacttttatccattagttttaacctccatggatgatttctacctgaattggttgatagttggcaaatggtgatcttctaatcctataagccttgctacacatgttagttgagacttaatttataatgggaaagagaacaatgataaaataatgtgcatgtacatcaataaaattgcaaaattttcagtgtcaggaaaaatcaatggatggatgttgagcatggtttgggggtggtctgattctgagagtagtaggaaaagtggtttgatatttcagctgagagttttaagaatcagaaggagcttgccatggaaagaatgagaggaggaatgagaggaagggcaaacaaagggaaagagaattgctttaggtaagaaagatctacatacaggggtgactaaaacaccagtctggcagcatatagtgggcattgggcagaaagggcaagtttccgttaaagggagatgtgtagctgtgatcacttaggatacataagctatggtattttcatctaagtgaagttggaagtcatttaaagatttaagcagagaaatggcatgataagatttttaaaatgtgtctctttgtagagaataggccagaagggggcaggtgaaaaatctctgtttgatctgtgttaactactagcatcattacttcagctactctgatctctcattggactgcacatatataacttgtcttcttagacagttctgtaaattccaaatgatctcttgaaaatgaaaattgtagcaccctggaccccactgaccaggagtgctagttgacagcaagaggagaggaagagtgtaatataatcacatgttgtgagctcaaagagaaagaagcgatagtagcctggaatcagcaatgagaaataagtaagactcagaagtgaaatgggctagaacatgagaaagtggggtcttgggtaactttaggcccaagtatgggtgcgggtctcagagtatgggtaataccagatgctgagggacacatgccttttggttgtcatgaagtagagaatgaagagataagctgtaatagtctcttttaagaggctaaccagcagtctagagctgtattcctaaatgctattctctaaggctcaggacctagagttgtccttgagaagcattaagaggtagggagtgaaacaggtgaggcattggaaagttttatgcctgagactttccaaatatgatgggcctttatttttaataaataaaaaggatttttattggagactccttgcgctgtctcatgctgtaatattgacaattaatggctcaacgacacaataacaatatatttaaagttttaataaatgcactgtgatgtgaatcattcacttttattttatttattacttgcttacagcttagttttatactcactttggatttttttaaattctgtggtttataggaaacctaagctcatgaagagtttataatctaagtataatcctatgaagggcattatgtgagagattattgtgttttgttggaggttgtattagatgacttctaaggtctcatcctactcggagtctatgatttaatgtttctagcatgactttgtatcaaagaatgagccagaaaattgaagggtgtttaatatgacctgaaggaaaaatcaagaattctaataaagtcaagacacgtataatgtgaacaattcctaggcttttgatcattcagtggaactgacacttatgtagctacagatttatgctggttttaaaggcatgtttcaattgaatgagcaaattgtgaaaaaaaaaaaaaaaagtattaggtaacaggatttcaaaagaccgtgtgagatcttagtccatccaattattttactcttgctgattaaataaatctgatataatcgccctaaaaatttgatcagattactagctggtaaaaaccagcttttgctcattgaaataatgagccagtaatatacttcacaaaaatatagctaatgataataaatatatgaaatatattattttttcctaggtgccaagttacatcttttgactcaatgacctaataatagactttctatcattttaaagaaagaatttcccctcatacatgtccccttcacagagattcccctaatgttagactaatggtcctaactttaataaagtgttagtctgagtctgtggaaaaagacatagaaaggtgacttatctgagatcataaccaattcaattgttaaatattgtaatcaagcaaatacaaaccacctactccttaaatatttgtaatttttcaaacacttttaatcagatgctctgggccaaaggacagatgcttgtttacaaggctgatttagttactttaaatgctgctgactgaactatgtacctgtaacatgcttcagctacaggccatgttcagaaaaatccttgcatatcactaccaacacacttcagtatccagctagctaatatattgcaaaaactaatttattcaaagcatatggtctagcaaatgttgactgcattttcagatgatgttgtacatttaggatcttggaaagttgtagattcttacatagaaccacatagaattgaggcactttggggaaaaaggccaaaaatcttatttcacaaatatgggaaatatttttactataagaggtaggaaataactaaacaaaatatttaccagttaaaaaacctcaatcagaaatagtaaattgaaacatttgttcataggttctttttagatatctaatatgaatatatatttatgtagcaaacactggggctttaaaaataaatacaggcatatcttgttttattacacttcactttattgcactttacagttattgtgtttttttcaaattgaaagtttgtggcaaccatatatcgagcaagtctattggcataattttaccaacaacatgtgctcacttcatgtctctgtgtcacacacattttggtaattttctcaatatttcaaacttttttaattatcattatatctgttatggtgatctgtgatcagtgatctgtgatgttatcattgtaatttatttagggagccatgaatttcacccatgtaagatgataaacttaataaatgttgtgagtattctgactgctccacattccagacattcccatctctctccctcttctcagttctccttagtccttgagagaaaacaattttgaaattagaccaattggccgggcacagtggctcaagcctgtaatcccaacactttgggaggctgaggcgggcggatcacgaggtcaggagttcaagaccagcctggtcaacagagcaaaaccccatctctactaaaaatacaaaaactagccaggcgtggtggtgggtgcctgtagacccagctactcagggaggctgaggcagaagaattgcttgtgagactccatctcaacaaaaagaaagaaaagaaaaagacattagaccaattaatactgcaatggcctctaagtgttcaagtgaaaggatgagtcgcacatctttcattttcaatcaaaagctaaaagagagtaagcttagtgaggaaggcatatcaaagctgagatagtctgaaatacattttgagttgatttttgtatgtggtgaaagataaggagttataaaagtagacttcatgaaggtagaaagtagagtgatggttaccaaagggtgggcctggtagtgagttagcaaagttgtaaatgcaaatgaaaagttctagaaagttctagaaaacggaacgttctagaaagtgcttcttttaagaacacctgaatgataagaacacaaaacagccttactgctgatatgaggaaagttttagtggtctggatagaaaataaaaccagccacaacattcccttacaccacaatttaatccaaataaaagacctaaatctctttaattctctgaagtctgagagagataaggaagctgtagaagaaaacttagaagctagcagaggttgcttcatgaagattaaaatgaaagctgtaaccataacaaaaagtacaaggtaaagcctcaagaactgatgtagaagctgcagcaggttatccagaagacatagctaaaataatttatgaaggaggctacactaaacaagagactttccatgtaaagcaaacatcttcctattggaagaagatgccatgtggtacttccattgctagagagaagtcacttcctagcttccaagctttaagggacaggctgactctcatgttaggggcaaaggtagctggtaactttgagtggaagtcaatgctcattcaccattctgaaaatcctaggggtcttaagaattatggtaaaatctactctgtctgtgctctataaatggaacaacaaaacctggaagacaatgtatgtgtttctagccaggtttactgaatttttaagctcactgttgaaacctactgctcagaagaaaagattcctttcaacatatcactgctcactggtaatggacctcatgacttgacggctctgatggagatgtacaaggaggttaatattgtttttatgcctgctattacaacatttattttgcagcccatagatgaaggagtaattttagtttcaagccttattatttaataaaaacatttcataagactatagctgtcatagataatgattctcataatagacctgggcaaagaaagttgaaaaccttctggaaaggatttaccattcaagatgccactgagaacattcattattcatgggagaagatcaaaatatccacattaacagggctttggaagaggttgattctaacccttatggaagcatttgaagaggtcaagacttcagtggaggcactcactacaaatgtggtagaatcagcaaaagaactataattgaaagtggagcctaaagatgtgaatgaatcgctgcaatctcatgacaaaacttgaatagatgaggagttacgcatagataagcaaaaaaatgtcgtttctttggatgagatctactcctggtgaagatgctgtgagcattgttgaaatgataatagatttagagtatttaattaacctaattgataaagctagcatggtttagagcatggactccaattttaaaagaagttctaccgtgagtgaaatgctatcaaatagtattgcatgctacagagaaaacttttgtgaaaggaagtatcaattgatgtggcaaacttcattgttatcttgttttaagaaattgccacaaccactccaaccttcagcaacgggcaccctgatcaatcagcaaccattaacattaaggcctgaccctgccccaacaaaagattctgactcacagaaggttcagatggttgtctgaaattttaaaattaaggtatttaaattattgttttagacataatgctattgttcatgcaatagaatatagtttagtgtaaacgtgactcttgcatgtactggaaaacctaaaactttgtgtgactgactttattgtgatatttgttctgttgtggtggtctggaaccaaacctgcaattcctccagtttctccaaggtatgcctgttctgttgttttaagtcacttaacaaatacacatactttttttccccctatttttatatgatagttactatgcccatttgtacaagagaaattcagaggaatttatgatttagaaattaattgactctgatgctgtataagttatactccagaaaattttaaattattaataagaacatctgattccgaaaattattattcttaatgaaaaaatgccaaaatgcatgacactgctctcctgccgatgactaccagaaactcatctttattcaaacaagttggttttattggcacattgcaacaaaggaaactaacacaaatgaagaataggtgcttcagccagagagtgttagaaaggacgtattataggatacaggttcatgctaggtaatttgggggcatattcaaagcagtggtgctttgtctgcattggataatgtcaggaagcaggggtaattctttgtttgtgaatctaaacaattccttttaaagcagaaattctgattggtaaagaatcagcactcattggtgatagccaagataggggaagtgtggtcattttcgtagtttgcacaatattcttgttttgtctgtgctcaaacatttttatgtagtggtctgatgttgtccagatccatcatagcaaggagtggctttgtctgatgatggtgttctatgaaattatctgtgtgcagtaagagaataccatggcccagctgtgtcagcccaacttctaacaatgttgtagcctggctgatagtgccaggccagcttccagctgtgaggggctttttctctttctcatgtgtaatggcaaatacttctaactacaaatgtcacgacaaaataatttcatgccggatatgaatattttctagctcaacatcttgctttcaaagttctttaatatcaatcctcatcactggattgtaaactccacaaaggcagagaccatgaccttttttcaagagctaaatacatcctaattattagtactactcatacaaattgaattataactaatatttatcaaacttttacttatatgtcagttatacttttgtgggttttactttgcttgtcaccctaatatgcacagaaactctctaggatgagtacatactattaatatctccattttataaatgagaaaatgaaggaatagggaaattaggtgacatacaaaggtcatacagctagtaaggagcaagtacaggattctaactcaggaagtctggctgtagattccctatttttcatcactgtaatgggtttgatacatatgtgttgaatgcatgtgtaaaccaaaaataaaattcaaagcccccccgccctgccaccccaaccgtctaaatggacctcctcctcagcaagggctcttttacaatttaatctgagagactgtttctttcaggccatgatgggaagtgggggttgaaaatgcctcattatgcttcccaagcattaatatcaacacagactttaagtctgataagaaacattttacaacttattctctttaaagcctagtacctaaaggctttccctgcaaagaagaacttgggtctccataatcctttatcttaacccaggcattcatttctattaatcccaggtctttagataaacttaaccaactgtcaaccagaaaaaattttaaatctacttgtaagctggaagcccccactttgagttgtcctgcctttctggaccaagccagtgcatttcttaaatgggttttattgaagtctcatgtctccctaaaatgtataaaaccaaggtgcaccctgaccaccttgggcatatgttctcaggacctcctgagggctgtgtcatgggccgtggtcactatatgtggctcagaataaatctcttcaaataagtttcttccaattgtttacagagtttgactcttttcatcaacacattatgaatagatgaggaataatttgatgattttgaaaattttgggtaaaacaggtaacttttgagattgggtattaacctgggataagagtagcgcaaatcttaacttggagttattctacaagcacatttttaataggaattcttgaaggggatagagtcaagtgtagggaatagacctgaatctggatctccataaataaaaggttaaatataaagtagaaataaggatgaaacgtggtaggttcagatctgtggttatcaatctgaatatgtggatataatgaaaagtgtaaacataccatacctgagacagacttatgtaaaatgaatagccaccttacaagagaataaaccagacagcaagaggggtatatgtgagtactgcaatctttgaccctaaaataggcagccatgacagtgtagagtgcatccttagagttttaaatgtgtatcaggaaaatgaacctaaagcaagttttcctttaatattttaatcaaatcatgggactgtggaccagaaaggatgttgtttaagtataacttaaaattgatataatttataaacttaaatttataccatttagttttctatgttctgctcagaatctataagaaagacatagaatcatgttcatgaaaccatagaatttttgcacaaacgtttgtacaaatttgcaggtgctaaaagaagtgtgcttaacatctttttagcccttgtaatttgtttgttgctattattcattgcatcttgtgactaggtatgtcttggtgaatttagtgtgtaaagctttgaaaattatagtatcctctacaaaaacaaggttctactattatcagtattcattttgttaagagaaaaagagaggttactgattaatgccattccatgcgtgggatctcttttcatttattctcatcttaactatctgcataaataagaaagtgagagaaaaggagaaactgtttaatgccagtaaaggtatcatgttgaacacattttttttgtgctcctcatttagctacattggagatgttggaaatatcacaaattaataaatattcaatcttctcttcttcctgtaatcccattattcacacactgcatcaactgtgaaataggctggactttgttggaaatccaaaagcatgaggaaatgtgctcaaagttgcatattaggttagaaaaaatgcctgatgaatatgcaatttaataggtaattgtattatgtaagaacatacaaaactaatataagcacattattgtattgaggttgtattttattaaattgcttactgatatttttttgaaacaagaaagtaatgtaaattgagtaattctgaataagcgattcagggcacatatatcatgtttctccataaaagaatttttttcatttaattaattgtaaggaagtattattggattagcccttcatgaaaatactagggcaaaatggggaaaaaattatatatatataaatttcaacacagtgataccctgtatctactaaaaaatacaaaaaattagcccggtgtgttgtcgggcacctgaagtcccagctactcagaagtctgaggcaggagaatggcatgaacccgggaggcagaggttgcagtgagccaaaattgcaccactgcactccagcctgggcaacacagcaagactccatctcaaaaaaataatatattaaaactcgaaaatgacctccttcatatctcacatccaggtcatgctgatccaagagatgggttcctatggtcttaggcagctctgtcccatggctttgcagggtatagcctccatcctggctgatttcatgggctggcattgagtgtctgtggcttttccaggcatatggtgcaagctgtcagtggatctaccattctggggtctggaggaaagtggccctcttctcacagctccactaggcggtgccccattagggactctgtgtgggggctctgaccccacatttcccttccacactgccctagcagaggttcttcatgagaggcctgcccctgcaacaaacttctgcctggatatccaggcatttccatacatcctctgaaatctaggcagaggttcccaaaccccaaatcttgacttttgtgcgcttgcagactcaacaccacatggaagctgccaacgcttggggcttgcaccctctgaagccatgacctgaggtctgaattagcccctttcagccaaggatggagtagctgggacacagggcaccaagtccctaggctacacacagcatggggaccctgggtctggtccacgaaaccactttttcctcctaggcctctgggcctgtgatgggaggggctgctgtgacaacctctgaaaagccctggaaatatttttgccattgtcttggggattaacatttggctgtttgttacttatgcaaatttctgcagcctgcttgaatttctcctcagaaaatggaattttattttctatcacattgtcagcctgcaggttttctgaacttttatgctctgcttctcttataaaactaaatgtccttaacagcacccaagtcacctcttgaatgctttgctgcttagaaatttcttctgccagatacccaaaatcatctctctcaagttcaaagttccacacatctctgggatagggacaaaatgctgccagtctctttgccaaaacataacaagagtcacctttcctccagttcccaacaagttcctcacttccatctgagaccacctcagcccagactttattgtccccattgctatcagcattttgggcaaagccattcaacaagtctctaggaagctccaaacttgcccacattttcctgtcttcttctgagccctccaaactgttccaacctctgcctgttacccagttccaaacttgcttccacattgtcatgtatcttttcagcagcatcccactctactcatagcaatttactgttattagtctgttttcacgctgctgataaagacatacctgagaatgtgaagaaaaagaagtttaatggactcatagttccacatggttggggaggcctcacaattatggtggaaggcaaggaggagcaagtcgtgtcatgtcaagtggatggtggcaggcacagagagagcttgtgcaaggaaaccccaccttataaaaccatcggatctcatgagactactttactattacaagaatagcatgggaaagacctttccctgtgattcagttgcttcccaccaggtcccttccacaacatgtgtgacttcaagatgagatttgagtggggacacagccaaactatatcactacccaatatttcaacgtatgtggttagtagaattttgtaatactgttttgagctcattagtttttttacttagatatctaaagtacagcaaaaattactgtctttttgtatcttagatcatataattttagagctgaaagaggctgtagagatcattaaaaaaaaaacttagatattagaaaaatgatgcctggagagatgttgtatgacttttccaaggtaaagtacttaattaaaaaaactaaaaatttaaggggattttaagtcatcacccccagccctgtagattaacttaaattttatcaaaagattagacatattaaactattaagtattgcttcaaaccactctcagagatttattttaaaatttgtgcactgtatatgtggttgtcatataaaggattgacaacacttttttgtgtatgtaaatgaaaattgtattggtttagtgctggatttacagtttaaggattgtatttaatgaaagcctctcaattggtatgtccttgacataataaaaattttcataatttaggttttaattttcacattatgttgaaaattcaaattatttccaaatatcctgtgtttatatttactatattaattcaatcaaaaatatactagttgaaatttggactattccctatcttgagcacacaacatgcacacaccccacacactttacccattaacatggtgtacacaaagaatcttagatattttattcttttcaaagttgagaaatgcttgttaatttttaatcaagttgagctattattcaaccatttaaatttaccatcaacatattgtggaataggataccttatgcctaattaacaacataagtaagaatcaaaatatttcatttgctacctgttaatgctgtcttatgattttgctcatgtttactaatctcaattataaaatatatttttatgtgcacaaaccagtatattttatttattttgccttcatctaccttaaatgttaaaatttttaaaataaacctttatatatttatttacacataatttaataattaagtttatcaatatttctatttttgtaaaggaaattactccaggacccatttatatgactatttaggctaaaattgtattttccatttttttaaacaaatatttggtaccagaataacaaggtatgcaaaatgacaactaaatttattattcaaatcaaatatttaaacatgtacttgtatgattattggcataattatatataaaatgattatgtacataaagtttaattttttttacctgttgtcttcaattaatttagagtgttctccatttatcttgcgtcttgatgaagggtatgggggatccaagatgatgtcaatagctgtttagatgtttttgttgccatgagtttgggctttgtgtaatttcttggcaaaatatatggagatatggagagtgcattactccctgatagacacttataatgatggaaaagaagcaaaaaagtttatgtactttcagctgttgtacatagatgctaaatattactatttattacaatgataatttttaaaacaaatatcttctgtatacaaattacattccaataattaaacctcatgttaatggagatatatggcggggttgaacagtatattttataatctattattttacaagaagaaaaactagatcagttgcaaaatatattaaatacaggctctgaaaaatgaaagactaaggatgttaggccccaaaaaagatacactggagttaacaaatctttattaatgcatgaggcctcccatgatgctggtttctgttctttaccattgaaaactgatcattgcttctggagaaggttggaaagatggctagagcttattttaatagccttacagatagctaataaagtttcatttattcagtgtcttttaaattatatataggtattaaattgttttttaagccattcctgtggtatagctgtagaggtgccaggctgcacaaataataatcctatacttgttgctttggagaagaaaatatcgtttgttgtaagcaaaattgtccaacaggttaaaaatggtctaattatgtgaaaaaactattttagtttaaagtatacattcgaaagtgctgatctttaatgtggtataatgggcccttgatttgttagcatcagcaaagcaaggctaacaatgaagtttgggaagcatttttactttttttttgtatcacttagccctttgttttagatatggtaggtccttgtgtgtgttgatttttttgtgtaatgatataattgaaagattatatcttttaggagaaagagtacatctatttgaaacataccatttctattccaaatgaaaaaaaaatcctttgcttccttagcatatgtatttttgaagacattgcttactagctcttcaaaaaaaagttatttagctttgttgatcctcaggttgttatctgtgaaatttgtaacacagatcttttgtgaagattaaatgatatcaggtatttataatacaaaatttctttcctcccccaactccacctctacatatttgatttggctccatttttgtctcatttttctatgtattttaagtatattttgttgacttatgttgcatatatattcgttagctgcctcaagtatttctggacaaaaatatgtatacttatagattaatacaaattagttcttcgttgaaatccttttgtttttgttttgtttttcagattaccaaatttgttaaatggattaaagtgtggagtcatatgatgtagttgcttctggctaacagcgttagttcactcttcagggtacaattttgcttctctgaaaattagttggtcttagttgtaaatttgactaattaaattatataaccaaaatggtacatataatactatatctcctctgtaagtgtaaatttgactaattaaattacacaaccaaaatggtacctataatactatatctcctctgtgagccctcaataattactaaataatatactttgcaatatcagaaatataaagtttttaagcaaaaagccccttttccctccaatattattttttccaatattaacctgttagtgtctctaatgtgtcatgcaatcttaagcctctttgaaatatagtagataccatacattattttaagtgttttatatgtgtaatgtactttaatcatcataataacctaataaaattggtaactattattatccccatgtgtagatgagaaaacagaggtacgaatcattaataaactcagctaaggttgccaggtgacggagtgactgaaccaaaatctgaagttggcagtctggccccaaaatcaacattcttaattgaaattctatatcacctcgatcactcgatcacttctaatatgtactttacatgtggggaaaagtaggctgctcgtgtgctttgggtgactttcctagtacttgtaatttcactgaatgatgacaaatttcttcctgatcccttgaagagagactagcaactgagtgattatttgtatgtaaactctatggtaatataaaagaagtgtttttttttttccagcaatgccaataatctaaaagacgctgggaccctactaatgtcacttgctcaattccatctccacatcagttaattcatttgggcagcacactttttcaccacaatgtaaaagtttctcttttctaatgcattctttgcaaagaattaaccatcaccatatggaagtactgtggagtttaatttcaatgtgttaaattttgatggtggaacatcagtgaattgactttgaaatctgaactgaactctggttcatttgtcagctggtgtaaagattcatgttctcttgtgcttgtggtcttacatctaccctgtggttttaattttggcaatgattagttagcatcccacttcatttcatacttagtcatccacaggaaatgataaagacaatgaatctcagatgtctacagactagatattgatttattactattttttcaagtttttcatgatttttccccctaagtggaaataggatttttgaaaatggatttctggctctgtgtaattgctgtatgtcagtgagcattccattagtattaaaaacatagtagatatgtccacatgttagagttttgaatatatttatagttacaccgagattgatattaaagatttgaaatttagtaaaatttttattacattaaatgactgtattgagcccataaaattatgtgttctcttaaggtggtagaaaatactatatttttaaagaggagctgaaaaaaaatatagatatagctatatccatggcaacagcatagcacccatacaaaagaaagccagggtgtgcttgttggatagctgcatagcaacagcagagttcagtatgggaggaggaaagaaagtttagaaccaagactatagtgtgctttctgaatgtattgcattgtgctgtcagtaagcctgattaatgtctttttgttcttgttcgatattttacatattatatttgtgattttaatttcaaagaatagttgaaaaatgtaggtgtatggtgtaaaatcagtaaatttgcacttaagttttgcattaatatgagtatgtgctattggaaattaaagcacattgttaagaaataaagttaatagaatgagttattgattatatttgtgaggaattggaatatgtattctataataaattcactttcaaatttagaaagggatgacccttattttataattatttttgttttcaatatgagtatgctagtgttcaaatatatattttatgtgtagaaaatagccatgctacatacttccagaaagccattccattcagttagtcatatgttttggacactgtacgagatagatctaagcattttgtattagtccattctcacattgctataaagaaatacctgagactgggtaatttataaagaaaagaggtttagttgggtcatggttctgcaggctgtacaggaagcatgatgctgacatctgcttggctcctgggaaggtctcaggaaacttttactcatggaggaagatggaggagtagccagcacttcacatggccagaacatgaggaagagagagaggagttatcacaagatctgattgttttaaaacaatcactatctcactcactatcccaagaacagcaccaaggagactgtgctaaatcattcatgaggattccgctcccatgatccaatcacctcctaccaggccccacctccaacactgagtattacaatttgacatgagatttggtggggacacagctccaaaacataccacattgttagggaggactacagcaaaacttgtctaataaactaaatagacatttctgaaaattaaaattcttagtttctaagtattgtaattcctttgtaaatctaaaccaaatcattaagaatcacatataagctccaaaggcctaagacagaagttgttaatacatacctttcagcccaattctaccttactcctaacgtaagaaacatgccagtacagccttttgtcttccatgtaaaaggctttggaatttatcccaggggtaaggtatagaaagcccccttaaaagataatgggactagttttcccagtattctaaataacatagtatgttttcggatcctttgtgttgtattcatctatgtatttgctctgtgtatgttttctttctctttttcttcctcttcctcttctttcttttcctctacctctccctcctccaatgatgctggatttactacctgaattatttcaagcttcactataaagtgtgtatataatattcaatagtcaacagtcagttggctcccaaataatatttctgcttaaaatcaaaattagcttcatgatatttaattatactttaagtctatacattgttccttgttgctgttaaagtttatgacatttcttatccactctttgctcccaaagatagtaaattcttgtctcttaatggtatttaagatggtaaagtagcctttaagatatttaattgtcaaaacctttcttaatggaaatatcttaagcattaaaaaacaggagaataaggatatattctagtttggctgacaatgtgtgagtgaagtagctatgaagaataaagaaatattctaatttggcagtgtgtgtatatgtgtgtgtatgtgtgggtgtgtgtgtgtctgcgtgtgaagtggctgtcaagttgcaaccagaatgtaactctactaggacttttggtgatttttgtttcttttgtttactgctgtatttccaatgcatggaagggcacttcaaacaaagtagtcgaagttttccctcagccacaagagccctttatgtggggctttatgtggagtacagttttaaaagtatgtgtctacattctgtgaatcagccattgtggataatgtcatatatactaacagaggaaagaagtgtacctgtgtgtgtgtaggaatatatatatatatatatatatatatatatatatatatatatatattatttatatataataaaaatatatattatatataatattatataatataatatataatataatatataatatatattatatataatataatatataaaatatattatattatatataacataatatataatatatgttatatattatatataatatatattatatataatatatagacatattatatacatatattatatatatataatatatatgagacatatggatgtttgggagccatataaatattttacttgctgaattagtaaaacttctgataaataagaagatacttcaagataataagtgttaggtagttttcattctctgaaacaatggaaaaacgcttgaattttcagacggtattgtccgtaaagattcacgacgcattctaggtgttccaggatggccttggaagcagtcaaaaggagaatgtttatggagctgaatcagaaaggatagattgcatcaccaatatacacaatgggcttgtcacatttactgatggttccctatgtactgggaaatgtcaggtgattcacatataatttgtcttttaaaaatataaaaatatatctgctggaaaaattgcaccaggtcaaatgtattttagagtatctagtgttataaaatagatgtgttaagtttcctgctataaatgttgatatttataatttcatttattttcataaacagttaggatgcacctattcaagctatcctttattataatataatttagatataattcaaaatttagctataattccaaattttgctcatttctagacatgactatatgactgaattgatgctgaggagtttctacaaattgtcagtgttttgttgttagtattatttgctattttcaaaaacattttaaaatttagtcaattttgcattagatattttaattgtggcaacacagagtatcaactggaatttattaaaaaaattattaaaaattgactcatgcttatatagtctaaggtaaggaaatcaaaccattttttttttcctacaaccatgttaacgctatgaaaactctcatgtcaagatgtgctatctttagaacaggaatggaattcataaaatagctctttgctacagagtttttcagctgcattttcaaaaccaaataatataatttattttaaatttaaattttaggcattttacagtagaattcatgaattattaggtttctatacatttgtttaaaaaacaaataggttagaatacataaacatttgtgtcctacttttgtacatttgtaatatacctttgtagttctacttttcatgtattgttttcaattatgaaataattaagttatttggatttaaatatagaaaaaatatttaacttttgttgtgaagaaatatatataatatacgtgtgtgtgtgtgtgtgtgtgtgtgtatatatatatatatatatatatatgaaatacacagttcatttgcccttgaaataagtcctccaataggaaaaaaaatatgccctttgtgaaatgtcgtctcctcaccacagataatgaaaggattgctttgtgatttgacaattaaaattcacttttatttgtcagtattttgtatgatattctgttcaatgacaccctccagttaaaactctacaatgtagtaacattgtattctgaatggtaatgcctgcatcttattgttgttatttttaaaaagtttaaagctaattaggagacacatctattattttgctactttatcattattcccttcagacctatgagctagattttatcaggaatgcatactgtatattcactctcagtttattcatgctgagggcatcgctaatttgatcatcaaagtgtatgtaccatgtatatcctacagtagattccttaaaggaaaactagggctgtgctattaattttaaagtcctaatgtatggctgttaaaaattaagctgtcaacattctccatttccagcagtagcacagtaatgacaaagacatattatggaaataaatagtaattaattttaataagtagcattgtacttacagcattgtcaacaggaaaaataaaaaatcttttatggagaaaataaagttgtaacatcaaaaaatatgaaaaagcagaatatatttatgattaaattaaggcaattttagaaattaaaactctcatttagcaatatttgataaagacatctgtattgcttctgaataagatatgtattaaaattattcataagacaatatggattaaaaacaaacttctggcttcatgatacttatttattgagtaatttgcaattaatacaaaatatttttactttctagggacaagagaagaaaaacaggcaatgctatggaggattagaaagctgattaacttgagatacatagcctcatgtttataaatttgacagaaaaaatgattcacattctatatatcagtcattaatttggtactgatgataatgtgcaatgtataatacatatctgtgtttactctgtttcttgattgcatatgtaatgtgctgaacaaaacctaacagaaaagacgtttttggtcaaatatatcaaattaaaagcacactattgatggtccgaagctgtttaaacagttaatagaattatctgttgatttcacctgatttcaattatactaatgtaattcatgtaaaaccttatatactcaaaaagtaaggaatttcccatggttttaagaacatcttaactctagaaacacagaaaaggcagagaaaaaaaaagatttggagttgttatctagaaaaatttcagtggtaaattctgatatttttcttcttccttacatgactgaattatttcacatactttttattgtgtctaagagatgttttgaaaaccaaaataacaaacagcatctatgcataaaataagagccagcaagttgtgtggagaatgtgaggtactctgcaaagtgtatttttataagccctgattttgctttccaatatgctccttaatgaccaacaaagagggatatttcttgaggatgacttcccttgacctttcctatttgtctagagtatttgaccaggatagatgggagactatgctgtgcagtggtaactgtacccaggagcaggaacatgagtaagaatgtacttgatggagacaagggaggaaggaagtgtaagtggctctggaaagctccctctggtggagaatgtcttaataataattcagaagccattactagaacaaggagatgatagattacctatttaaaggactttctcaatgtagaaggggccttcctaaaatttcttgttatctgttttaaagtctgtggtagaaataaaaattccattccctaattcaaaaattcagcattcttccattgccagccaaattagctaaagttcaaacataaaaagaatcaaagatctttgggttccatattttccttattcccttccaagtctagctggatttcagagatacatttattactgtaaaacaaatgctcaataatagaataacagaagacaacaaatcttccaacattttgtttgatttctaaaatttttgttaccgttgttggacataatattttacatttcctaccagcactgcctgctgcttaaaaaggttgtttgctcatcttctgctagagaactctaaaaggggtcaatttttctccgaaatcattctgccaagggcagtcgttgatattgctgtcagaagaaagaaaaagacaatcttatgtaggtggaggggttttaacctttttaggtcattggctgttttaaaaatcagaaaaaagctttggattctctggctcagctatatactcataatattttgcatgcagttgcagtattttcctgaagtcacaatagtattcccaataccacggttacaatagtatccctggctctctctctggtgagctaccacctcatttaccttcccactgcctcctacaccttgccatgactagatcttctgaaggttaatgtaattcctcaccccgaggaaggttgaaagtacagtctacataatcatgccccacaacggctatctttagcattaaacaccctggctctaagactctcatcttttatcacaggaattctgcattgttttccgagactggttcctactaagaaattccaggttatggtactccagtaatgaacactaaatattgagaactccctacttccgtagcattcatttctcacaccgccagttaatcagttcctgaatccttgccttctatgattgtgtttgtgtatatatatgaaatagacttgaccctcagtcctaatatcagagttgaatccctgttacaatttttttgttgataaataatattatctaatcacaatgactactgtaagtatacaattgggaaatgttaacaagtgctatgcaattaaaaaaaggttttgtggtcaatgaaatgtggaaatattatataccgcattctctttgggagtttacaacgcctttcaacatacactttaagtagcatcacagtaatggaaaccggcccttaatactggttaacccaaagtttgtcaaacatatctgcatacataacaatttctataggacagtagttaataacataatgttgatagtttaggaagtttggtgttttaggaagaaactcatagccaagcctttaataagatatatttctgtaaaaataacttccacagtactctttatggccaccagtatctgagatcattatattgaaattatggtttattaaaagtgataatttagttgatcctactgtattcctcatacatagcagagatgtggaaagggacagtatggggtttgaaaatttacaacttcaaaaactattttccttaaataattttctcttgtctgatagaaaatcagtgactctgatatgacatgaatctgattcccttcactaaatattcatgtgaccaccttttctgaaaggaaataatactctaagaagtaaccattaaaacttttattatgttcagctccacagttaaaaggacccattttaatatctaattgagtctacttccattttagtagtttactatgaatgtcatgattgttttctaagtaggtgctacaatctttatcactggaatttccttccatctaagagaacagaaaccgagttaatgtatctgaatttcaataaggcatttacaaaggtctcttttagtgttcctgttggccagatggaaaaatattcactgatgatatggaactgggtaggcttattattggttaaaagtttgtactcagataaccctgtgttatggatttgtattaactgtaaggagatatctagtgatttgtcatatagtttcattcttgcccctatattattctaaaggttcattattaatgtgggtaagaacactggactcaatcttttcaaaattgcaggtgctatgaaactggaagaaatattaaatatgttgaatatgttgaattacaaaatagaaattctgggaaatggagaaattttaagaattaggtagaggttagcaaatcatgtttaacagagccaattttaagtcctcttttaaaaaaatctagcatcaattaaacaaagagcacaattacagatggggataaatttgatttgactacagcatgactgtttagctagattctgaatttaacacggaagacagatagaaacaaacattaattaagtgcatactatatgcacacctggggctagttaccttcatgtactcacttcatttaccttcaacaacaaaccagtgaatagaaatgactataaatagtataatgacaaataaaattaattgaaagaataaccgccccaagatcattcagcaaataagtgtcagatctaacttttattcccaaatttatcaattagaatttgcattgttagtaataaaatatagaaatatagaatttaagaagagtgaaaagggtggctctcccttggtccaaccacatctaaaggctgtgtttagttctggccctgactgcggagggaggttaatagaatggatcaagtccagggaagaacaaacaaaataatttcacattatgtgcatttaaataagtttgaatctatttattttgagtaggaaagttttctggtaggatatgataatgatttaatataattgaaaggctatcgttttaaataaaaattagatactttcccctccactttgctccagagagaaattccaggatcgatgagaggaatctgaagagtttcaggttttactcaacataagaaaaacacttcatattttgctgctttaccttttattcctagctcttattatcttatggtataatatacaattttatcgtatatattttctgtttttctcactaagataaaagttccatgatgtcaaggatttatgtctgcttaatcatggcatttttggcaccaagcctggtacccaggataaaataggtgcctaataaatatttgctgaataaatgaaatcaaaccagagattattggattcaacttggttctagcaaatagtttccttactgacaaacagtattttccttactaatagccaaagaagtattcatataatttgcgaattcataaaattgtacatatttgaaagccaaaggagcgctgaattctcaaaaagtcattttagaaagtggcccagaatgattgattaatctatcaatctctatatgtgagtacactttggaagtttttagtcataatgatgttacaaattgtcatcagactgtttcaaggaggtatgagctctgtagttaaacttccaaggctctttacttgcaagctgtctgatcttgaacaattgatacgacttcatggttactttcagcaccttcctcctgacattattttgaggattaaaagtcataatatatgtaaagtacttactgttaccttgtgcttagtgtgaatataaatattaaataatattaacagtattagtagaaaattatggcattgctcttattatagctacttaccattcatactgtatatcatgaaaatgataaatattgagattgtaaaaaaaaccattcaacatttagaagcactcccagggtctttgcaaaacaaaacaaaaatgcatagttcctctattgtccagaatagataaataaaatgttaaaatatggaataaatagaccactgtgtggattacacgtataggtaaaaatgtcatcctcaaggaatataatgtcactctctactcattttgatcttctcactaacttgatctttttaggtccaacccctcttctgagctttcccttccttctcttgaaggattgaaacataatagcaagttgagtagccacaggcagttttgctatacaagactagctcactctctcccattacagtgttttctttgcttttgtgaaaagactcccacactggtgtctgctgctaaaatcaattctggaaaggtattttaaaaaatgaccctcccttaggacgtgacagatctctgatggtgtctttgtcttccttctgtttttgaaaaaatccacagtattttctccaaaactttattatgttttatgaaaacataccactgacagcttccaataggaatcagaagatttacattgattgacctaggatgcacttcaattatctagcctgagcctatatcatctttttaaaacgtttgcttttaaaaaatgatttatattgccctgatcctttgaaaagtaaatttgacacatgataaccctttaattctacataattcagtgtgcaccccttgagaagcattttcttggctgggcgcggtggcctgtaatcccagcactttgggaggccaaggtcacaaggtcaggagatcaagaccatcctggccatcatggtgaaatcccatctctactgaaaatacaaaaattatctgagtgtggtggtgtgtgcctgtaatctcagctacttgggaggctgaggcaggagaatggcttgaacccgggaggcggagattgcaatgagccgggatggcaccactgcactccagcctggcagcagagtgagactctgtctcaaaatatatatatttatatttccctgattttctgaaagtaaattggacacatgataaccctttaatactgcataattcagtatgtaccccctgtaaagtattttcttattcagttacattactgaagtaattatgaaaattagaaaaataacactgactcaaaattactatttaaactttagacatcattcaaatattattttgtgtcccagtaatatcattcatacctaaagactatactttttgaacatactaatatttttcataaatatttctttatcgccttccttaccctgcgttactgaaaacggtgtgttttggtcatgtttattttgaacatagtgccaaacacattcatcgatattattatattaggttattcttgcattgctataaagaaatatgtgagactggataacttacaagaaaagaggtttaattggctatcagttctacaggctatacaggaagcatggcaacatctgcttctggagagccctcagggagcttttactcatgggggaaggttaagtagaagcgggcacttcacatggtgaaagcaggagcaagaaagagggatagagtggtgagggcgttgccacacactttaaaatgactagatctagtgagaactcactattatataggtaggaccaatccatgagggatccactcctatgattcaaaaacctcccacaagaccctacctccagctttggggattacaactgaatatgagatttgggtggggacaaatattcaagttatatcaattattatctttccatctcctttacatatagatactctatagaatgatgcagtgtaatcttacataatatctctcttcaagtttgaacaatcattttttctaggtatggaacaaattacttttatggaatttttatttcctaaacttccctgcactcaacctacatatactctgaacaaatctgaatatagttggatttagaaatctagaatagtcttatatgtacttatatgtggcatacagttaattatgtaaggaaatatttgccctatataattttgtgcttcattttctgttcactccatgttttattttctttcaccaaccaattttcattgttttatttgactaattcctggctacaaacatgatcaagttgctctttagttttggggaaacttaccagtttgtatgtattggtccagtcaaagggggtaaaatattattagccagaagttttctgaataaacataataaagctaactcgatgttcattttaatggaatttttatgttaaagcctagtgatctgatgaaatgccttcccagttacatatatttctatcatattagtgttggtcattttgaataaaagttgtcactttgctggatagtgtcacagaaatactggtactggtcactggttaccacttttaactgaaaggaacttgagtgtctctgcttcagtgatcatattttcaattattaggaagctaagcaaagggtgatttggtttgtataaggttactcactgagtcggcagaaatgccactgatctcattttatcatatctgctaggttttatgtgacattgaaatgcctcattgtccaactcttgttttttgttacaatgaagatcactaatatattatttgtatttgtagtaatatcaataatcatctgcaattccactttttatattgcattataatttatcaactatttttaatcagtgtcttctacatttgactttagccaaaaagctaagaaataattattttcactgattttatttgaaatggttctttactcatggtgcacagggcaccataattttaataaaactttaccgttcaatacagttttgattaattccaacaactaatatcattcattaatcataaattctagaaaactttttttcacagaagctaaacttcctgatctggctgtggctagttttggagtctgttgttcactggttacaatgcttatatcattctctacttatattttaattagaagaatgtaagtagttgggtcacaggctgaaaaatgacttaaaaattaaaataattatagacaaagcccaattaaacataaatttcaaaactctgcaataaatactttttattctaaaaatttattcagtttctatgaattccaacttgaaagaattattagttttctataattatatgtgctgtcagtaaacatttattttgatgtgaaataattactatttacaagccttaattgaaataaatttgtttatgtagatctgtatacttttttcctacataagttatttttaacagctatactaaaatttagtttcctcttagtgtgtaattttgttattttatatttgtgtaatattatttttagtcttcctaccaaaagttgacttttcagttgttcattcttagagcacagtgataataaaaaggaatctatacttaattctatccataatatgctttggcagaataaacaaagtaactaacacattaaaattaccaagtaattttaagttctaaattaaataaacaatgaacaacacataaatattttctttaaaatattttgtgtagaatatagagtttgtttccacaattattcaaaaattagcttaaatacccacatattttgttgatgtactaataatggggatatttttacaataaaacatagaattaaaaattatgattttggagaattcataataaggtagggatatagtatgatttatgtaccctttgatctcacaattaggtgggaagacaatgaataagtaattcactcgataaaaaatattgttaagaaatgtatatataaaataaaatattatttttacagccttttaaaaaaggttttcaaacatattgactgttgatcttgcgaaacccttcattacttaatatctattaaaatattttcacttatcaggaaatttataattatctgtaatggtttatataagagcaccaaaatgttaagtaagcacaaccaaagctcaaccccaggaattctaacttaaaaatttcattctggtctataacgagctctcttgccccgatatatttattctatgtagctgttggcactatctatctatgtgtctcatagataaaaccacataatatctaaaaaactctagttataatataatagcataggtaacatttattgtatacatatgtgtcatattttaaatatattctttccattccttgcacttagagagttgggtgggattattcctatttcaaagatgagaacactgaagtttagtaactaataaatgagtaattatttttgagctgatgtgcccctaaaggccaatatctttctgcatctttgattatttatacttatagaaaactacattttgtacttagtacttggtaagtagattttgaaatacgtaataacctattagtagatttttcttatgcatacacagctttttaagtaatagaagaatttttatgatacagagaaatagtatgataagacatattatttatttcactttttaaagccaaactgatttaaaataaagtgataccttaaatgacttgacatatggtctgaaatgtttagactgattattggtgaaatattttgggggaaatttgcactgtaaattaaagcattatgtttattcaaggtgacaaagaaatgtacttcaatggcatggtactgttttatttcattactaaaaacaatagaactaaagtgctaaaggtaaaatagagagcttgtagtgcattatattttaagaaaaatgagacccagaatgtcttgcatgttatatttgccaaaatatttgataaattcagcgaaacaaatgtttgccgattgctttttgtaagtacctctgatatgtgcttttatatacatggcctaatgatcttatttatgagaatgacttatcatcatcatacacagtcatcttcaataagcaatttttaagcttataccattggagagacacttcactagaagatgtggcatatacaatgaagattatgtcatacctaggagtgagagcctaattacggagatgaggctagtgcataaaatatagttaacaataaagatagcatgtaaatgccaacaggtgtataaatcgtaattattaaagatggtcaaagcaagacaatatcttttatgaaattattttaatcccttactctttattatcatccaggagaagtcaagatctaaaacatagttcagagaagcagaaaagtttcagcacatcaggtgcttccagtcctggatgaattctaaataagaaattccaatatagtagtgttgacctagcaacaatttaaataaaatgatttcctttttatttgcttctctgaagcatggacaaactgctcattaacagtagaacaaactgctgtccacttttatagttatttgaaatataaaaatcaattattagtcatgagaatgaatcacgttttaaaacaagggttgagaagtaaagtattttagttttttttcaaggcaagtattctaaaatgccagcattaggtccatttacaaaaagttgaatcattacattcttgaaattctttaaaataatcatgtaaaactttaaaaatcagaacaatattacaattattatagataatttgagaaggataatttattccacaaatattttatataaattacttagctttgtaagctaaaatatcatgtaggattttttttagtctctctgttattaactatattaaaaggaagaaaaaacagctgagaggaaaattataataaaactctgtgtgtttgtatgtgtgtgtgtgtgtgtgtgtgtgtgtgtgtgtgtgtgtgtgtttctccattcagaagaaataatggaggaggagttaggctgttaaccaagcctagcactgacatcattcaagagtcaaaaaatataatagaaggcatgcctaatacattgtttactattggaaaattgaagatcaagagaaagaaaaaagaaattatttatgtcacccaacatatggaataaactgaaagtgaaaagaaatgctcctattatagcataaaacaactatgttactgttgcagcatagaagtggcatgaaaatacatggggtaataatatcagaagtagtagaggagagtggcctgaaaccatagctcccatcatgaggggaaggggacaaaatgttacaatagcaacccaaaatacagtaatgtctgagaaagtgacagagggtacatggttaatgaagagaacatatcagtaattaataatgaaccatatggaaacgattttatttcttccacacctttgagtaagggttgaatcagaaagaatggtattgattaccatcactatacctactccaagttaatgtggcctggggaaactagaatcacttgcaaatttgtgttcacacaggtgcttcagactgtaggtgatgcttttaaatgtaaataatgctctatattccttttggagaacttaccttacaaatatgctggcacacacacacaaaataatatatgcagagacattcatttgcagcgctatttgacatggcaaattttgactactcctaaaatgttaaatacattgtggcagattaaacaataaaatcatatgcaattaagaagatggaatatctatatataaagatatgaaagtatcgtcaagatatactttaacaggaataaaacaagatgccaaagagcagcatgtatcaaatcaatcatttattattatttcactattattattattattaatttgagacaggaattaatttgaaacctgttgcccagactggagtgcagtggtgtaatcacggctcattgcagccttgatctcctgggctcaagtgatcctcctgcctcggcctccagagtagctgggactacaggggtacaccaccacactgggctagcttttgaatttttggtagacaagtttttgccatgttgcccaagctggtctcaaactcctgggctcaagtgatctacctgcctcggccttgcaaagtgctgggattacaggcatgagccactgctcccaatcacttatttttaaaggtgaggtagaggataaacttcatttgtgtttccttgtacattcataacaattctggaattattcttaaggaactaagagtagtcatcatcgttgaaggaactggaagtaagaattgggcagatgaaggaaaaaaatgaaagaaagactagaaatgcatgattgtacaactatttagtatttgctacattttcagccatattattacaaagtgaaagttaaaaaatgcatataatttaataggcatgttatgagcagtgggactgagtgagctgcctcacactgttaaacgtgataactacatgaatatagtaaaaggatcagatagtctcataaagtccgtaacaactcaaaaaattattatttcttgaattggtaatctattcatttttattttttacatttaaagctagagctacaactggtttagttagagaccaaattactcatccagtttctgtaagccatccacattttactttcatgaaaacacacatggtaagtaaatgtggagatatcaaaaaggaccctcggggtatgtcattgagaactctgtgaatgagctcaggtttctgcatcctaccgtaatacaggccaccgttttataataataaccccgaggacagttgctctttccagaagtgaggtgagtcacatttgtgtttgtgctccattgactgccttttcccttcctccgttgagctcatagtccgagattcctcaagcagttcccgtcttccttcaggcccactcctaattggaacccatctatcccactaacagccgttgagctttaccctgtgaaacattctggttgttgtcttttcaacttgaagtcatatcgaaagatgataattgtaaggctaaattcaatacttggggttagattatactgtattcttattcgctgacaaatattatttttgtgatctcttaatttagttttgaagctttataaagatacacaattaagaccctccaattacatatttcacaatttaactttattggatagaataaaagcagctctctctctctctctctctctctctctctatatatatatatatatatacatacatgtgtgtttgtgtgcatgtgtatttaattatataaaatttttcaggtaggcaaaacatattattttattgtaattagaatttcagagctagaagatattttaaagatatatctcaactattcaatttacagaagtggaaacaaactcaatgaataaatacatagttacagatgtagttactttacgtattgcatgtgtgtataattatataatttttcagttgggcagagcatattatttcattgtgattagaatttcagagctggaaaagattttaaagataagtcttaactatttcatagtagtggaaactgaaactcataatgaataaatacagagtcaaatgtagttactgtaagtattgcagctataacctgtctcattcacattttaaataagagattcattaaggtataattcaaataccatacaattctctcttttaaagtgtatagttcagtcatttttagtatattcacaaaattgtgcaactaccacagctatttaatggtaaaacgtttgtatcactccaaaaaagaaaacctctatccattatcagtcacttcccgttcacctctccctccagttcccagaaaccaccaacatacattcttgtctctatgcatttgcttactctggacatttaacacaaatagaatcatgcaatatgtggccttttgtcacagcatctttcagttagtaaaatgttttcaaggttcattcatgctgtagcatgtattagtactttattcctttttattgtcaaataatatcccattatatggccataccactatttgtttatctactcatcaagtgttgggcatttgagttatttccccttaagggctattacaaataatgctactaagaatatttgtgtgcaagtgtttgtgtggccctatattttcaattaccttaccttacacctgggagtgaaattgctgggttctatgataacttcatgtttaacattttgataaacccccaaattgttttccaaaatgactgcgccattttacattaccaccattaacgcatgaaggttcttatttctctttaccctcacaaacacttattgcatgccttgaaaaaaaattatccttgtgagtgtggtgtccaattgaagttttgatttaccttgccctaaagactcatgatgttgaacttccttcatgtacttacatggccacttgtatatctttcttggaaaaatatctactgaaattctttgcaaatttttaaatttatctttttatcgttaacatgtaagagttatttaaataacctcaatataagttgctaatcaaatatgatttgcaaaaactttctcccattctgtgggctgtcttttgactttcctgatgagatcctttctttcataaaagttttaattttgatgaagtgcaatttatctattttgttgttgttgctgtgcttttgttgttatatataagaaacaatttgcctaatccaaggtcacaaggtcagattcctttattttcctttagaagttcatttacatttttaacatttctttcctcaaagaagtttattatatgcaatttggcaatagtttaaacaataaacaagtaaaggaactagaaagcagatattacatgtttatatagtaatttcaacttcattctttcaattgttatttatcagatacctatagtgaaccaagcataatgttaggagctggttttttaatgtaataatttatttagttttaacaccaattctttgtggcaggaattatgtgcagtcatacatcagagatatcatgggtttagttttagaccactgcaataaagcaaatatcaaaaaagcaaatataataataaagtgagtcacacaaatttttctgtttcccactgcatataaaaattatgtctacactatactgtatgtctacaatatactgtagtatattaagtatgcaatagcattatgtcaaaacataattaacatttaaaaataatttattgataaaaatgctgactatcatctgagcattcattgagtcgttaatatttttgctactgcaggatcttgcctcactgtttatggctgctgattgaacagagtagtggttgctgatggttagggtggctgtgggaatttcttagcataagaaaacaatgaagtttgccacatcagttgacactatcttgcccatatcttttctctgtagtatgcaatgctgcttgaaagcattttacccacagtagaatttctttcaaaattggagtttattctctcactgtgcagctgctttatcaactaagtttatgaaatattctaaatcctttgttgtcatttcaacaatgtttgcagcatcttcactaggaattgtctctatctcaagaaaccactttttttttcctcattcgtaagaagctacttcttatctattcaagttttatagtaagattgcagaactccaggcatatcttaagtctccaattctaattctagttctcttgctatttacaccaaatctgtagctacttccttcaccgaattcttgaatctctcaaagtcattcatcagggttgaaatcaacttctttcacagccctgttgatctgtgtactttgacctcctcccatgaaacacacgtttttattggtatctagagtggagaatcctttcctgaaggttttcaacatatctgcccaaatccatcagaggaaccactacttatggcaggtatcaccttatgaaatgtatttttgaataataagacttgaaagtttgtattactatttgattcatgggctgaagtatggatattgtgttagcaggcatgaaagcaacattaatctccttgtacatgtccatcagagctcttggatgaccagatccactgcaaatgagtactaatatttttaaaggaatcttgttttatgagcaccagatctcagcagttcacttaacatattcagtaaaccatgctataaacaaatgtacattcatccaggctttgttgttccatttatagagcacaggcagaatagatttagcataattcttaaggcccctaggatgttcagaatggtaaatgagcattggcttcctcttaaagtgacctgctgcattagtctctaacaagagagtcagcatatcctttgaagcttcgaaggcagcaattacttccctccacctatgaaagtcctacatggcatcttcttccaataggaagatgttttgtctgcatggaaaatctcttgtttagtgtagcctccttctttaaatgatcttaacctgatcttctgcataacttgccgcagcttctacattagctcttgctgcttcatcttgtagtttttcatatgaagaaggcttctatcttaatgcttatgaaccagcctctactggtttccaacttttcttctgcagtttcttcacttctctcagccttcagagaattgaagagaggtccttgttctgctttagactttggcttaagagaatgtgtggctggttttattttctatccagaccacccaaactttcttcatatcaggaagaagcttttttgctttcttattattgatgttttcacttgagtagtacttttaatttctttctagaacagttttgttgcacaactcaggtgtttggtgcaagaggcttacctttcagcctatctcaacttttgaagttcctctctcagtaagcctaaacatttgtaacatttcattgaaagtgagagacatggccaggcatggtggctcatgcttgtaattccagcactttgggaggctgaagcaggcggattatgaggtcaggagtttgagaccagcctgaccaatatggtggaaccccatctctactaaaaataaattagctgggcgtggtggtgcgcaactgtaatcccagctactcaggaggctgagacaggagaatcgcttgaacccgggaggcagaggttgcagtgagcagagattgcgccactgtactccagcctgggggacagagtgagactccatctcaaaaataaataaataaataaataaataaataaataaataaataaataaataaagtgagagacatgtcactcttcctatcacttgaaaacttcgaggctattgtagggttaactggcctaatttcaatattgctaaaatagataatagggaggttcaaagacagggagagagatagggaatggctggaaagtggagcagtctgaacacgcataatatttatctattaagtttactgtcttatgtgggcatagttcatggctgaccaaagcaatgataataaacatcaaaaataactaatcacagattaacataataatgaaaacatttatgaaataatcaaatattgtgagaattaccaaaacgtgacgcagagacatgaagtgaacacaagctgttggaaaaatggcatcgatagatttgctcaatgaaggattgtcataaaccttcaatttgtagaaaatcaatttctgcaaagagcagtaaagtttaacacaataaatctaggtatgcctatattcatttttttccaaaaagaaattaagagttaggtaacttttctaaagtcattgtatgaaagaatgaagatagagttaagagaaaaacaattctgattctagggaaatgcaaatcaaaccacaatgagataacacctcataccagtcagaatggggattattaaaaagtcaagaaacaacagatgctggcaaggctgtggagaaacaggaatgcttttacaccgttggtgggaatgtaaattagttcaaccattgtggaagacagtgtggcaattcctcaaagacctagaaccagaaataccattagacccagcaatcccattactgattatacccaaaggaatataaaacattctattataaagaaacatgcacatgtatgttcattgcagcactattcacaggagcaaagagaatcaacccaaatgcccatcaatgatagattggataaagaaaatgtggtacatacacaccatggaatactgtgcagccataaaaaggaaacaagatcatgtcctttgcagggacatggatggagctggaagccattattttcagcaaactaacacaggaacagaaaaccaagcaccacatgttctcatttaaaagtggaagctgaacaatgagaatacattgacacacagaggggaacaacacacactggggcctgttgggctggtggggagggagagcatcaggataaatagctaatgcatgagagtcttaatatctaggtgatgggttgataggtgcagcgtaccaccatgggacacacttgcctatgtaacaaagctgcacatcctgcaaatttatcctggaacttaacattagattaaattaaaaataaagttgattctaagcattctgtaaccatatcagatatatggttgtggttgatagctcgaatgtcagagatggagaactgcctgggtttgaagaatggcgttcaaactcccagcaattcgactttggtctagttaattaactgctttgcatttccatccatgcaaagtgcaaataataatatttatataggacagttatgagaattaaacatgttaatgcatttaaaatacttaagcttatgactggcatgttattaatgcacacaaaatgttaaaatgttagttatatttattcataaaatttattataaatctctgctgtctggaactgacattctattagcggggacagacgctgaactaacaaccatgtaaatttttatgtaattaccaattttggtaagtactacatagaaaagaaaaaagtaatataaattataaaagtgattaggtagttcaagatattcaagtatttctttttctgttccttgctgtgggtgttaaaatctttttatatttgttttcttaaattttcatacaataattcatttttatatatgtatatggtgtttccacatagcaatacataagggaaaaaagttgattaggataaaaatatcctgactctcaactgaaaagtaggtaaaagttacattcagtaatacaaaaaaaaaaaaatcagcttatacaactatttcatgaggtcttatttctaatggaaatttagtatcatcacttcaaagtatttttagaaatacggtataaatcatatatgaattagggttctcttagagggacagaactaataggatagatgtatatataaaggggagtttattaagtattaaattacacaatcacaaggtcccacaacaggccgtctgcaagctgaggagaaaggagagccagtctgagtcccaaaactgaagaacttggagtccaatgttcaagggcaggaagtatccagcatggaagagagatgtaggttgggaggctaggcccatctctcctcttcacatttttcttcctgttttgtatttgttggtggctgtttagatggtgcacacctgattaagggtgggtccacattccccagcccactgactcaaatgttaatgtcctttggcaacacccttacagacacaccaaggatcaacattgcattctccaatccaatcaagttgacactccatattaaccatcacaatacaattaataaaactaatacataactttaaaattataaaatctcatttatcccttaaattttaggcctttagtttttgaagcactcaaaagtcaaagttaaaaaagttactatcattataatgttacagtcaaatgcccagtaatgtacattaatgatttcattttagaaaacatgtgcacagttcttactggcctagaacagaaaatgaggacattgtgtgcaaatcaatggggacattgtgtctctggaagtgactagagttttgggtatttttcctttttttaaaaaaatgtcaacttttattatagattaagagatatacatgcaagtttgttacatgggtaaattgtatgacactgaggcttaaggtcccaacaatcctgtcacccaggatgtaagcatagtaaccaacaggtggctcttcagcccatgaaccccttcttttccgctccatctagtgatgcccagtgtttgttattcccaaccttacaattaggcattttcaatgtttagctcctacttataagtaagaacatgtggtatttggttttctgttcttaagttagtttgctgaggataatggccctcagctacatccatgttgctgcaaagggcatgattttgttctttcttacggctgcatgtattaatccgttctcacactgctataaagatactatctgaaactgggtaatttatatataaaaaaggaggtttaattggctcacagttctgcatggttggggaggccaccagaaacttgcaattatagtggaaagcgaaggggaagcaaggcacctcttacatggtggcaggagatagagagagagagagagtgcgtgtcagatactgccactcttaaaccatcatatctcatgagaactctctatcacgagaacagcatgggggaaactgcccccataatccgaacacctcccaccaggtcccttcctcaacacctggggattacagttcaaggtgatatttggatggggagacagagccaaataatatcactacataatattccatgatgtatatgtaccacattttctttatccagtccactgttgatgggcgcataggttgattccatgtccttgctattgtgaatagtgctgcagtgaacatataggtgcgtaggtctttttgatagaatgaattatttttctctgggtatatacctagtagtgggattgctgtgtcacatggtagttattttttaagttctttgggaaatctccaaactgcttttcacagtggttgaattagtttgcattcccaccaaaagtttataagcattgtattttctccccagcctcaccaacatctgttattttttactttctaataattgctattgtgactggtgtgagatggtatctccttgtggttttgatttgcatttctctgatgataagtgatactaagcatattttcatatgtttattggttgcttgtatgttttcttttgagaagtgtttgttcaggtacttttcccatttttaaattggattatgtggttttttgcttgttgatttgtttaagttccttacagattctgggtgttagatctttgtcagctgaataacttacaattattctttcccattctgtaggttgtctgtttactttgttggtaatttctttttctgtgcagaagctcttttgtttagttggatcctacttgtcaatttttgtgtttgttgaagttgcatttgggcttagccataaattccttgccaaagtctacgtagaaaaggatatttcctaggttttcttttaggattgtcatagtttcaagtcttacatttgaatctttaatccatcttgaattaattttcatatatggtgagaggtagggttctagtttcatagacctcattcaatggctgcatatggctagccatttatcccagaaccatttattgaatagggaatccttcccccattgcttatttttattgattttgttaaagatcagatggttttaggtatgtgggtttatttctagattctctattctgttccactggtcgatgtgtctgtttttataccataccatgctgttatggttaatgtagccttacattacagtttgaatttaggcaatgtgatgcctttggctttgtgctttttttgcttacaattatattgcctattcaagctcttttttttttttttttttttttttttttttttgctgttgttgttttaaatgaactttagaatagatttttctaattctgtgaaaatgaccttggtattttgatagggagagtgtttagtctataaattgctttgggcagtatggccattttaactatactgattcttccaatccataagcatggaatatttattattatttttttttgtccctgatttctttcaacagtattttgtagttctctttgtagacatttttcacctccttggttagataaactcctaggtatttcattttgtttgtgactatgataaatgggattgtgttcttgatttggttctcagctagaacgttattggtgtgcaaaaatgctacttttcttttaactgattttgtattatgaaacgttactgtatttgtttatcaagaatgtttaggtggagtctttggggttttgtagatatagaatcatatcattgaaaaagacagattgacttcttcttttcctattttgatgctttttattttattttctctcttgcctgattgttcctgctaggacttccagtgctatgttaaataggagtggtgagagtgagcgtacttgtcttgttccagttctcaaggggaatgcctgaggtttctcccattctgtatgatttggctgtgggtttctcatatatggctcttattattttgaattatgttccttcgatgcctagttggtcgagggtttttaacatgaagggatgttggatgttattgaaagcttttcacgtgtattttggctgtaataccaaaaataagaagtgtgtcataacaacagaggcatgaagagacagccttcttttcccttatttccctcattacagagttaccattttaggtccattaaatgtattttcctactctataaggtgtccagttcaaaaaaatcacacaagggcctagagacctgaagatgaactctagagaatggtataatatgttttgtgtggatagagtatttcatttttaagtatttattactttctgatagattatgtcactcaatcatggtgtctaatatatagtattacttttataggtaaatttataagtcaccatttcagacatatatttctcaaaattaggactatagaacattcaggaacttggatttgtaaagggatcggctgctggtatgaccgaacatacaataataagtaaactaatgttaaaaataaattttaaatacacataataaaatattctataccttcctgggttataaaataaatatagttgatccaataatttttaagtgaatatgaaattcccttctacatatttagtttcaacatccctgcagaaattctgggagagaggaaagagagttacaatgtacttagagtttgttcaacagggtgtggcctgggacagactgtgctggtctttttcttgtggaacctttgctgtatcacctttccctaggatattgcactggcttttctctgtcatctacacttctaataaagagagaaggatgaggctataataaaagttctcccttggagtagtctctctagtttgtgagacttctcagatttaatgaataagaaaatataaatgctatattgaagtttgatgtatctcttcagcctatttcaaggctatgctacttgttagcatatccttcacatgccattaaactttttgggtttcggaggacacccaacatgactttccgggaagcatcttctatctgtccttgaacacgcttcaacttctttgtgtagtggggcaaactgaacttctatatgggcacatgttttcattaggcttcttcccatgacagagatgtttcgtgttacactacatttgttgactgttaaagtaaggcagtacatttaactatcaacacagatagctattcttgctaagaactatattttgaactcagtgtctgagaatatgtacaaaaaacttagttgagagatacaattcatatatccatgaacatttattgcacacgtattttgtatgcagtgaatcctccagataccattctgtgcattggcaagataagattgaacaatttggacaggatctctggcttcacagagctaacattctactagagatacagttttcatacagaagcaacatgcatggtgggctaagagcttgaattctgaagttgtacctgaatttaaatcctacttcaagcacattttagatgtgtgatcttgagcctctcttacatcatttgtaaagtgcacatagcaatacagattaataatcctttatctgaaactcttgggggcagatatttttcagaattcagaaaaaattgtatatttagaaaggtaatgtggtacatatcggtgtaatatttaacaacctaagtaggtctgcaaaagcattttttttttttttttttttgcaaagaaacacatgaatagtcactctcagtggaataagaagagattataaacagtctcacctcagttcaggtcaacagtatttgacaataaaagggttttaatgtcaaacttctgaaaaaaacaaacagcaacaataaaagcagccactggttttcatcatgtttttggatttcaggattatagctaagtgtttatggatatgtagcacttgaagaagacaacttatgtcttgtcagcacagattctggcatgtggtgggttcttacttgttattaatatcagaattggcctggctatttctttagaaagtaaaataattattattgactcaaccataccagcagatatttatgtacgtgaactgctttcatttgacaccttacttctcctcaaattatttttacagaatggacctttagaatttttatgtggaaatattatgaaacggaggcttgtgagactgactatattatttgcttcatatttaccttaatgttatagattatgtgtctttctgtgcaatgactggtagaaatcttacaaaatagagatcaatctccagcaaaatacaaggcttcactgtataaactaaatatgttactttattcttaacgttctttcatttcctacaatatttaaccaccttttcctgatttttaataaattcactttttaaacttttcacctgtattttcatatgctgtctcaagcctctctgtatcaagacataaagaataaatttgtgcattatatatagatatatatgcatgtgtgtgtgtgtgtgtgtgtgtgtgtgtgtatatatatatatatatatatatgaaatatacccacagtgtatttcttttttttgtttttttgtttttgagacggagtctcgctctgtcgcccaggctggagtgcagtggcgcgatctcagctcactgcaagctccgcctcccgggttcacgccattctcctgcctcagcttcccgagtagctgggactacaggcgcccgccaccacgcccggctaattttttgtatttttagtagatacggggtttcactgtgttagccaggatggtctctatctcttgaccttgtgatccgcccgcctcggcctcccaaagtgctgggattacaggccacagagtgtatttcttctttttctatctccttcatattttcagatcctagactaatccaataaccatcatctatttactatacatttttattttcaattttaattgcaattatatatcgtgttttttgtgcctgtgtgtgtgtgtgtgtgtggtgtgtgtgttcaattggctcttgtgagttagcctagaaaagtaatcatggtttatactctgatttctatcaagaagtaagctacatgtttccattacagttccatattgacataaaaactgtttctaaattggaaaccaagctatgtgccaacttatttattgcatatttttaaagaatatttgtgtttcactagtaagtcactttacttctttgcaatacacattgtaaaaatctttgaatattttttttttctgaatcacctattcctagaagtgtggatacaaaggaaagaaaaataagaggacaacatttatatttttctctagaaaacaatgttttctacaatattgatttgtaatttttatatttttccctcttctttaacctctaaggttttcatttatcatgtaaaataattttaaaattagaaacaaatcattttatatgagtttagcacatctcattttttcctactttcacattaattcattacactcaaatttcattcactgagaatttgtaataaaaataactattcatccctgccatactacttagcatttctattagcccatccacataccctgttgcactttacaaggcagaaactctgaattgcttacaggtcaccaagcacaccctggcatttcagacttttatctgtttacacctgtttttcctctgcctgtagcaaatgtcttcttctcctttgttcactagaacacatcctatgtgacctccacatcacaaatcagaggtcattgcttccagaaattttctactgacagtccaagggagcattcctttgtgttacttctagtgttcctctgtatttctctttaccagatacatgtgtgcatatttgtgtttattacattgtactgtactaaatttcagtgagtttcctttttagtatttgtataaatttaagggctacaagtgcagttttattacatggatatattgcatagtagtgaagtctgggctttcagtgtaaccatcacccaaatattacccattaaacaatttttcatccctcatcccctcccatccttagtgagtttcttgataggaggcatgtagctttttcattgctctacccttacccagtcatagcatttcctatattttcattgattgtatacaggcttaaaataaattaggttgaaattaaactatgtatgttagttttttttaaaaatgatccatttcatagaaggacttaaatagtaggccaatacccattggtaatgtgagtgatgaagaaggtggaagaagaatattagcagtttagatttacaccttgagtttgagtgccagttaactatccaagtcagtagtaagattagattgtgggccactggagaaagattacacataaggagaaaatcaaaaggaagaaaggtgtccaaagtgataaacttgcagcaatacctacatcttaagaaattccatcatttaatgagtttacatatggaaagtgtttgggaaggattccaaaaggatgggatgagaaatgctgcaggaaacacgggagaagttgtaattctgtaaaatgaaagggaaagggaatctcaaaaagaaatgactgtttattgtgttaaatatatgcatctgggagacattcttgatgttagtgatagtaatttcactgctgtaatgtgaagaaattttagtattttgaaagataaatggattttaagaaaagagagatgatccctacaaattttgaagaggaacacactagattgtgctagagaaggatatggggttgacagaggatttttttaaatgtaggaacaacttaaagaatattactttagataaatagtttagaatgaggttaacataaaagaacaaaaggaaatattgaaaataacaaaatgggaataatatattgtttggtaagtagaagttgcagctttgcactgacaatggtgatacataataaagtcttggcatcataagtaagtttgtagactggaaatgattagcttgagaatcttgctgcaccttgtatcttactgtctgagacaatagctagtgggaagctaacaatttattagaatggtaaaagttaaaagcatcttctcttacagtgagaagagaaaacatactagagatatatagaaagatgttcagatagccgtgcatcttcaaaaatgaggctggatgcacagaatctgtgggcacacaaatctgcaaaactttcgtgattgtctccagtggccctcagtagactggctatggaaacaaggagaatacatggtgatattaatgcaagtttggagttttcataattaatattacataaacaaaaagagaagcaatagagttaacatttttcagatgatagtcaaagggatggaacactaaattgaatctaaatttgatttaggagagaaagcaaaaaggagtcatttattctggctgatggtgccattgacagtgatgagctatcctagtaaatggtacaaaggcaaacatatggttgtggacagtgagcctagaaagtaacacctccttttaaatactgtgatgttgccagcagtcattttcatcataaattctatagaataacatgtggatgctgcatgaaggtttttttatatttagtttctactgggactatgttagtctaacattaaatttattgtttattatagggttagatccatttatacagcagaagacctcactaagtggtatattttccaataaaaactaaaacctgaatttaaaatcttaggagctgattatattgcagtggaaatttgtctcgcttcattattccatgaaagttttcattcatgttggtatctagatatactagacaagatgttacggtagtcagagcatgcttttcaccctgccttattattattattttgtttttgaaaaagaacaagataaattgtcatcttaaacccataacattaagtatttcataacttcttaaaaataaaaagcaaattttatcttgtaaaattttcatctaatattttattttcatgaataattactgatatatcttaacagaaattgttgataatattagcaataattcatattcttaccataatttaccactgacagattacttttatatgtattatcttctgtagagataattacattaaactctacaacaaatatagatttttaaaattttgtttatttttattattattattttaatagttttgggagaacaggtggtgtttggttgcatggaaaagttctttagtggtggtttctgagattttggtgcactgattacccaagcagtgtacactgtacctgtgtagtcttttattcctcaccctcctcccacagttcctcccaagtacccaaagaccattatatcattctttaggtttagcatcctcataccttagctcttgcttataagtgagaacatatgatgtttggttttccatttctgagttacttcacttagaataatggtctccagctccatccagggtgctgcaaatgtcactatttcattccattttatggctgagtagtattccatggcgtgtgtatgtgtgtgtgcatgcgcatgtatgtgtgtgtgtgtgtgtgtgtgtatgtgtgtatatatatatatatatatatatatatatatatatatatatcacattttctttattcactcattggttgatggtcatagtctggtttcatatctttgcaatcgtgaattgtgctgctgtaaacatgcatgtgcaagtgtctttttcatatagtgacttcttttcctccaggtagatactcagtcgtgggcttgctggatcaaatgatagttctacttttagttctttaaggaatctccatacagttttccatggtggttgtactagtttacattcccaccagcagtttaaaagtgttctcttttcaccacatccacgccaatatctgtttattttttaatttttacttatggccattcttgcaggaaaaagttggtatctcattgcggttttaatttacattttcctgatgattagtgaggaacaatttttttcatatgtttgttggctatttgtatatcttcttttgagaatcatctgctcatgtcattttcccactttttgatgggattatttagtttttcttgctgatttgtttgagtttcttgtagattctggatattcgtcctttgtcggatgcatagtttgcaaatattttctcccactctgtgggttgtctgtttattctgctaattatttcttttgctgtacagaaactttttagttgattaggtcccccgaatttatctttgtttctgctgcgttggcttttggattcttggtcatgagctctttgcctaagccaatgtctagaagagcttttctgatgttatcttctagaatttttaaaatttcaggtcttagatttaagtttgtgatccatattgagtttatttatgtataagttgagaaatgaggatccagctctattctcctacatgtggtttgtcaattatcccagcatcatttgttgaatagggtgtccttttgccacttcatgtttttgtttgctttgttgaaggtcagttggctgtaaatatttggctttatttctgcgttctccattctgttccattggtctaggtgcctatttttataccagtaccatgctgttttggtaactatagcttgtagtatagtttgacgttgggtaatgtgatgcctctggatttgttctttttgcttagtcttgctttagctatgcatggtattttttggctgcatataaattttaggattttttttctagttttctgaggaattattattgtattttaatgggaattacattgaatttgtagtttccttttggcaatatagtcatttttacaatagtgattctacccatccatgagcatgagatgttttcatttgtgtcgtctatgacttctttcatcagtgttttcaaatatatgtaattttaatgctcaaagaaggtgcaaaaataattgtctgcaagtttatattggcaatgtaatagttaataaaaataaatttttgtttttgaaaatgggaaaataatacacaataatcatgcttccataaagaacacatttcagatttgacttttaaagtcctaggtataaatataagtaacggagaatttagaagggctatgaaaataaaatgagagcaaaatactctgaaaagtaatcccaaagacaattgttatggtttgactatgttccccaaaattcatgtgttggaaacttaattctcagtgcaacagtgttgtgagatgaggtcttgaagatgtgattagctcataaggctcataaggattcagatagggaaaatataaagcaattaccccctgaggaactaacgctccagtagagtaattaattgtaacaaaaaggtaaaggcacaatatcatcgctattcaacatttttaaaaagtaccaggtatgtactaagcactatatataatagtgttcagaaattatcatattacatgccattgtggaggttgcagtataatgtgaggaggtggatgttaatcaaatgattaacaaaaaatataaaatcataatagttattgatatggtttggctctgtgtccccacccagatctcaccttgaattgtaataattcccacatgtcatgggacggacccagtaggaagtaattgaatcatgagggcaagcctttcccatgctgttctcgtggtagtgaataagtctcatgcgatctgacggttttataaatgggatttcccctgtgcaggctctgttgcctgccactatgtaagatgtgactttgctcatcctttgccttctgccatgattgtgaggactccccagccatgtggaactatgagtccattaaacctcttttataaattactcagtcgtgtgtatgtttttattagcagtgtgagaagagactaatacagttatacatgaagaaaaggatcaatacatggagctactatgttgtaccatggaagagtctgaggtagatttggtgttcatacatgcttctctgaagaagcagtgactgagttgaaatctgaagaatgagtataaatgagagcaatgagcatgtccccacactctatggctggaatgggtttggtgaatccagtgagctgggagatggccaaaatggctcatggaaagactgaaatggaatacactgcaaaatgaggctgagtggcagataaggagcagaccattgaagaccttagctctgtaaagggaacaaacaccaagcgtcaagacaaggatggggtgggagtggtggaattgtgacctgattgcatttgggattttaaaatgttacactggctgtagtgtagaggaaagattagagagggctaatggtgatagaagtagatgagtgggcaaggacaagataatggtggcatggacagaaagaattggaggcagatcagagatttaaatatgagacaaagtagagatgaattgctaacaaatgagtaaaaagatagaggcgggaaagatgtcaaggacaaaatctaggtttctggctagcttaattaaatgataatgatatcattcatcaagtttgggtctcctccttccacacccccctaaaaaggacattaggttaatgtttgtttagataccataaatgacatgtttagtaggtcctgttagtaagaaatctccatttctctggcctcatatttctatagagaagagcttcaaaaaataataataataacatgttggcctttatttttacttcttactcagtgctctccagtgaagatggaaaaattatctggttaataatttggaggttaatgttgtactcatatctctctccctctctttcctttctctcgtctctttcttttgaaggtttggggtatttctacatatttccagaaagcttaaaagcttaatttgcctctgctatagtgggatagattttgaattatccttcttgcttgttaaaatgtagacaagtttgtcattttcaggtagagtatgttgaaagctcattttggtcacagagataaactgtactctaatcagtctaccagtaataaagcttacacttcagtcttccatttatctttctcctgtgactgtctcttaattggcttttaacttatgagggaaagggaatgtgatttaaacctcctaaaactcttacatgtagctcaggaaatgagtaatctgcctctagaagtaattgaagctgtggatatggatgagactgccttgggatagaatcgagaggtaggtgaatagcctaagactgagcatctaatcacaactgagtgtcagttctggtaaattaagatgacggataaaatacgtcaaataaatttaaacaacatgaacattatatttgtgattttagaaaatggtaagaagccagattgaagtcatatctcgtgtttctggtcttgttaggtgattgggcaggttcaagtgggaaataactttttggaagagatatttctttaactgcttcttaaagttgagtaaaagttagaaaagggaagagaatgagcaaagcttgagaggaaaaagatagcaggaaatttcaaaatcaccttcttccttcctttttaccttaaaaacccatctctaagaactaacacttatttaggtgctgtaacttgaggaaaaaatgattcactagaaaaattctaggacatttatttcagtggttatttatatagtcaatagtaatcatcagaaaatatactctgaaaattggaaaatatacctattttatttacttaaatatttcaaattttacgctgttgttctctgaaaatataaaaatgaaatttcatcaaagtttcttagtcattattataaagtatgatattttcagcatgaattagaacaaatatatagtcttgacatatagcttattattggggattatagagttgtttgcagtgaagggattttagcacttcttttaaaaaattggtttcacaaaatgtatcactggaaaatttatttccctttggagaattctgctgtgactacaaattcactcttgtcaattctttgctatagctttgctagagagcatgtataatactaaactataatataaacttaattggattgatccatttatgtatttattgcatttgtctggaaattattaccataaacttttaaatagtaagttttaacacctaatatggtgttatgatgcacatagaaactatttttaaatttatagaatcaaataacttgattacaattttatgattatcctatctaagctccagcctagtacaggagtctgtttatcactgaagaccatttattagcatattttaaatataataaaagggagagcacatgcttgtgttataagacaaatcatatttttgttgtttacaaggtttgttttcatatttgatttgtcttctcctaatttcaatccctagtctgtccttcacataatacatcaatacaaaaatcaattaccaatttcaaatgataacttttcaaatagatgaagcagacatggacatcacccacactgaaatgttttttgttttgttttgttttgtttgagacagagtgtctctctgtagcccaggctggagtgtagtggtgtgatctcagctcactgcaacatccaccttctgggttcaagtgattcttatgcctcagcatcctgagtagctgggattacaggcacgtgccatcatgcccagctaatttttgtattttcagaagagatagtgttttcacgtgttgtccaggctgatctcaaactcctagcctcaagtgatctgcctgcctcagcttccaaaagttctgggattataggcatgagccaagctgcctggccctcacactgaagttttttttaatgtaaattctctgtcagttactacacaacttaaaaggtaaatgagaacagttctttttgtttttttcagttccatcatttactttttcatatggctagtttccaaatgctgcaccttttacatgatcagctctgagagctttatcttttattaattttatttatatttattaatcatggttatttaaattatttgtttgttgagtgctctgtatgtgttaagatctgtacggactgttttatatttattaatttagtaaatacctgctgagttcattctatatatctggtacttgaattcagtacagtggaacaatggatgtgttataggaattagaccttatacaattgtgggaggagctgaggaaatacagatggaaaaaggagaaagtttgagaaaagatcaccagtcagtcttcccaaagcactgtcacctttggcatgagaatgctgagaacccaagcacatttggttgctgaagtgggactgcaaatgaaagtttgtagaaaagtcagttagaagcttttgaccctgtaagatctatctgctgtaggcccactgctaagagtctggtagtgggtccaaggctgctgttattcaaacaggactaatagatgagaataagaattagacacaaagcagaagagagtaaaaacaagctagagtttgctgggcgctctgtttcagtcactctctgtgtctgatgtaggtttagagagtaatgcccactgcttcactttcctatcccaaatcttgcacaagttccttttctgttcaactctaatccagaactatacaaagaaaagaacactgggtagtatagttaatagcttaactattagagagccaatagttcaaatctgcaagggatgcttgggattcagtggtgaaaagacagaaaaagttcctcgcttcttgcagttacattctagtggtagagtcagaaaataataaatattttatttaatgtcaagcagtggaagttcaggaaaaataattaagcagagaaaggaatggagaatgatgccttggagcagcatgagtggaggatgagatgaggcttccctttttgagtaaggtggatgaggaagactcatctaaggaaatgcaaatgagccttagagacctcagtgatgtaatgtgaatctttcagctacctaaaacagatcagtactggcagagggtaggcagcaggtgggaaaaagcttggtgatttttggaagagccgggtagtgtgtctaaagttgaatgagtgaaatggagagttctaggagcagatttagagacctttccagggattcgttcaaagagaacattataggcatgaaatgagtttggacagtgtatgataggagtccactggagagttttaagcagagatgagacaagtttgaatttacattttattttattttatttttgtgggagaccagagttttattattactcaaatcagtctccccaagcattcaggaatcagagattttaaggacaacttggtggggaaggggaagccagtgagccagcggtgttaattagttaggtaggagatgaaatcacagggaattgaagctgtcctcttgtgttgagtctgttcctgggtgggggccacaagatcagaggagccagttaacccatctgggtggtgccagctaatccatcaagtgcaaggtctgcaaaatatctcaagcactgatctagcaagcagttcagggagggtcagaatcttgtagcctccagctgcattactcctaaaccataatttctaatcttgtggctaatttgttagtcccgcaaaagcagtctagtccccaggcaagaaagagatttgttttgggaaagaactgttaccatctttgttttaaactataaactaagttccccccaaagttagttcagcatacgcccaggaatgaacaaggacagcttggagaacaagatagagcctgttaggttagatctcttttactgtctcagtcataattttgcaaaggcagtttcaatccctccctttgggttttaaaacacctcagtcttatggtgtaggctatgaagatgggacaaatcctgccatctttgtagagagtagattctagcgagccaacgcgagaaaaatggagtctacatgaaaaatgatagctcaaactgggaatctagctgatgtggtagaaagaaatatatcctgaatctaccttgtaggtagagctatatagtaagactagctaatagaccattgttaaaaaagcaaatggagttaaggatcatcctaatttttttagcaaataagtgagttttggcagtatttgcagagatgagtaagaatggaacaccagtgagtttaggagataaattattttctattagaagttagagattttgtgttgattaggcagttacaaagaaaggaattgaggtgaagcgaggagagatggatattgaggtgtacattttgtagttattcaagtccataatgtgtttagggacacgatactagaaaatcagtggggaagatggtatagagtttaaaaagtgaagagaagtgatattcttgtggcaaagattgtgtacaacttaataagagaagtgttgttacattcttatggcatatgcttacctggagggagtaatgcttcttatgcataacctgatttatatcctattttccttcacaacagatttgagctgatgttcaataatacttttggcactccagaataaaatgcaaacagagggtagttgggtgcaagagagaaccagggtagttaaattttgtagccgaaagtaagttagcacaggtgtattaaaaagaaatgatgatgaagatgagctgcagatttttttgcagtgtccaaaacaagaggagcaacacaattagtcaaattgttagaagatttataatattcataaattaaaaaataaaaaagagaaatggaaaaggaagaattgctctgaaaatatttgcgaaggctctgggcttctatgctcttcaagtagtgttaaaccaatttcctttgaattgtctgagatgatattacatagtatggcaagtgatatttggaattcttgtgacattatgttactgaaatgaaattcaataaaaacagtcctacagggacccaagcagttttatacaagttcttaattctctagtagtctgtcttgatccaagataaacttcatttatttcaggtaatcttccacaaaattctctcaactaggagtttgataattattgcaaaggaaagagttattctttcttcaaaggacctgtacttctttctcttcctgttcatatgtgggaaacatatgataccatgtattatatttttctatattccttgggatgttaaacttacaactggacaatactccaagttccctgtgatcgtagttgatatgacaggatgaccaactcctttggataaaataaattggatttttaaattaagttccaaacttttgggagtgagaaatattttggtagtcaagaaatgctcatgatgatgactacagtgataaactggaagtaatattttatgaacaatgacacataagccaccaacatgtggtagttaggaataactataaaacatctataaaagaactaaaatttacaaaaccctcagtgtaatgaatatgagaaataaaaatctcaacatcaataagtgagtcaatttaacaatatttctcactatttctatagggtaataataggcttttgaactgaaaaaaaaaaaccacaaggacaagcttctagtttcttctgatatttcaataaaaattgtctatttacaacagcagtcctaacaacaaaaaatactactttttatactcctctgattaaacaaaaattcaaaagttgcttgtaaccagaggagctaataatcattattaagtatttactaggataaaataatttaatgaatggaaaaaacatagttctcatgactatctaaattatatttcaaatgttaaaattaagtcttgtattgttattaaacatttttaaggcagttaaatttttaattgtgttgaattcagcagaatcttttaggttattataataattataagatgaattttcttgactaccaagccaaaagaattatttcaaatagtttaaatacaattttctgtagaaagagaagtaaggaagatgatttttttccacatgagtatcattattaagtagacgacagcaaatacaaccaagaaaatccatctttgaagtgtgctaaagggtggctcgtttagatatggcaattaatcactgcattatttatagtactttaggaacagctcatactacattaatcagggataacttctgcttaattaacaagactgccaaaaaatgtcaaacacaagcacaaaaacacaatggaataaaaacaagaaaacaagtgttagctagcgactgatcaccacaaagtgaaattttaacttgcatcacaatattttacttgcttgaacttttatactttagctggatatttcatgaaacgatgatttcttctcaaggttgaaaagggtgctgtttaggacacatagtagcaaaataaggtaatccatattatatagtgttttacttctgaccacctcttctgtagtatgtttgtgtagcttattctgtctaggcaactgcctactttcccacatggattgggcaggcattactgaagtgccaaaatagactgtagttagattgcctagtttaaattctggcaccattatgtcccagctgtgtgatttaagataaagtaatcaacttctctgtaccttcatttaataatttatgaaagagatgaaaaatgccaactaacttacaaggtggttatgcaaattaatatatttaaagcattgaccaatctgtaactactcaatatgtattaggtgttattattatttgtattttttaatcaggaaaattatcctctatcttctttagctttctatagctctctcttccttagcctctgaaagataacctaatcccacctactttctttctctttaacatctcacttggacacctgagcaactgctgtatgcatagtacaatgcaatgaatactttatgattcaaacacacagttcaggctttctatggtaacttgtacttcatacatctctggcatgtagttttctcagatatttgatcagtttcatatgtccaaagttatgtcacatttaatgaaactataactaataataagaccttgggtcattctctgaccaccaatactgaaatacctagaataacacaaattcctaggacttcttggtccacggaatatatggtaacatgatatacaaagaactttcatgtgatgagctaaagcaggaaaatggtattcagggtagaaaaggtatatgctttgcttaaggatgtgataaataatgtaacacagttgggaataaccaataattgtagatgtctacctgatctagtctgtccattttaaatgacagcagcaatcagtattaatgctaaaacaaggaattacaaacatagtgcaaccttcagatacacagaaatgatagcttcatctaaatccagaagatactgcttaagtgaggttctgtagatactcaagtatatgaagagcaacagtatgaaatgcttcccctttggaaatacaatcacaaagaacaagagcaaatatctttcctttgatttgttgaaaaactgtttattatatattatgtgaaattatcacatacatttttttcaccttttctttccactgatacaagcatttgttcatggacctgaagggaccttctctctcttttattactatataaaccctagaaatgcaaaaagcataaggtcacctcctagaagaaaccttcctagattatctgacatgaaaatcatatttagtaggtgagccatccaagggctcatgttttaaaatggaggagggtgagcatacctatgtgtgttagtgtcaggacacaggtttttgaccaatggtatcaaaatcactgggttaatgtcatttcccttcaatctcacctactaggaactcagatcacattgaattattaaatagtggacttgaattcaggcttttatgtgtttgttctatttttggcttaatgtcttactaacttcctatactctgatccggctcaaaatatcagaaggatgctccaaataatacatacattttcattcttgtattagttaatcttgtattctttcatattgggtttggctttagtgggttccaattatgggaccttatcagtatttagacgacattcttgatctattatgttccctaaaacgtatgacaaatatattttgatgaatgaatgaatgaataaatgaaggggttgggataaacagccccatgaaaatgaaaaagatagcatacaaacataggtttgttgagttatggactaaattgcaacccacattattgataaaaaactgttttcttgttgttaaatgctgtattttcagtccatctcagatgttatatagaaaaatatactaggaaaagctagtacaatgaatggtccctagaccttctattttgccttattataattgtagatggaaaattcaatttttaagaaaatgtaaataaagagatcatgataaggagatgactttttaaaaggtagcaactagaacattttatcaaaatagcaacaaaatgttaacaaatagagcgaatagaccaagttatcttggtttcagttggttaagtttaattaaatgaatataataagcccaacacagtacaaagttttattgtaaataagttttatagattttcttatcttaatgaatgcaaagtttttgttgtgttttctactctaattgaaaaatagaaaatattcgaaagacttaccaaaaatcaagctattgctagggaaacaatctactctgtgcttctttggagattagaattattttgttttcaatatttgattaatgctaataaaaataatagttttgggccaggcacggtggctcatgcctgtaatcccagcactttgggaggctgaggcgggcggatcatgaggtcaggagatcaagaccatcctggctaacacggtgaaatcccgtctctactaaaaatacaaaaaattagccgggcgtggtgaggggtgcctgtagtcctagttactcaggaggctgaggcaggagaatggcatgaacccgggaggcggagcttgcagtgagctgagatcacgccactgcactccagcctgggcaacagaacgagactcctcacaaagtaataataataataataataatagttttgaaaaacattttgtttggcatttatttttcaagtttctaaagaatttactggaggcattgtaagaaattcatctttaattcttattcttttgttttcttttttctctcttaacttctgatatttccttcggtaatcctgttacagtttctaaattttcagtaaggaaaacaaaagagaatagaactataacaggtttattttttccttgtggacaattggtatattcccgtatattctttccctgtgatattaagaagagatagcatttatcataattttctttttattgaacattttgctttgagtattaagttataactattatgttttttgctaataagaacatgtaagtaaactaacttacattttatttaccatattttagaaattaaacacatggatgtcagagacattttgtgaagctaagacctacatttcctatcttttaatgtttattttattatgccacttccatgatagttaaactagtattttttatttttatgcatgcacagtaggtgtgtacatttttttgaaaacattatgaatttatttatatacatgttccacaaacattttttttaaattatactttaagttctgggatacatgtgcagaacgtgcaggtttgttacttaggtatacatgtgccatggtggtttgctgtacccatcaacccgtcatatacattagctatttcttctaatgctatccctcccttacctccaccccccgacaggccccagtgtgtgatattcctcttcctgtgtccatgttctcattgttcaactcccacttatgaatgagaacatgctgtgtttggttttctgttcttgtgttaatctgctgagaatgaaggtgtatacattgatggggtgcatgagatatttcgatgcaagcctacaatgcataataagcacatcagggtaaatgcagtgtccattatttcattcaaatatccaatatcccagcctcttgtaaatattctattttctgtcttcataagttcaattgttttaagttttagatctcacatgagtgagaacatgtgaactttgtctttctgcgcctggcttatttcacttaatgtaatgtcctttcattccatccatgtcattgcaaatgacaagaacttaattctcttttatgcccgaatagtaccccattctgtatgtgtactgcattttctttgtcctttcatctgttgatgaagagcttaggttgcttccaaatcttggctattgtgaatagtgttacaataaatataagagtgcagatatctctttgatatactaatttcctttcttttggaaaggaatccagcagtgagattgctagatcatatggtagtctatttttagttttatgaggaacctctaaattgctctctatagtggctgtactaatgtaatttagtccccagcagaagtgtacaagcattctgtgttctccacaccctcgccagcattcattattgcctgtcttttggatataagccattttaattggagggagatgatagatcattgtagtgttgatttgcatttccttgatgatcaatgatatggagcaccttttcatgtacctgtttgttgtttgtatatcttcttttgagaaatgtctattcagatcttttgcctagttttttaaatcagattattagattttttcctatagagttgtctgaactccttatatatctggttattaatctcttgtcagattgatagtttgcaaatattttctcccattgtgtgagttgtctcttcacttttttgattgtatccttttctgtgcagatgctttttaacttgatgtgatcaaatttgttcattcttgctttggttgtctgtgcttgtggggtattactcaataaatttttgcacagaccaatgtcgtggaaagtttcccccatgttttcttgtggtaatttcagaggttgaggtcttagatttaatccttcaatccattttggttttatttttgtatgtggtgagagataggggtagtttcatttttctgcatatgaatatctagttttcccagcaccatttattgaagagaatttcttttctccaaagtatatttttggcatctttgttgaaaatgagttcactgtagatgtatggatttgttttggttcttggttctctattctgttctattggtccatgtgtctgtttttatgccagtaccatgctgttccagttacaatagctctgtagtattatttaaagtcaggtgatgtgatttttaaagtttttctctttttgcttaggatagctttagctatcctgtgtcttgtgattctctatacatttcaggattattttttctatttctctgatgaatgtcattggtatattgatagggattgcattgaatatatggattagtttgggtagtatggacttttaaacaatattgatacttctaatccatgaacattgaatatctccgttttttgtgtcttcttcagttacttgcatcaatgttttacagttttccttgtacagatctttcacttctttggttaagtttattctctgttattttattttatttgtagctgttgtaaatgggattactttcttgattcctttttcagattgtttgctgttggtatatacatatgctgctgaattttgtatgttgacttttttgtcttgcaactttactgaatttgtttatcagttctaatagttttcttgtggactcattaggtttttccaaatatgagatcatataagctgaaaacgaggataatttaactaattccttagaatttggatgaccctttatatatttctcttgtctgattgctctagctagcacttccagtacaatgttgaatacaagtggtgaaagtgggcatccttgtcatattccagatcttaaaggaagggctttagatttttctcattcaatttgatactagctgtggatttgtcatatatggcttgtattgtattgcagtatattttatctatccccagttttttgatggtttttgtcatgaagggatgttgaattttatcaaacactttttaggcatctattgaaatgatcatattgattttgcccttcattctgtttatatgatgtatcacatcgatttgcaaatgttgaatcatccttgcatctctgggataaacccatttggtcatgataaatgattttttaatatattgttgaatttactagtattttattgaggatttttgcatcagtgttcaacagggatattggcctgtagttttatttatttattgtttgacgtgtctttttttttttttttaataacagtgtaatatccttcaaacatgaataagaaagactttccagaaaaaaagactttccgtctctatgttatcttgaatttcatttagcttcctcaaaacagccagtttgaattctctgtctcccccagattggtttctgatgccttatttagttcatttggtgaagtcatgttttactcttgatgctcgtggatgttcactgatttctgggcattgaagagttaggtatttattgtagtgttcacagtttatgcttgtttgtacccattcttctggaaaaggctttccaaatagtcaaatagaattgcatgttataatctaagtctttggtcatcactgtaattgtgtctgcattgggggaaccccaagcccagtaatgctgtgactcttgcacacttgtagagataccactttggtggtcttgaatgaaatccaggtgaactgcctggtttaccaggcggggaatcttgttcttttcccttactttcccctcaacaagcagagtctctcttttcatgctgatttgcctggagctaggggaggagtgacacaagcatctttgtggccaccaccactaggactgctctgggtcatacctaaagccaacacagtattgggtctctcctaaggcccatggcgaccactgcctggctactactgatggtcatttaaggcccaagggttctttagttagcaggtggtgaatccatgcaggctggtgtcctttccttcagggtagggagttccagctggcccagggtgggtccagaaatgccgtttggggaccaaggcctgagtcacaaaccttaggaatctacttggtgctttattctgctgcttctgaactgacagccaacctgaaagacaatggctttcccactctttcctctcctttcttcaagcaggaggagtctttcctcatggccaccactactccaggcctgtggggtactacttggctactgctgatgttcactcaaggcccagtgctcttcagtcagcttgtagtaaacactgtcaggcctgagtctctctcttcactgaagtgggctcccctgtggcacagtgcaagtccagaaatgccattcagtagctaaggcctggaatcaggaaccccatgagcctgcttagtactctacacaactgtggctgagctgctactcaagcttcaatataaagtcccctttactcttccctcttctttcctcaaacagaaggagcctttccccatagccaccgcagctgggaatgtgctgggtcacacctgaagccagcagggtactaggtctcccccaaggcctgcaatgagtattgccttcatctgctgatgtttactcaaagcccaagggctctttattcagctggtgatgaatccttccaaaaacggtccttcccttaggagtagcagctttcctttttgttcagggtgtgtctagaagtatcatccaggcgctgggacctgggatgggggcctctggactctgcctggtgtcctattcaaatgtggctgagctggtatccaagttccaagacgaaatcctgtttactctcccctatcctctcttcaagtagaaggaaggagactctcccagagctgcaagctgtactgcatggggttgggggagggtgacacaaggactccctcagtcacccaaggcagtgcctcactatgtcatgtacacctcaagtccactggctctgggcccagcacagcactaagctgtgctcaggaattgcagtccttgcggcctagaccgcctttcaagtttatgtaggttgccagagtgctttagcctgcaatggcggtgcttgccagaacttaggttccgactgctgggatggatgattcccctctggctaggtctcatctaagtgcttcctctgtgggtgccagctgaattttgccctgtgttgctttctgctggaacagacacactgagttccaatgccaagtcccacaatcattgcaagcacacagattctctccccacctgctgctggggagttggggaggggtggcattagcaattcaagactgtctttccacccccttcagtgcctctgtcctcaatataatgttacaaccaggtactgtgattgatcacctgatttttgtatcttatggaggtgctttcttatgtagataggtgttcctgtggggaggatgaatactgaagggttctattcagccatcttgctctacctacctttcctaaaatcatattttaatttatcaaatcagtaattagtttgtcaccttccttaaaagataacatacacatatttaatgaaaattaaaagagagcaagcaagaacagaaataagaataaataaaaaagaagaacctagaatgaggccaataatgcatatcatatactttacacagtgggatcatggatttaactttcagttttctataaacccacgtcaaaattgttacacaattcacgatgtccgtaaatttaaaacaaccagttattctttgagataatacgttgttctcagttttcttcagtagtaatatcagagtagaaattttccaagtggagcggctattccagacactgtgtgacataatacaattattctcagcaacatcctttcaggcgattccacagtggttttcatggactgttttttttgcgtgtagtctctgatggccacacagcaaaagatggtccagccaaagcaattttataagtttgtagagtgtaacagaggcatttcctcactgactggatcaaggagtatgtgtatatttgggatttgaagtagcttttttatttctgaaacaatgttctcttaaatggcgttaaacataacctaacaatgcattcggaattctgctgttttccttgcgcctatggtaaattctaatgtcagttaaagtcagaccacaggacttaaaagataatccaaatgagattataggtgtcatatatttaggtcaaaaatagagagcctagaaaggacaacagcttaatttgaagctatcctgacctcctttggaggtcaattaaatagaatagagatagggtaattttatattatttaattttcacatatatcagttttggtggtttaaataacttctaatatatttgaaaaatgaatagcaaattaaataaagcattttctaataatacaaatttttccaaaagggaaattaatataatatatagatagatagatataatttgataggtctctctgaagtcaactgtatttcctactggatatgtgagaaaatgctcatatgaaaatttagcaccccttaatccctataatgctgtagaaaattcgaatatttaaaaatagaagattacttgctgtcgttgatcacatgggaatggaattcaacaattcaaatgttagtattcttacttttatactatgaaggctaaatagagtaggaaaatgcatatttatatccaagattattatgtctttatgatagcagtatatcttctatgtttcatttacacaggattatgtacctcttcatttttaatatttactgagccctatgtaagtgggcaccccatctgcagttttcctagaggtttctttctgttcctgggccaccaaaccggatttgtgttttcattatcagggttgataagatccttgggacatttcacaaatttccttatagggtatgtaaattatttcaacctgagtgtagctttgtgatcgaaggagtttatgacagaaaatagtaaaatgtaactattcaaaacagaaagggtcaaacttaactggaagcagtatccatggagatgatgggggagatgtgaagaagatagatgtgccttttacagtggaagaatgtgctacaagtgtcatgagtattcatctgtctagaacagagtagataatagttcccttcttcatttatgtcataccctacttgagtctgtctggaatgagaccctgtctggaatacaataaaccagagtgagactatgtgaatcacaacatacgatgactgattgaaggtgctagcatgttgagcctagagaagaaaagcttttcactattttctacaagaactttccgagctttcatataaaatgtactttaggttttccatgccattgcagagaagagtactagggtccatggatgaaagtgtagtgaggaagactaactcattgtgaggaagaactctctgtgattgattctggaattgtctgcctcaagaagtggtttgttctccatcactggaagtatctagacataggatatatttgtcaggaatattgcatagagagattttatcagagtagcttgacagactacgttctttttatccttgcatttcctttggaccttatgatagattttgttgttgtatctgagattgtttggtatagttttagagactggaattggtgtgccatgtgagaagataatagcaggcatatgagacttcacaaggaagttttgttgactaatgggaattaaggattatattccatgtcttcatagtgaaaggaatattactaatggtggatcctacatgctatgaaagtgtaccgcaaaattattctattaaattctcagtttcctttaaattaataattcttggaggataaataatggcaatgtgtacaggtaaccatcattatttaaaacaccttttgtgtgtgggcaacaaacatttaactaggtaaatatgaaaacactaaatgttgaccttaccaaaaattcagagaatcctatatcaatgaattaaaaatttctcaaaatactaaagatgtggcaataaaaaaagtcttgacattttcccattttcaatattaaattataatcaatttgttattatagggctaaagatttcagtacacatttctgggcatctgattttattttatttatgaaatgctactactatttaaattttctcagcttttttttggtttgtttacatttttgaatttgtttaactgacataagtatcattttgtttttctaactgtgaagtgtacagatagtcttgaacaagtgctatctactagaagattattaagaataatacattgcatcataatggttatggaatctctcttaggttgcttgtgtgtgtgaatgtatatatgtagctataaatgtgtgttaaatatgtattagacatattagacttatttctacatacatttaatattgaagacaaaggaaaacaatctcctaaatgcctgatactttcataatttattaaggaatgatttatttatgatataagaataatgtctgttgggccaataagtggcatatttatttaaaattatgtgtataatgtttatcatatgaaataataggtaatgaatgctttatgtactaaatacaatagtataaaatatattagcaagtttgatttagctgtagatttggctataacaatttttaaacaactcaaacaaatgtataaattcttaaaatgtgagtaaattttgaaggacagattctagttaatttataagttatgtgtctataattgactaagatgttcgtatttgaatcatgtgggtcttataccaattaaagagaaattttactttaaattgtaagattctttaaattcaaaataaatattcggtgcactgaacttgggctatgactagcatttcaccgacgaatgattggaaaaaaaatgattcatttatatttctctaggaatgcttatttttagtttttgttttgagacagattctcgccctgtagcccagcctggagtgcagtggcacaattttggctcattgcaacctcccccacccaggttcaagcgattctcatgtcttggcctcccatgaagctgggattacaggcatgcctcaaatagcccagctaatttttgtagacagggttttgccttgttccccaggctggtctcaaactcctggcctcaagtgatctgcctgccttggccttccaaagtgctgggattacaggcgtgagctactgggcccagctgactgcttaaaggactattattaaatgtttgagtggttctggaatcaacgtctttaatatgctgatatttgattattcatatgtccttttctgtttaacctcaaaggtttcactaacaaaatcaatatacagaaggtattactcagacatgaaaacacatttaatacttccttctttctatattacatctacatggcaacttgtggatattgaggctccaataaattggattgcttcggctcaaggtaaaccaccactttaagaattaatacctaaagaaaacaaaattgcttagatgttttgttgcttattaaaatgatttatatctcagtattagtttcagatccatacagtctttctttgaactctttttactagcatttttttcttgagccaagattacatgcattttttaaagttcatttttctgattttattcattggactttagctgggcttagtgtgccacaataaataatctccaagagtatttaaggctgttaagtatttcctaagactatttatgactttccatcgttggtattgtagttattttatacgtacatatgccagaaataacataaaaatgtatgccaataaatttcatgaatatctcacctttttttttcctcttaatatcaggatacaatttatctgctggtttgtgcttctaaacactaaaccaactatgtcacacaaagcttactttaaaaaaagaaagcagagggacagtatgatgtatttgtcattaaaagaaaaataggctgccaggaatctcggagcacatatactcagatgcaatgattgattatcatcttatcgcatatttttttttgtgctcccataatccctgtcctttatcttaatatctaacaccaattttcttgtcattttctttgtttttatttaatagtgtatatgtgatgaggcatctaaagtcaatattggcattatactgtaaggattctattaatttttataaaataatattcatttggcagtttaccttctgtgtgtgtgtgtgtgtgtgtgtgtgtgtgtttctatactagtattttagccatgggcacatgttcgtgctgtttttcccaactcttcgttggctaccatggaatctatttaactagtgtcttcttttaactgaagaatcccagtcgttctaggagaaagttgtatttttgaattctcttctttgatctgatataaccctcaagaagaaaatctgtagatacatgaatgcttattcttttaccaatgtcccctgtgcatctattcatgtaatatcccatgaaacaatatcaacatttggttttctagattattgccagcactgtgagatagttacagtatatcctgccttctctccaacactggtgtcttgcatttcatgcgcgtccctgtgaagagaccaccaaacaggatttgtgtgagcaacatggctgtttatttcacctgggggcaggtgggctgagtccgaaaagagagtcagcgaagggagataagggtggggccgttttacaggatttgggtaggtaaaggaaaattacagtcaaagggggcttgttctctggcgggcaggagtgggggttgcaagttgctcagtgggggtgctttttgagccaggatgagccaggaaaaggactttcacaaggtaatgtcatcacttaaggcaaggaccggccatttacacttcttttgtggtggaatatcatcagttaaggtggggcagggcatattcacttcttttgtgattcttcagttacttcaggccatctgggcgtatatgtgcaagtcacaggggttgcaatggcttggcttgggctcagaggcctgacattcccgccttcttatattaataagaaaaataaaacaaaataatgttaaagtgttggggtggtgaaaatttttagggggtggtatggagagagaatgggcgatgtttctcagggctgcttcaagcgggattaggggcggcgtgggaacctagagtgggagagattaagctgaagggaggtcttgtggtaaggggtgatattgtggggatgtaagaagaaacatttgtcgtatagaatgattggtgatggcctggatacggttttgtgcgaattgaaaaactaaatggaataacagaaggagaaaaacaggcataaaaggtttaagaattgggatgactcaggacatctgatgagagagtgcctaaggagattcagcatagtcctgccagcaaagattatttatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagttttttgggggcacagtctaagttggtctggtgtcaaatgagactggggcctaataaaaaggagcatctgtacaggagcttaaatgggctgtaccctgtagcattccgaggacaggcctgaattctgagaaacgaaagtggtaaaagtattgtccagtcctttttaagttggtggctgagcttggtgaggtgtgtttttaaaagacctttagtccgttctacttttcttgaagacggaggaccttaagggatataaaggtttcactgaatactaagagcctgaaaaactgcttggctgatttgactaataaaggctggtctattatcagactgtattgaggtgggaaggctaaactgaggaattatgtctgacagaagggaagaaatgactgcggtggccttctcagaccctgtaggaaaggcctctacctatccagtgaaagtgtctacctagactaagaggtatttcagttatctgactcagggcatgttgagtaaagctaatttgccagtcctgggtggggcaaatcctcgagcttgatgtgtagggaagggagggggcctgaataatccctgaggagtagtagaatagcagatggaacactgagaagttatttccttgaggatagatttccacgatggaaaggaaatggaggttctgagaggcgggctagtggcttgtactatagcataacctgcctttgctggtgtgtggtgattaggcctggtggaaccgccatcaataaatcaagcgtgatcagggtgaggaacaggaaagaaggaaatttggggaaatggggtgaatgtcaggtggatcagagagatacagttatgggggtcaagtgtggtatcaggaataatgtgggaggctgaagtctgggccaggaacaacggtaattgtgggagactcaataaagagtgagtatagctgaaggagccgggaagcagaaagtatatgaatcaggtatgaggaagaaaatagattttggaagttatgagaactgtagagagtgagttgagcatagtttgtgattttgagggcctctaaaagtattaaagcagcggcagccgctgcatgcagacatgagggctaggctaaaacagtaaggtcaagttgtttggacagaaaggctacagggtgcggtcctggctcttgtgtaagaattctgaccgcactaaccatgcctaggaaggaaaggagttgttgttttatagaaggtgtttgggtttgagagatcggtcggacaagattggcagggagagcacgtgtgtttttatgagaattatgccgagataggtaacagatgaggaagaaatttgggcttgattgaagtaatgggggctgtctgtgaagctttgcagcagtacagcctaggtaatttgtggagcttgatgggtgtcagggtcagtccaagtgaaagcgaagagaggctgggattaaggggcaaaggaatagtaaagaaagcatgtttgagatatagaacagaataatggatagtagaggcaggtattgaggataggagagtatatgggtttggcaccacggggtggataggcaaaacaattttgttgataaggcgcagatcctgagctaacttgtaaggctcgtctggttttaggacaggtaaaatgggggaattgtaaggagagtttataggctttgaaaggccatgctgtagcaggcgagtgataacaggctttaatctttttaaagcgtgctgagggatgggatattggcattgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggaggcaatgagatacagctgtagtccaggaatagtcagggaagcagataatttagttaaagtgtctcagcctaataagggaactgggcaggtggggataactaaaaaggagtgcttaaaagagtattgtctaagttggcaccagagttggggagttgtaagaggtttagaagcctggccgtcaatacccacaacagttatggaggcaagggaaacaggcccttgaaaagaaggtaatgtggagtgggtgcctccatattgattaagaaggggacgggcttaccttccactgtgagagttacctgaagcttggcgtccgtgatggtctagggggcttccgaggcgatcgggcggtgttagttttcagccgctaagccgagaagatctgggaaggagtcagacagccttgcgccagagttccaggggctctgagagtggctcccaggtgagttgaacagtccgattttcagtggggtcctacacagatgggacacggcttaggaggaattccgggctgcgggcattccttggcccggtggccagatttccggcaagtgtagcaagctccttggggaggaggttctggaggaacgcctggccgctgcggttcaggcgtttggaagttcttgtgtgctggagatgtggctggggtttgtctcacagtggaggcaaggaattgcaacttttttctattattgtacaccttgaaggcgaggttaattaaatcctgttgtggggtttgagggccggaatttaattgttggagttttatttaatgttgggagcagattgggtaataaaatgtatattgagaataagatggccttttgaccttttagggtctagggctgtaaagtgtctcggttgctggcaaacaagtcatgaactgggctggatttttatatttgatgaaaaagagcctaaacgctatctgatttgggataaagaaaaaggagcattaaccttgactatgcctttagctccagccacctttttaagagtaaattgttgggcaggagggggagggctagtcatggaaggaaactgtaagccggaccaggtgtgaggaggggaggtgataaaaagattatagggtggaggagcggaggctgaggaagaattgggacctagctcggcctggcgaggagcagcctggggaggaagggagaggtcagatgggtctgtagaaaaggaagattagaaagactcagcgaggcttggggttggtactgaggggacaggcaggagggaaagaaggaagatttgggacgagttgcactgggcacagagactaggaagggactgatgtgtaaaagaatgcctggacgtcaggcacctcagaccgtttgcctattttatgacaagaattatttagatcttgcaggatggaaaaattcaaagtgccattttctggctatttggaactactgtggagtttgtattggggtcaagtggcattgcagaagaaaataaggcatttaggttttaggtcaggtgtgagttgaattggttttaagtttttgagaacacaggccaagggagtagaaggaggaatggagggtggaaggttgcccatagtgaaggaaggaagcctagagaaaagagagagtagagaaacggagggaaggggtttgggggttcttaccttccagaaaagtgggaaaaggggttggggcacagagataagaggtcgggacgtggaaataagtgattggggcacagagatacgaggttggggtacttgcctctcctctagaaaagcgggacttgccgctaagagtgaaggagaaggggttggagtacttgccctgtgcccggaaaagctgagaaggggtagagacaaggagagaaggggttggggtacttgccccttccccagaaaagcaggacttgccgctaagggtgaaggaccaaggcaggcgtccctgcgtggtatgacacctttgaaacgtgggttgaataatcagagaggcgtccctgcaatgattaaacaccaagggaaggctgcctttccagtctgtgaccggcaccagagttttgggtccacagataaaatgtatctcctttgtctctcccagaaaatggaaggaattgaaattaagagatgggagagattgaagagtggaaaggagaaagtggttgagggacagtgagagagattggagaagagagtcagaagaggccgcttaactgatttaaaattggtgagatgttccttgggctggtcagtctgaggacctgaggtcataggtggatctttctcacggagcaaagaacaggaggacaggggattgatctcccaagggaggtcccccgatccgagtcatggcaccaaaattcatgcgcgtctgtgtgaagagaccaccaaacaggctttgtgtgagcgacacatctgcttatttcacctgggtgcaggcaggctgagtccgtaaagagagtcagtgaagggagataagggtggggccgttttataggatttgggtaggtaaacgaaaattacagtcaaagggggtttgttctctggcgggcaggagtgggggtcacaaggtgctcagtgggggtgcttttggcgccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttactttaggccatctgggagtataggtgcaagtcacaggggttgcaatggcttggcttgggctcagaggcctgacatttcgtactatggatataatgtaaaaagggggcgtttgtcttctctttttaaatatccgtacagaagtctctgctgcaacataataaatgacaaatgccagaatatatcctaaaaatttagcacatgtggacagtgggtttacttagatgtttatttttgcccttacatatttttggaggattgatacatttttggtatcacttttggtatttaaacaaataggtaaatattttctcaaaaagtgaagacttttttttcagacaaatctatgagaaattattggcttaacaaatcacaagttttgtcacgtatgccatatttgtttgtttgtttgtgaaaggattttgggtattaggcaactgtagcagacatcatgtatctggactttagcgagtcatgatcactcatcatctagtaaaaatatttaatatttatataaggcttattatgtgctagatactcttcaaattatttcacatctcttaactcatttgatcttgttaacagtgctacaaagtagatgatttgatttttgcccttgtattgatgagtaaaattagtctagcaagtagcagatgggtaatttgagtcccagactctcttgccctagaattagttttataatcacaatgtcgtgctgctaaacaattgagatgcatcattcctgacaatctttgccttcacccttcaagtaccatatcagcatataaaagtgaaggatgatgccttccagtgaaggttcaaggcttttgcctgaagtttatattatttgtttgaaatctttttcagccatggagatattgaaggagattttattaaactttcatgttgtatacagctgaaagagtgttttaaaaagtgatatgtaaaatgacagttttggtattcaaaaggagcaatggtggaaatccaacaataaatatggcagggataaatgtaaggtgctacccttgaatccaataacccatgaaacaagtagagcataggagagagctgatttaggaacaagccatgggaagaggtctaagggattatgatacagactagccccatcgtggtgtggttccccaaataacaaattctatcttaggtaggctgcatttctatgttgtaatttatttattgaataatcttaccttggttagtgcgtaattctaaactttttccaattaacatttttagctctgctattgttaatcatttcccatgctttaatgtcactgtgaacacatttttaattttttctaatgttttgttactaaaatcagtataaaactcttatctcatattttttgtttgtttgttttgagacagagtctccctctgtagcccaggctggagtgcagtggcactgatttcggctcactgcaacctctgcttcccgggttcaagcgattctcatgcctcaagctctggagtagctgggactacagggttacgtcaccatgccctgtctaatttttgtatttttagtagagacggggtttcactatgttggccaggatgatctcgaactcctgacctcaagtgatcaggccacctcaacttcccaaagtgctgggattacaggcctgagcctccacacctggctttatcccatatttgatttaaattgtatgttcttacctcttcttggtacccaaattgagaccctaacaaattggagtggcaaagaactaccacaaggtctgactctgagataaatgtctcttctttctctttgatatatagttgctccagtatgttaggtcagagaagagagagcagaaagtgttaagtgtatctttattcaacatttactaatactatcatttatttgctttctctgctttgcagacttctgtgtggctctcctatgaggctcattcatggattctttagaggacctattgtaaagttctctgatatgggagattcaatctgaatccaagctagctagcctccattagagtgaaccccaagctgtacacactgttggaacttgtttttgaggtctccttagttactatccagtggctctagctccactacattttgtatatttacttgactcatggagaacttacatagagttacttctaagtctacagcctgttctattgcaacaccttgcatagattggtggaccacttgggtgaaatgcagagaatatcatgcaaagaatatctgctctgcatgaatgattaacagcagaagttctcaagttttacctgataaccttcgaagtaacaccaattccttgatttgctcctgcaccatccctttttggattctgtccaacagatctgctataaagcctgatgattttgtttgtttaaagcacttcagctagtcagcaagggttcagaaacactaaattagattaccttactcagaatcctatgattctatgtatttttatcctctttaaaagtacttttataactgtgatattactttaatattttaaaacaaccataaataagattgcagatagtaatgcattgggtttgcaaaaataactttagataaaatatattccagtttgtatttatgtgataatacattacctcaagacctcaaaaatagatttgctttgtttatatggtttccttctataagtgaaaaaaactagtccaatgaaataaagggttaagaccccttagaggaaaaggaagataaaattatcttcagaaatggctatggtaacacctcccaaggcaaactattggcagaccttctaagggcagattgtgtgcatctatgtaagtgaaaaacagctgaagggtgtcaagtgctctgagtcacactagagtccctttagatttatttcccaaaccaagtagtagttgccttttccaccagcccacacagttctattattttcctatctttgctttatgaatagctggctcttacagtacttaacttcttatcttagtccacttgggctgctagaacaaaatatcataaactcgatagcttataaacaacagaaatttatttttcacagttttggatgctgagaagtccaaaatcacagtgcttgcagattccaaatctggtgagggcttgtcctttggttcacagacagtaccttctagctgtgtctgctcatgttggaagaagcaagctaacattctgagttctcttttataaaaggactaattccagtgatgagggctctgcccttgtgacctaataaccttccaaaggccccacctcctaataccatcaccttatgggttagaatttcaaagcagaaatttggggtggaggaggatcaaaaattcaaatattctgaacccttgctgactagctgaagtgctttaaacaaataaacaaaaacaaacatatcacttatgttgaaaactagtcaaataataaggcatttctaacataagacctcatgatcaagtaaacttacatgaaatgaccagtgcaaagacatgcttgggtaaagcttttctgtagagtagtagtattgatttttattttatgtatgtatgtatgtatgtatgtatgtatgtatgtatgtatgtatgtattttgagacagtctcactctgtcacccaggctgcctaggctggagtgcagtggtaccatctcggctcactgcaacctctacctctcgggttcaagtgattctcctgtctcagcctcctgaatagccgggactataggtacatgccaccatgcccatctaacttttagtagagatggggtttcactatcttggccaggctggtcttgaactcctaacctcaagtgatcctcctacttcggcctcccaaagtgctggaattacaggcatgagccaccatacccagcccgagtagtattgatttttaaagtaaattttttcatcacatccctaccaaattatatacaaattaagtaactagcccagttaggaaaatagtacacaagtactaaatccatattaagatcaacatctaaaaaaataaacatttacataaatggaagagacattttttactacatttatttgattttaataatttaattttatggaatttatgaaaattttatttttaggaattcatgaaaaattccaaaaatttcaattattaaaatcaaataaatgaggtaaaaattatgtaagatatatttgggtaaaaagcataaacacatttaaatattttattaaaacattttaattaacaggaacatgttttaaaggaactaatacataaaaatcaatttcaatctcattattcctcacaatcacttccagtattctggagcctcaggttttcatccttgatatttatttataaagattattatagtcatattgctcatgtaatagataatccctctccacaactaatattttattatgatattttctacattattacctatttctcataaatataactagaaattatcgtgcaatattttattgggtaacatgatttagttagctatttctcccataattatacattatatatggcttactcttgggttttgctcctacatataggactgctttagatctccatgtcactaaggttttaccatatttggattatttccttaggataatttttcagaagtgggattattaaagagactcaacatttttaagtttttgttttgtaatgcaaagttgatttccataacttacagtgctgccagcaagatagggaaacatccagtacacagccttactttttccttgaatttggagctcatcttttatagtttgtataaaatatgatagttgaaaataatatttcatggtcagatccatgtgaaatacaaattattgtattagtggagatgagttgaaaatttttttccatgtgtgggaaatacatttgcctttctcctctaaaatatgtctttttggaaaataggaacttcagtattttgtgatcatttgtatacactcttcatataataataactctgtcataactgcaaaaatattcatatttattcttaattttactaattatactcaagtttttacttgtaatataatcaaatatgtctatcttttcttactgatatatatatatatatatatatatatatatatataacacttaagccaaattcatttatatttcagaacagtcaggaatctctagaagcttcattaactctttcctaccattatatttaatttttaagtcatggctttagagcaccagaggttagtatgagtaatttagtcagtgagaaaagttggctccttctggaaaagcacctttatcaaagcaattccatcaaagctggctttgaatttcagagaaagcaattagattaaaagaaaattaggatcttggctcacagtaagagcatgtaaaacataattcatcttgattcagcgttttaatattctatcatgggtatcaaatatgtcagatatgaaaagtaatttcagctttgttttcaactttgctaagtttggtcactgttccttagaagcaaaagtttagctctgatcatgttggaaaataaagtagttttagtcattaaaaacaaaaattttatcaataatagtgtgatattataataatgtcatattttcatcttctggtgtacctatcttgtgcctgatgtataataggtgcagaatttataatagtagaatgaatagatgaatttcctgaagtagaatgcagtgaggcattaagcatgtcctcataatgcctttaggattgccaaaagtcttgcttaggggttgaaaaagaagtagaaatcaaatgataagacctcgaaggaacagagaaatccaactcaatgaacagtaaaaatcaatgaaggcaaaaaaggtccatttttatctcattcatcttcagagatagaccagtgtaagttcattgatttacagtgctcattgagttgtattctcctgttctttgttgtgctccattctctgttttttcagcttcactttgtgttttattttaaattgtatttgttatgaggtgggctttgatggcatagttttagcacaatgagactattttttttcacttgatttttctactcatatgatatcatcacttttcaatattcttaatggtacttttctgaataacctcctttaaatctctctctttctttatgttgatctgtgtcaatcaagtttttatgtgtaaaagtgtgttaataaatttaaatttaaaaataaattttaatttaatttaatttttaaatatttattttaataaatttaaataaatttaatttttaaataagtttaaataaatattcaaataaaataaaaataaaataatatttaaataaatttaaattaaaataaatttaatttaaatttattatagtgaccatacaaaacaaatagttgtttctattcagttcactcataaagaaatgttatttaacaaatatattcagcacctttcaatgcaatgcacttttgcagttgtcaagcaccataattcacttaggttctgccccaggcctttaattataagttcttatttatgggaattagagagtagaacttgaactgaagagactagcctgaccgtggagctgacaaagaaagaatgtacattggttctgagtacagtgcccacagataattggagaatacgtgtttgaatcagactgatgaattctgggtggaacatgaaagccggtaattctaaatattagtgatattaattaaatcatcataatttgtctagaatcacgctcaatttagaaaggattcatctaagggaatgaagacagaatagctgaagccaatattttgaaagataaaacagagtaagaaaaattatttgaccactaggcatttacatttttttatagtatataaatcacttacaacatgcagatacacgcatacaatagaatttcaatgaggtacaatcacttcccacattttaatgaatgtgctcagggtagaagtaataaattattttaatatatagaatttgataaactcataatagaagtagaagcaaatcctttgagtgctacaaagaaaggaaacccatttcaccaatgatatgcatgagtgcttcattgtggagttcatctttggtttcaggcttaaattatgacacattgacaatttggaacattcagattaagaaaacattgagcaataattcaggaaaattaggcagaagggtatgttcacaaaataatcctgtattgtccaaatatcaaaagagcctaagtattcatctcaaattgagcctagaaaattagactttgggagggtcacaagataagatgtttgtaatatagccagataagcactaaaacaaatccaggattaggctgtcttgtgatttggctttctccactgtaaaccatgtttttctatgaatgtgagactctgctggcattgttgaatcactacatagtcatccattcattcatcatttaatttattatccattcaggattgcaaaaagccaaggatgtataagtgtaaaagacaggtaaagcagtgtcatggcatacatcattgtggaaagctaccattatatacttggctattgaacacagatgccctaacagtgaaagttttaataaaaataatattatgccacataaatgttctttatagtatatatggaaatgttctctattattaatgtcaacattgcctttctgtcatgctttggttagcaaatttagcaagggtaaatctgtttagatttttttttttttttttagacagagtctcacttggtcacacaggctggagtgcagtggcacgatcttggctcactgtaacctctgcctcctaagttcaagcaattctcctgcctcagcctcctgagtagctgggattacaggcatgccactgcaccctgctgatttttgtattcttagtagagatggggtttcaccatgttggccatgactggccaggctggtcttgaactcctgacctcaggtgatccacccactttggcctctcaaattgctgggaatacaggggtgagccaaggtgcccggccctctttaggtttttaatgtaagttttttatgaagttttctgtgctattttaagcatgaaagtgagactaatacatataataacaatttgtgagaacttgtatttggaagtacttaataatagtttgtgaattgttacctgcccgttcatgagtagatagcaaatatatatgatacatgtatatataatatatgtttaccatatatatatatttaccatatatatatatttaccatatatatttttttaccatatatatatatttaccatatatatatatgtatgtttctatatatgatacatagagatagactgacaggtgtgtgtgtgtgtgtgtgtgtgcatacacttatgcatttgttagtctatgtatccatgtaacttatgtatgattttctacttatgaatatgtggcatttgtgtgggtgtgtgtgtgggggtgtatacatgcattaaatcatgtcctctaaagagcaaataccatgtcagaatttatcatgcaagagatttattgggaaaatgcctgtgaaagaagaaggagagggaaataaaggaggcaggaagaaccatcaaacattgaagcagttctgatccctgggaaaggaggggagagaaggaaggagagttggactgacagaatcttggatgaagcatagtttttaaaatattttggccaggccaacagggagtcattgtgccaaagttgcctgtcagaggagtattacatcttttagaaatggacctgtcttgctaatgctatcttgctcagtcattagcagagaatgggttcatacagagtatggcctcacgtatgtatattcacatatgtatatgtattcatatacatatatgcatacataagtatcaaaaaccgatgtatatttattgcaccaaatgatttttaatgtacatgttgaaacatattcgttgtgttactcttatgcatataaagttatttgtaaagacatggatttctttcatttatgttttaaaatttccatgtactatattagaggacataaaaagatgcgtaatattacctaggagtgcacattgttgaagagagttacctagtgtttgtgaaaggcttttatcatccagaaattaaattttacggcttaccttttaattttcctctcaaatattgattgattttttttacaagtagaaaacatttaagctatgtttgagattttttaaatataatgtataacttaataaagctaaattatactgtccttaaaaacttaagaccactgactgtttctttcttactgaaatcaaaatagtgattatggctcaaagacaatattacaaaactgaatatgattgcaaatatgtgtgcactaaaccacagcatgcacactttggccacagccaaaacataattagatttctccaaaaatgcctcttagtgtttaaataaacagtactatgtcataatagtacatgacatatagataatttacttttttagagaaatataaataataatgacacattgttttctctgctattacttacaaaatttgagtgtctaagtcataaatgtgtttttctttcccacattaaaacaatgacaaaataattagatttgtatgttttttccacttattggacacctggcttcaaattctattaattattcattacctgatcagcaaagaatacagagaaaagtacttaactatatgaaaatgagcattatgcataaggataaatttggctagtatcttacaagtttccttatataaattttttcaactttaaaaatcttgtgattctccatataaatacagttttattgatcaaatgaagcataaatataactaaaattaatacatttattaacctctgaaaaatgttaggtgaatgctatgtatatacaaacacagtggttgctatatggcatggaacattcccatcaaatctgcatccctggtggctcacgcctgtaatcccagcactttgggaggccgagatcggcagatcacgaggtcaggagatccagaccatcctggctaacacggtgaaaccccgcctctaccaaaaatacaaaatattagccgggcgtgttggcaggcgcctgtagtcccagctattctggaggctgaggcaggagaatggcgcgaacccaggaggcagagcttgcattgagccgagatcgcaccactgcactccagcctgggggacagagcgagactccgtctcaaaagaaaaaaagaaaaatctgcacccctgcaatgtctctggattactttccgattattcacatattatgttgtcccaaaaactcagataaaaccaaactagagtatttaaaaaaaattatttctaagaggttgattttaaactgttttcctacttggttaagattctactgtatgtctagctgtaaatgttttacaacttcatgattatggaatgaaaattagtgctacttttatatagcaccgctgtaaatttctattcattaaaactactttaaaatagaaaaatcctaatagagcccatatctttgaaaggcactagaatttatgtgaaataaaaaggatacttctaattttatttatttttcatttggagtaatgttttaatgcatctattgagcaagtattttttgaggtttgtggccaaaatactactcagttactaagtgccgggtggacaacagagacatttccgtgttcttgtgaaacttatattccaggattcttatattcagagaaaatcttattttctaatactctgtataccccaaacgacccaccagagtatcaattatgtgaattacaactgggaagaatgtgagaaggagaagtacaccatcaggagaggatataacgtgaacctagtgttgggcctggggagaggtccttgaggaagtggtactggagcagatgtcagaagaatgaggtgtgagcgagagggaaaccgcacaggaagagcgttctggtgagcaggaatagaaacatggaagaatgctctgaaatggagaggagcatgtgctcaaggaaatgagggagaccattgtgtctaggtagggtttggaaagcagtaccggagtggtgggcagtgaggcacgagagaggggaagagtttctaaatgcatcctcatgtaactcaagaatacacctgagatgaattttgttatgcttgtggaggggcagtgcctaataaagtttaggtcacactttgatactagaatgcaatagtaaattgtatgatcttattgctgcctgcgatttgattgattaattacagtgatttttctcttttacaaaagacaaactgctgccacttgttgcattttttaaatgagcagtttgcaaagattgtatcttttatgtaggttgcttatttcatatatttggaaacgggttatatcagttggtggacgatatgtcaaaaatttagaactttctcccatctttccaagttgctaaattatatttcagtgaaaagctttctctctaaagtgctaaaggtatttctcaatggaagcaataaaatgaacttttttggcagctttcccagaaaaaaaaaaatccctctagcatttttggaaatgagtaggggaaaattataaataatgtaaaataaactcacataagaggcttatatgaactattatacaatatatattaggaactaaattttcttccattattcctttaggatcttgtggctctagtagaatgggaaaatgcactcccatgagaaatttgacaataacagccaattctgcacggaaaaaaatattgaatggtttatatataagtttaaaatctattttaaaagtaagacttgatacgtgagagactagtcaagtttggtgattaggaagtctctttttctactaaattcaaacctacagtgttggtgttcactgaatacactaggtagtgtagaggatgcagaactcaggggaaaaggtctcaataccaacctacataatgaaaaagaaaagatatgtgtgaggtgtggctttaaaacaaaagatctaatctaaaaagatctaatctatgtatcacttttgggatctatatgatatgacagttatgccttatgtttggaataataagcaatatgtaaattacagcaatatacaagctactgtatattagtagggaacacaggttccatttctccttacttcttcctggcatgctatgataacaacttaactatgttatgataacaactactagtcatcctgcttcctgtatccctttcttgtgtaccttagacacacgtgcatttttcttcttaaataacaggtatgttatgaaatatttgtgcctaaaattcttaaatatttatctttctctttacacacactctcacacacatttatttatatgtgtatgtgtatatttctgtctccaacttatcttctaggcttattttcgacattccttacaactggcatgagcttcttgttatagtttctagatattctaggttttcttaccttgaggtcacttttttggtcactttattttttctgtttgtaattttttgttctctatttttactatcctctatcacctcagtttttgactgttctttaaaaccaagttcaattggcttaaactctgtgccttttccttacccatatgaaaaatcactgtcttctcatcaaagaattcctgtgatacattagttatgctgtttttatagcacttttcacattttccattgaattatttatgtttatgtgttagattgtaaggaacttgaaggcaaagtttatctctgagtcatttggcttagtaccttgcatagtaattatacagagtaaatatgtatagaatgaatgaataaatatatgagaagaaaaatatatttcttttatgcgcatcgaaagatgtaggcttcatctacatacacaagtcggacttaagtatttagctgacttgattaagggatgtctcatcctgaggaagggtataatttagcaataacttactcattataatttatttaaagttgcattccacaagtaattgtacagcatcacctatgggacaggaacattatatgtgtagcttgtgaattcaagattgataacaatcttcagctgagaccttttttttaaaaatgtggcatttgcctccaagagaaaaggcacgaaagcatcacaagcagagaacaaagagaaagtgtcttcagaatgtaattgtgatgaatctatgcctgtctgtttgcaaggatttgtgtagcactcttgcaccttcccccttaaagaaatttctctactacaaattttcagtgctttgaaatgaaaaataatttctgccattgtaaatttttttgcaaataatttcagcacctagaataagtgaagttatttttcagtaagagtttatgacataaagggaagtgattaaatcagtcatgaattgtgcatttagaatagcatgaaggacttttctttcaacacaactgatacgtttgaactatgctgaaaagttctcctggctgaaaaatggtcatgtcttttttattctaaaataagaatgaaatgttttgtaccttaaattttctttgattttattccaaaaataaatagggaagctaaattttgcaaaaataattagtctctatgataggcacggtgagaacaaaaagagactgtgaatcagatgatcctagttctaggcctgggttcagccacttaattaagtctgtgaccttggcgatttcatataaatatttaagtctgtgacctttgtcatttcatataaatattttcatcctcaggaaccttatctgcacaatttagggattagtctttaatggtaaattttaaactgcttttaggagtcacagtggcacatggagtcccttgagaagcaacctcacaaggggtggcctagggtgccaggctccaccattttttgtgtttgttttgtattctgtttcatttgtttgttaaaattccctttataataggttcgtgacaggaacaaacaacaaatttaaaattctagattaaatcacttctgggtttcatatagcaatcttaatttttacttgtttatggaacatgggtagtagcagataaagataattgtcatttttcttattgctctattcactcacccaacatttattaagaagttgctacatgtaaaaactgctgtgtccagtgttttggaaatttaaaggtgtcagagttcaaaatctattcggaaaatatctaagaaaaaaagtccatgtgataagggttacggcagaaatataaataaaatgtccttaaagaatgtaggtagagacttcattcttccatgctctgagcaggtaatgatcccacaacaggagatgaatgcaagttggtttaagtcctatggtctcaaacttggttttagaactgaagcactttttatttcagtatcattattttttaagcaaatgcctgatgaaaagttatctttgaaacattttgtatttaaaaaattgtcatcatgcatacattacttaatttaatacagtacactatttttaactcatagcaaaagaggtaaaacagtaacttaaaatttataggttgtaagaagtatgaagatcattgtgatgcaagtataaaaatggaaacgtgttttaaataaatcaatattcaaatatgtaagtcatataattgttataaataatttaatatacaaatacatatgccaaagtccacatgatatatccactaagaccttaacatcctgaagtgtattatatactagcgtaacataattaatatagtgaaaaatgtctggcaatatgcaaaccatccataaccactttgtttgcaatctaccttcaatatttagttggacaactttggagtgaaaagtactactgcatgagtaaagaaatacaaacgtcttattatgttgctttccagagtcttaggtttcagttgattacctatgtcaattagtatattctctcctttcctttctattacctttctttaaactttgagttttctgtgcctaaaaatgtgtatacatacatcttgtctacccaaaattttattctgttgtaattgaaatatgtatttacttgtgatggctaatttcatgtatcaagcctggctatgtcaagatacccaagtgtttaataaagcatttctctagatgtttctgtgaaggtatagatgagattagcatttataagtagacttacagtaaagcagatgaccctctatagtatgggtgagtctcatccagtcagttggaggttttagtagaagaaatctgacctccatggaagaagagagaattctgccagcagcctgcctttggattcaaactgtcactctttcctgggtctccagcctgctggcctgccctgcactctggacttccagcctccgcaactgcatgagcccattccttaaaataaatctcactatatatatatatatatatatacacacacaactttttggttctgtttctctggagaactctgactaatatatgcttcagggcccagaaagtgctgaccatcttataataatttgaacaaacaaataaacaaaaatagcccaaaccagaaaagtcactcaatgtatatgtgatgtgatacagtgacacagatattgagaaggcaaatactgtgtgatcgagataatggggtcagcagatattcttccagagacaagaagcactggtgtaaacaagtatgctagttaaatactcattagttaaatttacagagggaattcagtgaaccctacaatgcttcagttcttcagaaagattatccagcctctctttacttctcccttccgaaatttcatgtacacgattctagatatttgaataaatgttccacacagaactttgggtgatgaaataaaacctatccatctgtaatggaagggaactgactcttacaattgttatttctgatactgatagaatttttgtctcaaataatttttacacttactgctgttgttttcctttctgtcttgctcacacttttagtgtaaatatagttataacatatagaactgttagaattgtggcattaggttgtagatttgtgatcttcctatatttttgatgaaggcatttaactcaggactcattttgaaagtctaaactctttgaattggaaatatatctcctgaaagttttttactggatttagtaaaattgagcatttacctcactgtttttctttttcaaaagacatataatatttaaaaacagtagagaataatgtgggggaaaatgcaatctaattaggtttattgttattactattttgacatttttagatctctttagaaaaaaattacataaaagacatttgaagcttcatatatataacgctaacctattttcctcccttcttcctcatatgtatctattttaccacatatttatttttccataaatttctgtctattgttttaatttttaaagttttatataaatagtatataaatcatatatttatataactttctttcttatatgtgttttttaactgagtaatgaaagaataagtgtttaaagtaaaatattttatcaggtatacttatgaaacatcaagtatacccattaaacttgtcaacttttatcgtaggaatgttacatggtaagtccttagttaacatcattgataggttcttggaaactgtgacattaagcaaaaggacatacagcaggtccttgaataacatcattttgctcaacatcattttcttataatgttgagaaaaagcatggtatttttatacgttgttttgcttaagtcacagtttctaagaacctattgacaatgttaactgaggacgtgttgtgtttgccatttttttctagccaaaaactctaagaaacttgaaatgacaaacccttcaatatgctttctcgatatctttctcataagaactcagataatttcagtatagataataatatagctactttctgtataattgtggattttatatgagaattgctaataaaatgcctttttttaataaataaaacctaaacttaccctaattatactttcattttcttcctgatctcttaaatcatcgtggattacagggttttgttgttgttgttgtttaaatctggcatatggttacaaatatagcctgtgtgctaataatcatttcatcttttttaatatattagaagacatttacacagtggttcttttccaaggagagcattttctgctcagttagcaggaaatgcataagtagttttcctaagtgagatcttcatcagcctagaagtgtctactgcaactttctgggcttttaaaatcataccaccaattattcctgagatgttgtattacgtctttgacagctgacatttttttgtgtcacagctatttctatacaaatagaatgcatggagcattacaagatatttaaaattgttatgtattcaaatagtaataggtattgttttgaaatgtacttctttaattcacaatatacttcctttagggcacctggccagggatttaaaaacccaaagcaaacatgtttttgtttctttctagaaagatcaataaatagcattatacaattacaacttactattctcacatcgctaaaatagaagtgtgcttatggctgatgtcaaagactgtagttgcctacgcatcacagtctcccaaggagaaagcttaacctttaattgtatgctactcaagcaggattgctgactatccttatctattgaggggaaataagtaaatagtaggagagaattaactgcctttcattctttgctatcacttaaacatatggtataaacaggatttttttttgtggctgttgatttttttccagtggctctttgctggaagcaaaaatatattttgccttgaaaataaagttagtgttctcaatttgtgataaaggtcactatttaaaaatattttttgttgtttttgttttctgacaactcaagcagaattgattaaggataaaaaaatggcttgctatttatggagatgatttcctatagtttgtaatttaatggactccctaaccaaaacacattcctaaaatagttttatgagttaaaatgttaagtgatcggtttaaaaaaaaagtaaattcctttctataagacacttctgaatcaatatcattgtattactgaaatattaaaaacaagcaagaaaaccaatgagacttgttatacaggtacatgtggctactcaactatattgtgatgtcagagaaagctcccttttctatggagggccatgtgaccagaagaaataggtgctttcttactatgaaagacacaattgtcccttattctaatttgcgtagatatttatttcaatttccacaaaagtcctgtttacataagagacagaaataaatgtataacattataaagtaaaccattgaataatatataaaaacagcttgaagttttatattatgactatcactgtgaaatgctatcattacatgctttttgatggcatgatgcttttaaattgaaggttaaaagtcctaaaatatgtaactagttagtgtaaaatttttatttaaaactgatggagattcagttttttaatttctgtttcagaaattatcatcagtctaggaggtgtaaattatcctctcaaaggaaggattttgctcttatctattgggaattttctttaaggcctcttgcctgtaaaatcacttgtatctaatatgtgccattaattataaaaccactcctcctataggtctaccatcacagagttttgactaacattttttgaaccaccatatttattatgataacaatttaactaaattaggccctgcttttcatcattcagacaacttttgggaaaacatttaaaaaataaactcaaaactccactgtctctgagaagtttaaaaacagtgagcctcaattcttatgtcagtgaagtcaagagtttcagataaatctgtatattcaatcctgaggtatcaaatccagttcactgaaattgtcaacagtgatttacaaaaataaactgaagggcactgtttattcacttctgtactgatgttctatcttcttacggtgttttctcacagcttttttttgtgtagagaatcttgtattaaaaggtcaagaatattgggatttaagcctactgctgctactattttaataggtatttaactcccaattgcctatatttcttgtgtggtagtaagtgggatactgaagttagattcattgatgtctatggactttgctgtcaccattccctatcttgagaatcttatcttcccatctctctgcttccttttttcccttttcttttaaacatttttttttattcatttgctctttttctctacttctcttccattgaaatgactatattttccctcccttttaatatgctaagtcactttcagagactcaatcctaccctattcttctcaaacattcttaaaatacccttttctaaattgtagagcatgtaattttcctctcatttccaatattccttcctattctatcatgtatgttataatctgtgatgagtaaattaagaatcaagtgtgtcacagcaaaaaccaaaagaatgagaaagatagtggaaatagcacagctctggttaaaactgctttcatcttgccctttctcttagtaaaaactcaaccccacagtattctaacaggatttttactaccgttcttttcctgtcctaaccccaattcaaataaagacttcacaccatctcagttcagttaaaagaaatactgttctctttaatgttagaaataaagctctagtcttccataccagaaggattttgagtaggtatattaactttttgctctacccactttagagtagactggaagtattaggccaatatatgttaattattttcttctgatggcaaaataatataacgcctgctaatatttcgagtgagttttaagactttcaaaaatccttaaaaaaaggtaatacatgacttcagttcaactccataaaatagcatatcccagcatttagagaatcaaagacaaaaaagacaagttcattaatctcaagcagcttacagtctattagtggagctagaaatataagcacataaatgttaaaaagaataattaagaaaggatttataaaagatagcaattatacagaaaaatgtctaattctcataagatagtatgagaggtttggctctgtgtccccacccaaatctcgtgttgaattgttattcccgatgttaggggaaggacctggtgggaggtgattggatcacgggggcagatttcccccttggtgttcttgtgacagtgaataagttctcaggagatctggttgtttaaaagtgtgtagcgtttccctcttcactctctctctcttgctctgccatgtgaagatgtgccagcttccccttcgccttccaccataactgaaagtttcctgaggccacccagccatgcttcctgtatagcctgtggaactctgagtcaattaaatctcttcataaattactcagtttcaggtatgtgtttatagcagtgtgagaatagactaatacagatatcaaagcaagtgattcataaaagttgagattcctgggccgagttttaaaagataactaggaatatctcacaggcaaaaaatagagagtgagattaaaaaaaaaaattcaggcagagagaacaagtacagactcaagaaaatgttatgtaattaacattcataattgaattcattagacactatttggaaatgggcttacatatatgacaaaactgaaaaatggcagatttctgatatgaattatttcaccggattgcttaatttgctttttattgatattatggaactcattacaaattatttatatagagctataattcacaattatataccagtagcaataaaaaactagtagaattgtagatgatgttggcactttctttgtagtttgctcaaaattttcattgaagaagaggttacattcctctaattgtatttttccttttaatattgtgcaattaaatgtttatttgcagttcataaagcaacatcatctcatttgtttgaaaatcctgcttgacatgttcttgtatttagtcttgctattaaattaggggccattagaataaatgagattgtgagatgttaatacagaggtcagttcaattttctacccatttccaccaatgtgaaaagcatctaacatgtttgcataaatcctgacttatagatgtggtaataaacaaacaaaattgtaaatttcatttatttacaactactggggagtagaaaacataaagaaaataatgatcatatacaggcagaagctgagagtctcacagccccctttttatatttaataataatatacatattttaaattgacatataataattgcacatatttggggggtacataccaatgtttatatttatagatatgttgagtaggtgcaaaagtaattgcagtttttgcaattacttttaattacactatatataatggacagttaattttactacactatatatatgttacagtaatcagatcaggatgcttagcatatccaacatctcaaacatttataatttacttgtgttgggagcattcaatatacactcactagctatttgaaactatataatatattaatgttcactatagtcatcccacagtggtagattttcactgcctttcagagtttgtacagagagttaaaactatttttctttttctatatttagtctgtacattttttccttttgcaattccttttcagcattctgcttctaatctctacgtccatgacttcaattgttttgatttttagataccacaaaatatgcttatttcacattgtatgcctttatcaaaacatctcatgtaccccatacatacatacacctactatgtactcacaaaagttaaaaataaaaaaattctctatctattcattttttaaaattatttgccattactcatttccttggtttcttttacagtcgtttccctattaaatcagttagcttttgtttagcttttataattcattctccattctctatattgtacttacctatgacacagttatttaggtgattacttttagagtggattggcatatttctgttagaagatgatatcaaaatattgttaggtaaatgaatatatatctacctaaatgatacatacatatatatatatatgtgtgtgtgtgttatatatatatgtaaacataccaccttaatgggatgcatacagggctaatacgataattccttattttatataatgggaaagtagtttttgccttattcctcgaattaacggtgtagagagactcaatttgttttaaaatcttaattatcaatgataattcttcaaataaatactctcatttcattgcaaagttattactattagagaacattttaattattgttatcaaattttacttttttagaaaaacacaaatcctattttaagttgaaaaagcgaatgttaaaaatgttttaggatttacacaatattttatttgaagttttcaatttttcaaatgtgaaaatacctatgaagtatgaatttttttatttatcacgttgattataactttaagttttaaaaatgttgaaaagcaactgggttatgtagaagtgtatatgtgtgtttctaaacaccttatatattatgtattattacaaaatgtttataaacacgttataattttcagaggcttacattctttttaaaatgatacttcgttaataacacttcactaagtttttcattcagaaaattttaatctaaactagactgatgtactactacacactaatatgtaaaaagggaccactaccccttgagtgagactttatattatttaaattttgctccaagtactgtatgcatctggatatattcgaaaaaaatctttccacattctcttatttctgttttcttagatgaagcatgagtgggctggtttgtgcatctagaacaggggtaggggacagggagatatccaaccaagtatggaaaagcatctcttctcttaattttcttcctccaaattaaggtgctgtaacttgaacgaacactcaaattaatgtgtacacatgttatggaaaaaaataatgcagtgatcaatgaaagaatccaggtttaatattgggaattaatacaaagaggggatatagaaaattgaagctaggcttaaaattgaccccaaaaacttatctgaacaaatgaaatcttagaaatcctttaagtatagtatgccttggaaatgagtgatatggaatgatcatagtaaaaccacactaatgtgacatgtaaacttacctatgactacatgaaaacttgggcccaaggaaagctggattatcaatactatgtgtatatgaaagagtttgtcatgaacctagactgtgtcacttttttccatactaagagggatgctatctcatccacccaacatgaatggaaatttaattatattcaattatcttaccaggtttggagatacaaatgaaatactattatttaatatttactgagtgcttattttcaagtggttatcatgttaaaggctttagatcattgactaatacaattccataataaccaccctgactaggtgtttttactagctgaatttttcagataaaattgagacttacagagactgaataacttttccaatattaccctgctagtagaaagtggcagaactgggattggatcccagttcttagaaaatcaccaatctttcttaaccattatgctatttattggttttataaataattacttcaaattacctacttggtggcatccttaatttggagccaagcacttatttaaacaaacacttaatgaaatatttatttatttttaaaaaacttaattaaacacttatttaaacaaagtttaagtaagatacagtttttgttcttgaggaacttacagtataacagagggagaaagccatgtaaacaaaaaaacaaacacctctaagtttgtggctttgtacagagagagtggtctgttccttttggatttttactttctagaagttttatgcaaggctccataaatatattatgtctgagtttcattgtgaaaagttagcaggtattcacttactgaagggaagccattaaaatgttttaggctggattataaccactggacatgaacgaagaagaagatttcagctgagaatagtgagtccatttaaaaggctgttgaagtagtcaaactgaggtcagatggaggcccgaagagaggtagttccagagacaaggcactgtgaagagaagggattttggtgtttgaggagtagcaatcatggaccacacacatttctgagtggaagtaaatcagctcaacctatgtcactgcctgggcatttgacagccatttgttgctttccttgtttttaattacttaatttctattatttttgaagagactacctaacatacttaagaaacttcactttccaaaaatctttggctattattatcccgtcaggaaaactccttatcaaagaaaactttctttttggaattatttttttcttcagtgtcaagtgcttttatattctgttgaagatttgtttttcgttaaaagataacttccacttcctgtattgcaacaatccaatgagaatgaagaaggttagaatatagttgtccctcagtatcagcagatagaactggttctaggaaccaggtggatatcaaaatctgcaaatgctcaagctccttatgtagaatggtatcactgtatttgcatataacctacgcacatcttccatttagataatctctagattagttataatacctaaatcaatgtaaatgctatgtgaatagttgtcataccatgttttctatttgtatatttttattgttgtattgttatttttattatttcttaaaaaatattttcagcctgaggttggttgaatccatggatgtggaatccaagaatacagaaggccgattgtaaccgatatcggatcaaaaagagagtaatagaaagaaaggcataaaaataggaaaagacaaatgaaacaaacaaaaaagccacaacaaaaataacccaacttagttagattcaagtttcataatttttttttcttaaaggtatgattaagagttgatgagagatacttggaagaaaaaacaaaacaaaataaaataaaacaaaaaagctgaggaagtttagtaacagagaagagttaattgcttttagaatattttcacaatagtaaagctgcaaattagtttaataggatacaaaattttaaatgtaattatattaataaggaggtaatgatttcttgtagtctataagttatcctatacagacatgaaatattttttgtattatataacaaaccctactgaaaggatggatgtctcataagtatattaaaatttttctaaaaggcatttataaaaacaggtgtgaaaatttttaacacaggatggactagaagaaaataaataggagactagaaaaagatacattctcattggaaattctacagctccatacttgggatcctaagctataattggatgtggaacactcaatttgagagaattttcacagaatgctaaagttctctcttttttatcatccaaaaaaaatcatcattaaaaacttccaaagggcgtaaaacatataatattggcagagagacacaaacatgtttttttttaatttaattttaaccccctgtgaaaaaagaattccttgagtttggccaaaattcaaaattttaacttagaaaataataccagtctctattcactaaaaatatgcattctttcatttatttctgaaaaaaagaggtagaattttatttctgtaatgtcaaagcaagtcctcatccttctttaatagacactatatttgtcaaaatttttgtaagcataaaaatatggctggagttcttagaaatgtttgccgtaacttaaccaataaataaagtattgcctcaaactaaattgcattagaaacaggaaaaggagctctaagcaagaactgactgcaatcattcagaattatatttgtattttcaataatggccaaagacataaaattacgagtgcccactaggtgaacattatttattgtgtgtcagttatgactcataatacatagtcattatctctttaacacagtaagccagaataatatatatgatttttcccattttacagatttaaaaatgatgctttcaaagtaggcttaactgcttcacaggaatgttgtctaattttgagcaatgtacattataatttttctaatactgtctacatacagtattattggtacaactttaagtaggttgtgtagtatattgtaacacagggtacaaatcctgacagcaagtggtaaatataatggtgaggtcaagccaattccaaggaaatacattttctgggacatatgagaactttgccttttgtatatatgagcatcatgtaagagcgaatggtacagtaaaaaccccaaggaaatggcaacttaaatgtgagtcatttaaacaacattctgaggtattggtataaggttaggatcatgttttaattattgttgatctgcaaaatattctattgggcatccttcaatcctttcaagcatccagcctaaaatactaatactatataatgttacatgactccaaacaagattgaggaccagtgaccttgtacaaccctttcattttataattgaggaagttaaaggcttgagtggttagactgttggtaagtaagtcattacaatagcaaaactagaacccaaatctccaaactcttttttcccattatgttttctcctatatcatactgcctggtataatgataatggtaaagttcttgctttttaactctaactgttaacattttaataataaacataaacaaccaactgaaataataaaaataatttacacatgcattttaaaatatttattgtatgaccagcatatactaacttaaacaaatttaaattgtacactttgataaatactgacatacttaaaaattgtaaacacaaagtagtcatcattccccccaaactcccttgcttctctgtaattcttctcacccacacttcctgactgcaattccatacccaggaaaacgtggtttttttctggtcactgtattagtttgcattttatacaggcttatataaacagaatcatacaatctacattgcatttctggccttgtttctttaacggagcatacttatttggggatttatccatatttctttttttttttttttttttttttttgagacggagtctcgctctgtcgcccaggctggagtgcagtggcgggatctcggctcactgcaagctccgcctcccgggttcacgccattctcctgcctcggcctcccgagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccgttatccatatttctatgaatgtcaatagttcattgcttgttataaatttatactatttcattggatggctatactatgatttgtttatccactcacacgttgatggacagttgtgttgttttcagctttggctgttacaaatagagctgctatgaacatttacacttaagtctgtataggaacatatgttttgaaattttgggtaaatacctaggaatggaatgatgagttcatttggttggtataagtttaactttttaagaaagtttcaaattgttttaaatgagttgtaacattttactttcccactggtaatgtataagagtttcagttgctccacatcttcatcaatactggtgtggttacacattttaattttagacattattgtaggtgcatagggatgtctcgctgtgggttcaatttgcatctccctaatgacaaagagtgttaagcatcttctcatgtgtttgtcatgcattttccttcattgtttcaatgtctcttcaaagttttgcctgtcttaaaattgggttgtttgtattcttattatcaagctttgaacattatttttctgctctggaaacaatcctgttgtcgactgtatgatttgcatgtattttctcacccatttgtggctgaccttaacagtgtttttcaaagtagaaattcttaattttgatgaagtccatttcattttttatgggcttttattttagcgttgtgtctataaaatttttacctatcctaaatttacaaagattttttctatgcttatttctagacatttcatagttttaagtttaatgtttagctctgtgaatgattttgggttatttttgcatatcttatgagttatagatcaaaattcatttttttgcatacgtatagtcagtaccatttgttgaaaaggctatgctttcttcactgaatccccttcacacctttatcaaaaatcaattgaccatgtaattttgtgtttcacttttagattctccattctactttattgctttatttgactgttttgatgtatgtgatcttttatcctgaaaacttgcaaaacactttttagttccagtggctttttgtagcttctgttggattttcttcttacacatcggtcgtcttataataaggaaagttttattttttcactttttaatggcttacatttatgttttctgacttagtgcactaggcaatacatccaggacaatgataatagaagtgggaatagtggaaattcttgactttttcctgatcttaacaggaaagtattcaatcttcaccattaagcgtaaagttagatgtaggtctttcatagattcccttttcaggttaagtaatttttcttctatttctaggatcctcagaattttatcactcagagtatggtctattttggtaaatattctttatgaatttgaaaagaaatatgtgttcagctgttgttagctatcgcgttctaaaaccatcaatagtgtcaagttggatgatagtgttgttcaagtcttactgagagagacagttgaaatatccttctataatttgtttctttttttgatgatgaaattgtgtttaagtttttcagctttattgatgtatgattgaacataaaaattagtatatttaaggtctacaatgtgattttatatatttatatattgtgaaatgattaccacaatctagctaaaaatcatacccatcacctcaaattgttatcttggttgtgtgtgtgtgtgtgtgtgtgtgtgtgtgtgtgtgtgtgtacgtatgcgatgacaacaactgagaacttaaggtctattctcttagcaaatttcaagtataaaatacattataattaactgtagtcaacatgttaaaaattatgtctccaggacttattcatcttatgaatgaaagtttataccacttgacctcaacatctctcccatttcctaccctcctatctcctggtaccatcattctgctctctgtttatatgaatttggattttttagattgcgcgtataagtgatgtcatgcaatatttttatctttctatgtctggcttatttctcttagcataatgtcctccagtttcatccatgttgtcacaaatggcaagatttacttatatttgatgctgaataacacctgattgtatatatatgacacattttcattatgcatttacccactgatgaacacaaggttgattccacattttaggtattgtgaataaagctgcagtggacatgggagtacaaatatctctttgaaataatgatttcatttcctttgtatttgtacacagaagtgagaatgctggatcataaggtacttctatttttaacttttggaggaatctccatcctgtttttcataatgatggtatcaattacattctcaccaatactgtacagtggttcccttttctccatttcctcaccaacagttatattttttccttatttacaatagtgtgaagtgatatctcattgtagttttggatttgcttttctgtgaggattagtgatgttgagcattttgtcatatacctgttggccatttgtatgtcttctttggagaaatatcaatttaggtttttttctttattttttcctgagttgtttgacttcctaatgtattttggatattaacctcttatcaagtatataatttgcaatttttaaattttacctttcatagtttgtctcttcattcggttgattgttttaatttttttggggggggggtggaggggggagggatagcattaggagatatacctaatgctaaatgatgagttaatgggtgcagcacaccagcatggcacatgtatacatatgcaactaactggcacattgtgcatatgtaccctaaaacttaaagtataataataataataaataataataataataataataataaaaagctttttattttgacttaatcccatttgccttttaaaaaaaaaattgttgcctgtgtttttggagtcatgtccaaaatatcattgccaagatcaatgtcatagaacttttctcctgtgttttcttgtagatgttttatgatttcaggacttacatttaatctttaatccatgttgaattgatttctgtatatgatgtgaagtaaggatataatttcagtcttctgcttgtgggtttccagctttcctagaatcatttattgaagagaatgtcctttccccattgtgtgttgttgacatcttggtcaaaaatcaaatggcagtacatgtgtggattttatttctagtctgtctgcattgttctgttagcacatgtatctgattttaagtcaataccatgttgctttggttactatagctttgtagtattttttgaaatccaggtagagagatgcctccaaatttgttattttgtctaagattgctttggctacttggggtcttttatggttctgtaatgaattttaggattattttttaattttgtgtaaaacatcatgggggcgttcataggcattgcattgaatttttatatcactttgggtattatgaatattttaataatattatttcaaaccaagaatatgtgatatcctttcatttatttgtagcttcaacttcttttgtcaatattatatagttttcggtttacagatcttttacctccttagttaaacatattcctaaatataatattttactttattttattgtagatattgcaaatggaaatgttttcttaatcttctttggatagtttgttgttagtgtatagaaatgctactgatttaagaaattcagtgcttcttttttttttttttttttgtgacggagtctctacctctgtctcccaagctggagtgcagtggcgcaatcttggctcactgcaagctccgcctcccgtgttcacaccattctcctgcctcagcctcctgagtagctgggactacaggcgcctggcaccatgcccggctaactttttgtacttttagtagagaccgggtttcaccgtgttagccaggatggtctcgatctcctgaccttgtgatccgcccgccttggcttcccaaagtgctggaattataggcgtgagcaactgcacccggctgaaattcaattcttctttacattaaacataagataattttctaaaagtttaaaaaatattgtcttatttaaacacgacaacaatctaatgtagtagattctttatctatagaggatgaaactgtggcacacagggtgaggtttatataacttttgtaaacccatacagatattaaaattgaatgatggcattttgagtaaagatgttatatgattagatatccttcactctgtgttgctttacttatccaatcattttacctagttaaaatgattaaaataataaaatgttttaccagtagcaaatgaaaacatatatatctcagaatctacttataaccactaactaaagaaaaaaatttcgtatgtttttctaaataacatagcatttaaagctgtattctaaaaaagattacatatattgcataatgattttacttaattactatcacaacatgtagtcaaatatgaatgcttaaaatgtggtgttgcataatgatggaattttaaaaatatgtcagtgaaattcatttaggaacgaaaatgtgacttttctatctttaatttataaggctaataaaattgaaataatatatactttaccgactggtggagtggtccaaagaacaatgaaatgaagttatttaaaacactgtcattcttaggataaaaatcctttgcaaaaacagatggctaaactatttgatttaacttcatgtgtgtgtgtgtgtgtgtgtgtgtgtgtgtgtgtgtgtgtgtgtgtgtgtgtgtgtgtttgcttagtattgttagactatgaaaatgtacttaaatcttttaagaatggaagaatatttttgtcataatcagcagtgcaggcacttgaaaactctagcacaatatttttttttaactgtaactgttttggtttgctaatgcagcacttacttttccatatgcaaagatatttaaggtctcaatggttaaccttattttagtattactgtggagaaagttgcaatctgaatctaaaataagtcatttagtttagactaaatggacagacacatctttgaagtttatagatacagtttccagtgacccagtttttgacatactactgtcgtggttcactctaggttttccaaacactgtttcagtgattactgagccagagacagtatgcttgattgtgtcagtttatacttgaatacctttaatatgtgaatctatgcatcatactcaccatttatcactctaaccctctagggcatatgagcacaacacataaatctattttggctgctccttaaatgtcataaataccctggctatatttggttttaatatatatatattttaaagagataaatactgtaaatcatatttctgaaggaaacattattttgacaaaatgtccatcaattaaacagggtatatatgtttatatatttatatatcctcttttatatatattaattatattaatatacatataatacattaatataattaaaataatatatattttaatatatataaatatatatattcacacataatcacacacacacatagagatacacaaattgaaaaacaaacatacacataccataaactgtgttattggtactatacaagagttacatcttttacagaacaacataggccctagaaatagtataaactcaagaaatatttgttgactaaatgactgcataagcaaatgaggaaacggcctagaaattgatctaaataacattaaaaaattgactgtatcccatccaatatcatagaataatattttctatattactgcaattaccatatctttgattttctttaccaccaacctcttatttgtgcagttatctttttcctctagtgctctccctctttgtctctcctgcctaagctaaatgtaactaaaataaaaaatgtaagttactttaaagtatagcaccatgaaatcttcttagtctgattgtttggaagtagtcagtggctttacccctacaacttaaattttgtatttcaaacttagtcctgaaaaggcattatttgcttcatctccataaaattgcattttagtagcatgacttgatgtgcttaataaattagttatgcatcttaatgatagaagacagcttaacctgtctttaaaacatcatcataaagctggtcatgcatttttctttagtgtcttccctagcactgtgaagctgtatgctcatatttacatcaaaactctgtcagatgattagattttgcacattttttaatggccattgaaaacaagttctttaggaccttaattgccaaagcaaaagtatgaaatagttttgatcaccatgctgtgatcatacttctatgacattcttaagtaaatggcttaccttggacacacttttaaatatatctgacttctttttttccctttatggttttccatcttgtttctgcagacgttctcttccttctgtacgcctctcccaatatagaatttcaaatttgtcatcaattttctgtccacatctccctatctgaaatgtttgctaataaggtaattctggctaggaacactcacagcaattctttgcgggggtaaaatgctactcttcaaggcccagtgtgacatctccaatgatttctcaggatttatgagtttcctttgtggagctgactttctttatggtgtggctgcatttctgaggatcatcacagtgtcaaaattcgttacagtgagaataagtatctcatatgagccagttgaaaagctaatacaatttagatatttgtggttattgataaagatatatttaacaatgtagtgatttcagaaaaaataataatggtgggaaatattacaccttgtgtataattatgatacattagtggacttacttcaagtttagtttgtgcacgctatggaaataattacatggttttttaaaagttgttaagatacatagtcctccttagtctttgctctgctaaagtggatttagtgtactacaaatggtaaactgttagaatggtccaagtctaattcataataaaattttacctattacaaactgtggttatatggattaaaaaaatgcctaaattttccagagaaagttttacaaaatgtgtttatttggattttttaactatattaatcaacaaatatgtagcattttcaatacctccgtattgttctgtttaaatgagcacttacatattattagatttgatgatgttctttattttacatatgggaaaactgaggcacagatacattcattaagttcacatggaaaagcagaaccagattttgaaaatgaaagagatagttataaagttgctgcttattgaggagtattcttcagacctttcaattttatttggtgaatcaggaaatagattaattgatcaataggaacaaactacgttaaatgattgataagtaatataaattaattccaaaagtggagacttctgtgggcttcagttagctaaaaacatgttattgaggagacaggcttgatctggactttggagaaaatagagaggcaattagggagacataatgttggagtgagtacatagaatattcaaataaatatcaaatgttattaaagcatttcataaattaagttttagcgtaattgatagaatgtgattctttgaaacattgtaattactagcttaaaattgtttattgcataatgagtattattattattgttattttggaacatgttttcccttctgattagttttcttacaatttctgtgtaataatgattacaaataatttttcttgtcaaaaaatacacgtatcttctcagttctactaaaatgaatgttttacatgaatttgttagagtaaaagcataagaaaccatcaggatctagaaaggaaagaaatggaatgagaattaaataacttacttgaattgtcttgctttaagtgaatgtcatttcttatgataatcacaaaaatcattaatcaaattttattttcataagtttgcatgagattacttaatagttttcttgagtcaatatagtgttgaaatataacatttttacatttttctccttagtaggaaagataatctataactatgggtgagcttatcatcaagaactccaggaaaattatgaagtgatttctcttgccacagtgcctgtcttagtttcctgaggctgttgtaccaaattaccacaaatttggtggcttctaacaacagaaatgtattctctcacaggtctcaaggctagaagtccaaaattcaaacttggcagggctgtgatccctgcagggctctggggagaatatgttgtttgtcttttctgcctttctttggctgcactggttttccttgacttgtggtcgctcaaggctctaaccttaattgcatctgcaagtactctttttctaagtaacgtaacattcataggttacagaaattaaggtgtaggcatatcttttgggggtgccatccctcaacctacttcagtcctcttttcctttgagctttcttcaaaatccctatttcatctgctacctgtgattagagctcccttgctcactatgctccccttctacttcattgtagctcttaggaagttgtcaactctcttgttcagcttttaaaagtactcatttgattattcttgctggtgtctagtttcgtgaggtttctatgctctacatgctgacaagggtagtaagtatgatctcaatacagtgaaatcacctctcaatagagttaaatttctgaagtcagcaggataggctgaatgtgtatatgacgtaaacatggtaagccagaattaatatagctgtactgacaagtacacaaaattggaagtttaatttactcaaaggtcttgagaaaattgtttattatctttaatttcatatacctttataggcttctaattttttctgtaatcttatagagtacccttaaagttcctggaagtagagaagtattactcttctattttaagaaattacggaaagaaaaagatagaggtaattactccaggataagtgttcatttaatagaatggtaataaggaatttatgtgaatcacagacactatttaaatgattctctagtatgactagccaattatctcagcaccatttactgaataaggagtcttcctcattgcttgtttttgttgaccttgttgaaaatcaggtggttgaaagtgtgaagctttgtttctgaattttttattctgttccattcgtctatatgtatgtttttgtactagcatcataaaattttcatcagtatagccttgtagtatagattaaagttaggtagtgtgatgcctccagcttcattctttttgcttaggattgctttggctattcaggctcttttttggttccagatgaatttcatgttatttttccaattatttaaagaatgatgttggtagtttcataagaatagcacagaatctgtaaattgccttgggaagcatgaccattttaacaatattgattctttcaatccatgagcttagaaagtatttcaatttatttgtgtcaatcattatgctgaaaagacacatgcatttgtctgttcattactgcactattcattattgcaaagacatggaatctatccatatgcccatcagtggtggactggagaataaaatgtgatatatatatatatatatatatatatatatatatatatatatatatatatataaaataacaatacaagcttatagctgctcagagaattttgatttattcaagatttatatatatctatatttatatatatactatggaatactacacagccataaaaaaacagtgaaatcatgtcctttgtagcaacatggatggagctgaaggcaataatcctaagcaaaataacacaggaatagaaaaccaaatattgcatgtcctcacttatatgtgggtgctaaactttgagaacacatggacataaacttgggaacaatgggagcaatagacactgtggactacttagagggcagagggaggaaggaggacatgggttgaaaaactacttattgggtactatgctcactaccggggtgcaatatacccatgtaacaaaccttcacctgtacccctgcatctaacttaaaagttaaattaaaaaatataaaatgaaataaaaataattattctattcttgcaccttctccttctggttgaattggtcaaaggcaaataagaatataatttgactccatttagttatgttaactgttttagaaaatacaatagttacccaattaaaatctactttttttaagacgagattaatttaagtcagaatatgagcctatttgttaatttggtcttatcaaatcatatcacagggcagattgttgctcaattctggcttgtgattgacttgtctctggctgaaagaatctagagacgcataacttaaaaactctaacggaagaagatgttactaattaattcttcaaactcagtatacatcacttaaacaatgtattattttacaatattaaatgcttatttttattattaacattattctctaaattctatgtctatcattgttttagaaatttatttttaatagcaacatctgtgaactataaatactaataatatgttgcaacataggattgtatccatacatggaatattttgacagaatacactagacacatctagacaaacttgttgttcaactgacatagttggtcaaaagtacaagcttggctgggcgcagtggctcacgcttgtaatctcagcagtttgggaggctgaggtgggcggatcacaaggtcaggagttagaaaccagcctggccaatatggcgaaaacctgtctctagcagaaaatacaaaaattagctggctgtagtgcacatgcctgaagtcccagctactcaggaggctgaggcaagagaatcgcttgaatctgagaggcagaggttgcagtgagccaaggtcgtgccactgcactccagcctgggtgacagagtgagactctgtctcacaataataataatactaataataataaccacaataacaatacaagcttataactgctcagagaattttgatttatacaggatgccagttgaatgttgagttagttttccccttttcaagtgatgtcatgttttatcagtttaatttatcaagacagtcaatatgtatgttgggaaaagcaataaagctctcgttactgaataaatatcactgggacgatcaaagctagagtaaaatcctgggtcaggaacaccaaccacaagattcagggagcaatcagatttcagaatgtgattaccaagctgggtcagatgtctggagaataggatctggatgaagtagatacggaaggtgtaagtaagtttgccaaactaaaatcagaataatgaaagtcatatttagaagtctgagggagccttttcaggctgctacagggatagggaggtaaacaagcaacagaaaaaaattaaaatgcctctttggaatgttaagtagcagaatgcccctgttggtgtttcctgccacacctgacagtgtggcaaattagcttatacatttttgaagaattttaagaaatggaaatattgcatatgagaacgcacagttagttaacctctctgatatggcataggaaagaagattaaactacgtgaatgataaagcaaggtgctctccatgtaaactaacttgtaaaactgaccactcccaaatttgtatgtttttattcacactgtgatagaacaaggtaaatctatggtggaaggatggagggggagaaagaaacattacaaattgatagggaacattttaactgacaatagttgctatacctaatgtttctattcatttatagtaattgtaacctacccaaagtcacaaagatggtatctgacacaactagagttggttattgaaagatcactgctacaggcaaggcaccaagatgcctcatccaagctgcataatgattcagtaattcccttgaagaaagttagtaactataaaaagaaggtaaagataaaatgtcatttctgacttccagaagccccagcagtaatatactttattatatactgtatgtaagcaggaaataaaatattataggaattgtgaatattaattaaccacatcttcatagagtactcagaaaagagtttctggaagatcaatggttccaaacagattctaaatgatgatggtttaggaaggtggagagacacattcaatattttatgcaaagccaacataattttatataatattttatataatacttgttgaataaagaagaatatggcataaaattgaagcagtacatcagaataagttaatggagagattaagattcagactaaaaattctgggtctagttcagtagatattgagatagtaggatgattatgaagagcgtcatatgaagaagtactatacaggtttgacttatgaggtatggagttgtatatatttgatctaaatctcatatctaccactttttagctttgatcttaagctattttacattattatgcattataatttctcatatttaaactcagattaatgaaaatatttccttcatattacatggaaatatgtaatatggaggattacatggaaaacttcatgtagcgatctaatcatggtgcttaccatacatttaagaattatctatttattaaacaaatatttaagtggctgctacaggcaggtcattttgttattgttatttttataattttaatattatcattactcttattttcgatattgctaataacttgaggacgtttatggcaaatatatttaggctggatgaagcatcctaatcctggaggatgacagttggggattgggaaggaatcagtgagaatattcaaatgtttctaattgaataaatttatttgcttatatggcttttatttatgatttatattgtccttatatataataaataaggtgtgtgcatatatatatatatatatatatatatatatatatatatatatatatagtgtgtgtgtgtgtgtgtgtgagtgtatgtgtgtgtatataattcaggaccattataaagagaaaaataggccagtcctggtgactcacacctgtaatcccagcactttgggaggcccaggtgggtggatcacctgaggtcaggagttcaagactagcctgtaaaaccccatttctactaaaaatacaaaaattagccaggcatggtgtcacgtgcctgttgtcccagctacttggtaggatgaggcaggaggattgcttgaacctgtgaggcggaggttgcagtgagctgagattgcaccactgcactccagcctgggcgacagaatgagactctgcctcaaaaaataaataaagaaaaatgagagagagaaaaacaatttgcaaaaatatctgtaataaaaatatttgagaattttaagcttcagactttgcatatgtcagtgtatcatctgctctgcattaattttatgtttgtatgtctgacataaaattttacataaattttacgtggaattttacataaatagctttctaaaaattttctgggcctggaaacaagatttgaaattgtagaaataatgagtatagtgaaaactaatcatgtaaatatacagtagataacaaaaatgatggaacttgtgaaatccaccaagaaaactatgctaatgggttctcattaacactcaaattagattacctgacctctggtttctatttgtaaacttgaatctctaaaacataaagtggccaattcaacattccagccagtatgtaaatcttataatgaaaataaaatataaaaatataaataaaataaaaaaatataaaattagtttttatttttaaccacttaaaaactaaagatagctgaccggtaatcacctttatcatcccattagaagcacatagtaaaaaataagtaattaatgtaatatcatgccctttggtatacagcataaaaaatagaaataaaggggtacatcattcataagcctcatattttatataaattgagcttcttacatttttcctttcatatactccttgtcatatatgtaaatataataaaacttgaaagtttaacataacttttccaatttgacatagaaaaccagattaatatttatgtttgctgaaatttacattctgtcctttcaaaaagtgatgtaaaatagccttataaatctctctctctttcacacacacacacacacacacacacacacacacacacacacacaaacacagataatatagtaggaataagaagggtaagaatcaacagagtaaaaagacaaccaatggaatggaggaaaatacttgcaaatcatatatgtcataagggattaatatccaaaatatataagaaactctacaactgaagcagaaaacataattcaaataaaaatagataaaggatatgaatagacatttctccaagaagagatacaaatggcccacaggtatatgaacagatgcttaacatctctaaaaaatttttaatattaggttttggtgcaatgatacagctcagagatatggatatacagtataacccaaaggaacgtttaattatggcttttcttcattagattttggtgttcatttcatataaattatcaaacatattgatatacatttgtttatgttcttcctcccttagcctcttaatgtctcttttatttctgatatttgtgatttgtacattctcttttttgttatgatctatctggttacaggtatactatttttgctgatctttccaaataactttattttaattcattttcctattgcgtttctgatttatatttcattgatttatttctcatttatttctttcgtttaaacagaaagtttaattcaagactaattttttagacctaaatttatttttccagtttcttaatatagaagcatagatattatattatttcttgtatttaaatttaaacatttaatatgatacattttagagttacttttatgtttaccatctagtgctccttattttttgggtagattccaatttctatctgttattatactcgtgctgaaaaatgaatactactactagaacaggccttctgacattaaaatctctcaagtttttgccagtttcttcattttcttttcatttttgaaagatatttccactagataatagactgtgggatgaagtgattttattttagtattttcaacatatccaataaataactacattgtctttgtcttgcaagaatttctatctttttatctttattcttctatatgctatatcccactcccctgttttccccacccttgctggctttactaattttctcttggtctttcagttccaacaatttatcaatgttttctctaagtgtttgtgtgtttttaaattgttgtgggttttttgtttgtttgtttgtttgtttattttttcctgctacatagtgttgtcttgggttcttggatcggcagttttgtgtgttttgtttttggctttcattgattttatgaaattcttgatcattttctgtcctattgctcttctcctctaagaaaacaatttcatatatgttataacatttgatattgccctatagctgttagatattctgatttatttattctttgtttttcctctttctgattcagtttgtagaacttcttttgattcagattcaggctcagtgcctcaactgtgtcgattctgttgatgaattcactgatggaattttgaaactctgatgtcatgattcttatatgtagctattgcttgaatgctacactttctataaaggtataatgtgacataatctaatactcaattcctgtcaaatgtttggttaaattcttacattcattttggggatataaaaagttaaaagaggacaccggttctgacaaccagtgagaaaaagctgaataatctacaaaattataactattattcaacccatcgaagagctgagatcacaaggcaaacaaataaatcaacttccccagtatgtcactttgaaatagcagagatccagtcacaaggaaacttagcactcattcacaacttatcttcttatgcctccactggatgctttttagaaggatttggggtgctggcatgaaggaggtaactgctgagggatcattgggaagcttgcactacttttctagactctcatatgaagcaaaatctttatgttactgggaaatgggaaacaaactaatctccacaagcaaggcaaaattccactgcttctgaggtcaaaatgtaaccaaaaacccttctgtctctggggtaggcatgctgcccatgggatttaatcaaagaaatgttaatgctgaggaagggtaaaagaacgtacctcttgtgcctgaaggagaagtgagaaatcatctggggctcaggactctgcattctgcaagcacaggtctgataatcctggggaaagaccaggaaactcccatctgtttaagaatgatcaaaaataaaggcaaggtttggcttctttggggaatagacatgctgagaaaactctactcaaggagtctcatgaccctctctgtgcttgtctgaaactgcgactacagtagaacaacagagcctacccaatttataccaccaatttataacacaagcatacctagtgatagtacatttcccatagtattgctgtgatgattatattagacaatagatagaaaacacagtgtataggtgggtaagtcctcagaagacattactacccacaaaaatactccctatgagtaaactaaatatgaaataaatatggttgccccttctactgtaactacaaacagcaataataaatatgcagatttaggaagtttacattgcactctatggttgataacaatataatttttttaatgaagctgttttaacttaaaaactcaacagaaataattatattcattcagatatttttaaaacatccatgtcctaaatgttatttaagaaatcaaaatacatcaaaattatataattagatacatcaaaagcatatttagacacacatctcattgaaatctcgattttgtaacaatattcctcaaaattattgaatgcttttgattggtgcagaggaatatttccatgtaacaacaataataaataaaatcatggtacaagtttaattgtctttgattgaacaatgatgaaatgattcatctaatttgttcattattgaaagtaaataagggccgggcacggtggctcactcctgtaatcccagcactttgggaggccaaggcgggtggatcacctggggtcaggagttcaagaccagcctggctaacatggtgaaacaccgtctctactaaaaatacaaaaactagcaagcggtggtggtgcgcgcctgtaatcccagctactcaggcggctgaggcaggagaatcacatgaacctgggagctggaagttgcagtgagccaagattgtgctactgccctccagcctgggcgatagagcgagactccatttaaaaaaaaaaaaaaaaaagtaaatgatttcacttagagtaaaagatgactgttcttctgtgaaattcatgaaagtttaaaattaaggaagtctttgcatttttggagctacttctttatatgaggatgtgttccaaacaaggaaactaaaaatatgtttccttaaaatcaaaagtacgtttccttaaaattagtcacagggatcactttttaataaaataacttatttaactgtagtgttgttgaggaagaatttcatttggaactacaaattctgttactcatgctttatagtaatagatgatatcattaaaactttttggctctatgttctgtattcagttaaaattaataagatagcaaatatatggaaatataatctgcctgtttgtaacctttatcgtattcaaaattaaaagatgcatttggatggtgtaggtttgtgagaacacagaaatagagttagaagaaaaaattataggtatctttattgatttgtaaaacctggaatgccagttttcttatgtgcttgtaatttttgttcattttatgagcccttatatagcatcctgctctgatcagtttagtgtatttatcattaggctttattaagctgaacagcaaatggacaaatgctttattgaagtgaatagcatattgcagccattatgttcccaagatgatttagactctggatagttattttacgttggtttattgttctcacctccattagacactataactctatcatattgaagaagtagtgtggaataattaccgtggtacattcattaacatgggaaaaaatgaaatgctgattctgaattcccagtatgaaatcccttattgaaacagttccatctcagcatgagctttatgggggatttcataagaggccgtcctctccaaagtccccaaataaagcatctggggatgattctcctcaaattctcctcaaattcaatgttaacctttaagaaaaaccagaagaaacaaatttaaaataccaacaaatgatgcctgttttgcatcattaaccgtaagtgttcacattgagaaatccatacaattgaaacataaaatctagtatctatctaaaaataaaaacaaaaatagaatggaatgaaaaacacatgcaactggagttattaagctagtattgctcttttgtattttatctttctgtttacttataatttctccctattgcacaataagcaatttatagtaaattgtagatcttatatatcactgcattccagccacctggcatttttccctaacatattagcccgataaatatttgctgaatcactatttttgaaaataataaatggctggataagaacatttatttgtaaacctttggaaggagactttttgaatgaaaagtctaccacatgcatatatatgcatcttgcatttgtgacatcttggttaaggggtcttagataatatcagctatgcttccagttccacagtttctaagagctccggtcctgttttgtgctggatattgatgcttttatcttctgctataactgtatactccccaagtctaacataagccttcttgtgtacttttcttattgtcatcaggttagctcagttctttatcacttccaaattgtttaaagtaacaaattaacaactgatatctagctcaaaaacattggtgttttactacattctctttcccttgccatttgaaattaatgatgcaatgacttgtgccatttcttattaaactgattttttttcattgtcatgtttcacatttgtcttgtatatgcctcatggatagatggaatttgttaataaatagctgtttccttattgggtgtgtgtgtgtgtgtgtacatgatgtcaacagaataaagtaattcattttcaatattctatgatttcactatggataaacataaattatgattaattgttctatggtttcttcagtggatgataaaagcattaccatttctaaacatttctcatatcactttatagagtactttttggagatatgcattaatagttggatcaaaattatttaaaccacttcagtaatgccttttccaaactgtgcattgtacatgttcctaaattttgcacaggatacaaaaatgaatgaaaacattttctgtgaggatgggctttccctgacatcagtctattcccagaatccgaatctttagtcattcataagcttgcatttttaaatattattttagttatatctatcctaaaaggctttgtatgctcatcaggacaggtattttaaatgtggaagattattctcctattaaaaagtaaacagagtctttgaatctagaaagggatcttattaaaactgttgttttcctatgagtatattctggaaagaaagactctaccgaactgtcaagagcaattctcttccttcactatttggttattatatatggttagaagattctttcttggtaaaatagtctcaagattttaaccgtccccaatgttgtgcaattagcaaaagtgggacaattttttgacaaaatgatgtttattacatgtgtaaacatttagcattattctgtaatcaggcaattgtatagatacataagagcatgtatcattctgagttagagcaaggattattttgtagtgatcattggttagcatccacatattccattagaacatcctttcagatattcttggatagagaacagaaccacatttttatatctacaaagcctttatgtagtttcagtctatttccatatgatatctgaggcatagatattccatgtttctcagagtaagtggtatctctgtaaacacagaatatgaagctcaaaggctcctaggaaccaacagcttttaaaatgatgcatggcacaataggtattaaggagtcatatctgaaatccaccaaaaaaattttattatcaaaaacgtttaaaaggttgcataataactaagtaaacaatacccagggctaaatggaatacagttttaggccaggcgcagtggctcatgcctctaatcccagcacttttggaggcctaggcgcgcggatcactggaggtcaggagttcaagattaacctggccaacatggtgaaaccccgtctctactaaaaatacaaaaattagccaggtgtggtggcacatgcttgtaattccagctactcattaggctgaggtcggagaattgcttgaaccctggaggcagagtttgcagtgaactgagatcatgccactgcactccagccgggggacagagcaagactccatctcaaaaaaaaaaaaaaaaaaaagaattgaattgaataaagttttaaggattaatgttactatttcgctaagaaaaaagtggtttttatcctagtcactctcctaaaagagggcattataaaactattctattaagtcttcaagaagcacagactcccgactctacaaattccatgaattcagatgtctttcaaaaatattcttatttaactttcttccacctgatacctatgctgggtaatgcatcaccatcagcttagtagctgaagccagccagaaatcatagtggacaagagagacatagcccagcactcataaaattctaaagctacttcattctccacatgaatgaaatctttctgagactaaccttcaattaatgacggagtgtgtcagctgctctaaactcaagtgcagcagcttagaggtgtgtcttgcatccttgtgcatcactcacatttctatcccacacactgctgctaatcaatttctaaaataaaattttaaatctaattatttcacttcctttatttgtctctcattgactcccgttggccttaggataaagcgtgattgccatggctaaacgctcatatttttgaaatctagacttttctagctatctaatttgtttaaattattgctatcattttgaacagtttgaccttttttagccttcagctgtttccaataggagaccactagaaataaccatataaagcaatcagttaaacactttcctcaaaacagaagcatttgttagaaaacatcacatacattgacttaacactgtctttttagtttacgtataagacacaatatgatttgaagaaacaaaaagaaatgcagacaaagacaattagtattagctccttgcacttcagctatttaactattattttttacatttttgttgcagagccaaaaagttactgtgctatattcattatggtatccaaaattatctgaaaccaattacatctgctattgagaaaatttttcataattgctttgcctatattaccaagatttttcttccccataaaactctattatgttgatgtgaacatatatttgtgtctgtggaacttggtttttttgtttattctttggagagagagccattagaaatttataaatttaatggattctcctttttataaattcctagataggaaattactaaattactaaaaaattttcaggaaaattttttagtaatacacttttacatgtataaaggagggaattttattcctatgtatttagataaccaggtcattagtattagaattagcttacattatatagacacagaaacatttagtgtgtttcttattttacatgtcacatgagaaaaataatattgttttgataatattaattacaaaaaacttctgcatgtatctaggctttgttttatctcatttatattcacaaatctgtaaaagagagttgggcaaggttaccaggataacaagtaccagaatcaagtctaattctgctgatataattgctggcacacataaacactgtactaaaatggctctgttgtaaaagatttgccaaatgtgtattttatctttacatttgtagtatgtttatgcatttcattttttcattgtatcagtaatatttctaattttactaaaaaaggggctatgtacacagtagccatttagtacatttttagtttggtgcaaaagtcattgtggtttttgccatttttaataaaatacaaagaaaattattgcttaaaaaataatttcactttacattttcctccattgttagataaaaattatgcagtgaatttctattacattttatattattgggatgaagcacaattaaaattccagaatagagaaaaattaataaaaatattatcaaactttgttcaaatatacagaaagtgaaaagtatttaaaaatcacttttgtagtagtagagaaatgaaagcattcatgtggaatctattataatgtgtttccagtcaagcaaaaccagaattctcctcacgagagagtgtctagatcaaagaaactgcttctttcttcagtttcttaaccataaaattatctggaatacatttcaagctccctgtgttcatataaccttcccagtaggtttattttacctctgagcatctggttattggtcactgagaagaaactatttcctagaatctagggctagtcgctatgggggaatactcaacatacacaatagcaacatagattccctgttatacaatgaagaaataaggtagaggatctcttgtataaacaggtagaatgaaataattttaggtggctaagaggatcacaggcagagatgctgataattttaggttgccatagagacaattagcaggattgacacaattatactgttcaggcataagagtagaatgttggaagttatacagaaattaagggaactaacagaaatgtaggcaagattgaatgagatccgggtacataagcatcatggaggctgaatgaataatcacagcagcttaatgtaccatttaaaggggatattgattgtttagaattataaaaatataatgtaatataaataaaacattacaaaatatatgaccatatttagagttagttctaaattaaaattcaaagtaattgtgtagggtggtcattttctgatctgagaacctcctgataggtgagttgtggagaggaaggaacatcagaacatattcctatgcttctctagtgagatcggaaagattttagatagtattcaactccatgacattggcaactatacccagacatgcaaacttttgatgcaactatgagccatctttatggctaaataagttatagaggctttaaagtaaatatgtatgaactgaatttgtatttcctcaagacagaaaaaaactactattcctttagcaaaaattattctgcactgattattattttcaaataagtaaagcttaccatgtaagcaccatgtcctttaaattaatgttgaatattttgaaaatgatcctttacaaaatgaattgcaaatttttatttattttaaaaaactgatatttatcctaatttcagaatgactgacacacaatttcaatatatgtacacactctcctttaccttgtattccttctttgtggatgtcagaaatcagtttctaaccctccttctagttataccctacctttgaagatttcagtttactggaatctgaaaacaaaacaaaacaaaacagacagccatacttcttagatcttgtataaatgagcagtaaagaaggtctgagtgaagatttagcagaacttgccttttgccaacagaacttcatgtatctgactacaagtaaaagttggaaaatcatcactaaaactgtaacagaaattcaaggactaaattgaaagagaagttgaagtttatttatggtattctttccagagagattttatagagccttttttcagtctttcccaaccatgtttatttatgttaaattaaattattggagtttttttttagaattcttatagaatatatgactaaaatgaaggataataatataatttgacatttaaacagttttattgtgaaaatgaaaatgaatgttgttaatacttatgctaaaacagtaggcatgaaatgacactgtggctaaccagaagggacatatattcacaccacctaaatatgagacatgtttgttaaaagatcctccagatatctttttccagtgaaattaaaaaaaaattacttaatttatacactttcaaatattgtctttttttcacattcagctgctaagttatttgtttctagttccctaaaattggcacagagggaaacaaatagttaaaatcacatttatcccctattttttaccttatatttatataagaaagtcataaatctttctttagtccttagttcaaagattacttttagtcttcttttacaaataaaagcaatagtttggagagtgggaaatgagataggataactttcctctggttaaaaaaaaatctttgagactttgttgttcactttaatgcttcaaaatacttccaaggcgtctttgaaggtttaaaaaaggatttgtgaattttttatggaatgccacttagtaggtgtcaaaacatatttagcaggtggtatctaattttcattttaatgaagctaatcttttcagactaggataacataaggttttaccatctgtgtgtatcctatttagtttatccaggttggagaaatctgaaagaaggtctgtgaaacaagaagctagatgttgttcaacaccagccttaactacctgaaagcattactattttaaaaattaaaaaaatagagaatacaaattttagtatattagcctataattttatctaaattatatctttgtattcagattgaatgatcttttacagcattacttagaaaggctttacatgtaagacatcttaaaatctagctaagaattttctgaggagacacggtacaaatgtgtttcaagagccagagaattaaaaatatgttgcacttcttcacctttttctctcttgcagatcatcactaattatttccctgcacaatctttttttccagctttgcttccagcacatatttgaattttcctattgacttcttttccactgcttgcaagaaccttttcctttatggtcatatataaatttagtacatatttaaaaattttacgtaaaaggatcgtgccatatgtttgtcttttttatttttggaaataaaaaattatcattgcttttcaaaagtgacttcttaaatcttagctgcataagtaataaatacagctgtaaacattcactatgtactaaaatttaaaaagcattcagaatatcatgagctcagtgataatcaaaaacaaaactaaaaaagaaaaatacttcattgctcaaaataaaatgagatatatagaagaagataaggaagacaagaagggagaagtagaaaagaggttataggtaaaaaatggagagaggaggaggaagtcatcccacctttgcataaatgttgtagttgttgttgctttaagtattattataaggtagcacaaggggaataatgtgattggaattcaagagttagcattagtaaattggtcccaagtcagttcacaattggattgcaaaatatagtgaatttcaggaacttatttagaagaaatctaaaatttattagaaatgatgaagaactttgtgcagtaagagcatatatgtgccaagtatgttccagtaaagggcaattaagggtatatctgtcaattaaaggcatttatatttaaataacaaagctaaaaactgattatgcaaaagataaatttgttgaatacacgaaaaggataaggtttttaattttaaaatatcatttgcttttaaaaataattccttgattatttttaaagttttgctcaattggattcaattgatttaaaaaattaactttcttaatgaatggactaggaataaataaataaaacatgacaaaaattaaaagctgcttgaattgtgagtctatcaggtgcaaacttaaaacatctgtgagactattgtataaatttacagggaagcataatcccatcgacattcagttctataaatgcacaaacacatattccttcagaatgtcctccaaaatatatattaatatattatttaccatgcatacataatcattcatatatagtgtaggtagtatgaatcatggaaatttgaatttatgagtatgccaaatcatgtaggaaatgagacaagaacttatttaggtaaaaaaaaaaaaaaaaacaagttagaagaactgtgaccataatattgtccaattttgtgacctgaataaaaagaaaattagatttcttaaaatcaaatctagggacaatcttaatataagtatttaatagttgtcttacttttatacagatgcatagtttgaggaaataagatacattgtagatatgtatactacctgttttctttacatttttccttttttcttatttttatttgatgaagttattgattacatttcagagctttatatttatcatttgttcctttccttatattaataatcaaacatgtatctcctgtaatatttgaaagaaagagagaaagtatatcctgccctaccaaaactttgattctccagcagtttatatttgatctttggcaagatttctttagaatgttgttatttccttattctgctgcccattcctctccatagatttatccaagttcttttaggttgttttctctatttgttcctaagatttattcaaacaatttaatactttccttcaagataattaatagcttttactttatagactggctcttctatatttagaattattattcagcagaaataaaattccaaatggaagaagctcatattgagcattttaaataaatagtgtaggtaggtgatacaatctatgaatgttttgtttatttatttatttattattttgagacagagtcttgctctatagcccaagctggagtgcaatggcgtgatcttggctcactgcaacctctctgccttctgggttcatgcgattctcctgcctcagcctcccaagtagctggaattacagggacgcaccaccatgcccagttaacttttgtatatttagtagacacagggtttcaccatgttggccaggttggtcttgaactcctgatctcaggtgattcacacacctcagcctcccaaagtgctgggattacaggcgtgcgccattgcgcctggcctatgaatgtttttatacatccaaatttctttcttattcctgacaaataattgatattttaaattcaggattataggatttcagtcctgttctttcattaatatttttcccatgcaacttattattgtggttgaaaagttgacaacaattcgttctctgtcattttttggtctaattcatcggtcttgaagtgtgcaaggttttttctttgtaagtctcaggcattttactaggatttgcttacctgtgtttctttttttttaaatcttttatccagtaacttagtgacccctacctagctgtagttgccaatatcagcattgttttcacactttaaaaaattttttctttcataatttctatttttgtgcttcgttttgagatatttcctccacttgatctcccagcgcaatcattaagatgtcattagtgattcttctgttctcagtctatctacaaaagttaaattcttttaaaaaaaaacatatttttattcacattcctttgagaactaaatttttaaaatatcttctgtttaggtggacttaagtgaaatttctctgaattcccttgttgtttattcaggctggcatctgagttctctagcaagtctgtttcatttaaaataaatacaaatacttgtgtttttacttattattcctgtcttttgctgccattattttgcctcaccatacaccagtctgattgttggaatgctttatgttgctaagccctgaaattggtgggctgtctctggctttaaaagaataccaggtggtatgaaatctttgtccgccagaagccaggagtaatcctgcctgatacctgattttctcagttacaaagctagggcatttctagccttaggaatatgggtgaaacaatggtctagaagctcttccggggccataaaaaccactaggtcttttgggtgatggtttcttaagtgagtattgcatttaattaatcagagtctcccagtactattcaggttaccagagctccctttattttctaagattcattcatgttctgttctttgttgcttatctttacagctctggttctcattctttcattagggcccagagttacgtgctatttttctgaataccaatagaaaccttaggcttatttcagatgctctgccaacccctgaagattcttctctcaggaggggtgttggttaattgaatttgattaggagggaaggacaacaggaatgcattcgggaattctcaatgatttgttttcagaagtatactttaattgacagtaattactgtcagttgcagtaattgattgatacaggagtagccaactattgtgtggcaaggaataaagtgagtgctggccagagcatctgtgagggggcaggttatgccagtgggctcattttaccagcaattcaattccacattcgttgaacacttaaagtatgttctaggcactgtatcaagctggtccatgaaatgatattgtgaataaggcaaggatagtgctttcaatgtgcccacaaaacagggttggcacaggaggaatgaagggaatggagagcatgtcaactaatggggggtttcagctgtgtagtcttctccaagagaaatgcttacaaggtaaagcacaatgccacagcaccatctcattctgccttcttcctctaatgatcaaggcctgtaagctctttagtaacctctctgatgcaggtatcacttcaagcatcagtgaacaaatcatgccagcagcctccagccttaccctgtatgacctggttgcttagcactgccaacaagttcctactaggtcggagtgtactaattagtcacaatggaactgttatggatctatactgtcagtagtgtttaaagtttcttcttcctgcacttttaaaattatattccaaccaagaaatgattgtttacatatatttgagattgtgacgaatatgacaataaagacaaaatcatcagatgacatatgaaacagtttgatgattttgtttctggatataggcatagaatattttcatgaattaaatttttaaacttactttccttcttgaatcatggtaatgtaatattttctctcctttatatgacttctaagcagagtagcttaactaatatatgtatctgtttattaaaaaattcctttggaaattgttgtcaaattatgaattaattagtattccttttaaaaaaataaaagactaaaaaccaaattatgatagttaccacaaagtgagcaagtattttaatttttttaacatatatttctattgcagttttcaaaaatttcttttctattttataagttcaattaatgttagaaagaaaaacatcatctgcttacataaaaattacatgttaactaaaagctgtattaaaaagtgtaattcattaaaggtaatatcaattattctacaattattaggggctaaatgcaaattttcttgagaactgcagatgatttcaactctcggtaatgttgttgccacataaaatataaaatgagtaaagattttaagagtttattttgatgtttcaaggtagtttgattaaatataacataaatacatgcaactacatgatacattagaaagaaatgttctgagtaagaagtctggtctggaacatcgagggtatagtttttatgtaagtgtttttaaagtagaattaaattttgatacaaagatatgttgttatccacccagagttcttggaaatatattacagcagaaataatagtataattttgcaaataaaagcaatgaactaatgccatgtgatttcttttttttttttttttttttttttttttcctatacgaagtcttgctctgtcacccaggctagagtgcagtgcggcaatctcagctcactgcaacctccgcctcctgggttcaagcaaatctcttgccccagcctactgaatagctgggattataggcgcctgccaccacgcccagctgatttttgtatttttagtagagacggggtttcaccatgttagccaggctgatctcaaactgctgaccccatgatcagcccaccttagcttcccaaagtgctgggattacagacatgccatatgattttcaaaagcaaagataaaaaattaaggtttcttattacaggtggttttaaaatgagttccttgaaatgtggataccttgatcacagttttatgtaaacgctttctttctagaaatccagaaagcctgtactaattatgtacatgctatatagtatgtaacaacatgacaataaaaagatagtatcttccattctcattatagttagcaaaccctaaattttaaaaacaatatttctgcttgaatttcagagattgtaatattaaataagtttagtttctcctttctgttttctgattcttatgtaaaattagtttactaagctcattttagaattaagttatcaagatacagcatattggcattgaaaattaccccacctcaaagagagatacaatgaaatcatccaatccaatttagtttacactatggttctatccaaatcccttggtgtcatttccgttttttatgaggtttcctaaaaagatgtcccaatattatttgaagtatgtgattattgtgataatttgataatgtatcactaaattgtttccatgatccttatagctgtgcttctcaatccaatgcatcattcagttgtttgattaaatgccaatgctgtctgaaatgctgtctgatactgagtcccagaacagcatgatttccttcccactgaacatacataacactgtataattttacttttcttataacgcttatagttacaacttaatgccaggaattatttttcctactttataaagctagagtaaacctgaaggaaagtttttctacttaataaagtgcccagggatctctaacagatctattatagaataatcatgaatatttattgagcttaatgaggtagaggtatatagttaatgaagaactggaggagctcaagaagagtaaacctctctccccaatctcaaaataataacagttagattgaaaatataagaaataaaagtatgaaaatagcaataaaaatttatatatcatttcaagaccaaaaatgtgtagtacattattaattgtcaactacgtaaagcagaccataattgatggatgacttcatagaaaagaaaaatcacattagggtgctgatgttgagaaaggatttttatagaaattggaaaagtaattttgatgaatgagtaaaatttccatacccagaagagaggagaaaagggttttctttgtgtatggaataatgtaagcaaagtcatagaggtgtgattctaagagaaatcacatgagatgagattctaagagaaaagacatgagaatgggagaaaaacccaaattcctagaggcctctgtgtggtagggaatattacatgtcaggactgtgtgctacctaagcaagttggaaaataggattcagggtggtggtgataaggagacagctgtagaaaaaatgatcaaatctacagactctttgcaggaatatgttgagattgactccagaagagaatggaccaattgtatttggagttcctgtacctaataaacaacataattttctcatgccgaaggaagttaataggaaatctttttctttcatatgttttggtgcagttgttgagataatttttatcactaataaggttcagcctcttcaactagaaaagcacaactcttcctgatatgcttagggatagatcatgaatatttggcaggcagtttgataaaactcttataaaaaaacagataggttcctaaaataatcacactggctggcatccaagatttcattaaaatcgtaccttttctatcttgcttttaaactgaaatttattttgttatcaaagagaaaacatttcattttgggatatcaaaactttaggtgcatctacatgagccaataatattcagaatttttttccaatataaatatttatactagaaaataaaattgtacttgttttgtaccagaatacaagtcaaactaataataatgggtccaaatattgcaagaaacattttattaattaaaccgtcgaatcatttaaaagagaaaatgtaacttaagatggtgcgaagatggcatcaagtagtagagttaatctacaaaacttgagagcttttacactacataaaccatagtggctttttgaatagcctcataaaacgcagtgtcattgccattctgctcacaacatgtggattctctcttctgcaaatagaataggactcttggagcaatcataatgtaagcccactgaattttctcatttattttctgtacttataaagaatgctgtccataactttttatttttaatggcctggattaaatggcaactttctactgctgacaaaaaggcaaaatcctatgaagaagtcagagtcatatcaagtgctcctaaattataatatagatcttttccctatttttcttctttcttccttcttcctttctttttgcaagttaacatatataaaacacctgttcttattcttaagcatgcacagcatagtgataaaattttgcacagtcaatggtcatgatgcccacgggttagtgttgtaatagataagtgaatttaatgccacatgtgccctttgttagagtctggaaaacagtatgttaggggagtggaggagagggagttgtgaggtgacaaggaaagcttacaagaaagacattgctttaatctgttattgcagatgttaatcagagaagacagtagggataaagtggaagacccagaggacaggactacttggcaggcattctaaatttttgttgaatatatcttttagtgcaatgtatatctttaatcctcagcagagctttatattgatatacacttctaaataagtattgttcacaaaagaagagtgtcaataagttatatattctaccaccatttcctgaaatctctttttatatttgagatcaagaattatagaagctggcatttattatattgagcaataaagatacttcaatcaacattaaatgaaagtaggtatagattaagaatggcagttcttctgcatttgcatattgactaagcacatgaaaatgtatatattgaattcatggactattttaaaattaaggaaacactttggagctttatatagtgataatttgggcaatttagtgtagtagtaactgaattctagaagtacatgtggccaagattcaagggatacaaaatatagcatgcagtaaaaaaaggaaaatcaactgtaggcaaccagcttgatgccagaatgtggtggtgggattctaaatgattctgtgataaatgagttgagctgctttctaggaaattggagaggagaacaacaatagctttctggacagaactttaagtgactatgtgacacaatatctgtatggtcattcaaagtgtcatggatgcataaaacaggttgtattaagtacaattttaagcaaatgtgaaagagggaagctgtttttagaaaagaaatatataataacattttattggcatgagcaaaataatcagaagaaacattgatggccagttgattatattgggaaaagtttgtcatgactatgaagagtactgaatcttgttgaatgtctgagcacatgacagcttgaaaattgtcttttttttattagattaagagaaaatgattttctggcatgtattctcactgtatcccttacctatatacgataatacatttctatccttttcttcttgctttgctgaaggcagttattaggaattggagaatacagagcattcaggtattcccaaataatatacattcacctcctttgagacaataggttgatgtggtatgtgtcttcctatttctactcaggatataacagaaacaaaaaggtagcaattggcgtcatcagtttctgaaaaaaatctttcattttttctaatatgtcttttatttatcttcttcatcttgttctctatttctctgtcagcctcctgtgcttctactgctaaatggattatttcctctaatactttagcatccctgcctcctgctcaggctatgtcactttccctccctaatttcactgcaaatctctttgaaaaaaagcagtctactttcactatctctattcttcactgtcaattcatgtgttaatttattacaatctggcttccttctatccccagcattttgatgattctattctgtcagaatattgtgaggttaatgtttttgatagctttacatgcagtatttcacttcagtcccctttgaagagtgtcatatatttcctgcagggatatttctttgaaactacagagcatatcacagctccttctaagatgatacaccacttggatgtcctgaaaaaatctcaaactcaagacattgaaaatgaaaaattatattatttcccactgcctactccactgctactaatgtgctttctcgtgtataattgtgtgtgtgtgtgtgtgtgtgtgtttgtgtgtatgaagggcatcactgtttacttggtcctcaatataaaacctttggaatcctctccctttcactattcctcataacccctatgtagttaatttctgagtccagttttttttaattgaataaaaatttaaaaaataaaaaatcagtacaagagctacttctgtaaaaactctcaatattgtccttatttttatctatcttagcagtgagtacttaatatctttttttcagtttttccttcttcctttcctcttttacctgatgcaatagctttataacagtgcttcttgcctcagttgcttcctggcaaacaacatataacactcttggaatgtgagtctcaggtttccaacttcatctcaagtcattcttcaaggtattctagtatgtgctaaattcacacagcattagtgccatgtttgtagcaagccctttcatatggtccatgctttgggctgtgtagcctctattatgtagaatacccttccctggctttactgcattgtaaattccttcacagcacagtacaaaaaatccacttctttcataaattatttctgtcttaggcagaaatattctattttatttattttagtagcactttttgcagcatcatattttactggaaggtccttatgtttctgaaactcaaaatagactatttttcctaggaacagtatttatatcttattctttttgtaaacacagtttttgaaaaagtgtctggtacatagtaggaattcagaaacagttgttgtataaagtactttcattatagcacttattgcattccatttattgattcaattaacacatattcattgaaaaccttctacataccactcatactacaactgtgagtggtatgtagttctagtgcttaaggtatggcagtaaatacttgataggacatattctatcggtaaatactgataggacatattctagaaggggataagggaagaaataagtactatgaagaaatcaacgaatggtatattttgaacactgacagatctaagtgttattttaggaagggaggtcatggaggcccttactgaggaagtggcattcagttgagacctgtacaatataaaggagcaaagatctaggagaagacactgagaaagagcaggcacaaaagccggaagggagacataagtataccatgttgtaggaatggcaagaagacttggtgtttggagaagaggaaagaaaagttctagaagatggtgcgagagagttggatcttgtaagtctgagtaaggaggttggatttcattctaagcaagatgggagaactttgggagatcttgagcagggaatggcagacaatactttttttaaaggatgcctgagagaggaaagagtttaagtggagagaacagttaggaggctaataaaatccccagttgaaataactgtggtttgtaccaaggtagttgctgtagaggtgttgagcagtagttagatccaggatccattttgaagatgtattacataaaaataactcaggaggcttagacgggaggcacacttgagcccaggagtttgaggttatagtgagctatgattgcaccactgcactatagcctgggcgacagagtgagaccctgtctgttaaaaaacaaacaaacaaacaaaccaaaaaagaaagaaagaactgatagattggatttggagttgaacataaaagaggagtcaagaataattactgtgtttataacatgagcaataatataaatgacgatattattaaaaatggacaaaacttcagaaaaaaacataaccattagtttacttgtttgtatctccaatagaatatgaactcagtgaaggcagggctcttggcttattcttctttgtatctttaatacagtgcttagcagaagtagacacttaataaaaagtgatcatctctggatcttaatcagcaaacaactattggcactattctcactttttaaaaaattatctttccttcattcactcaactgatgttattgagtacctactaaatgcactgaggcaaaaaggatatattaatgaataaaacagacataaatgcttgttctcatggaacctatgggtttataatccagtgagatgatttctatgatataaaactaaataaaatatagagtgtattagattgtgataagtgcttcagaaaagttaagtagaaaaaggacattgaggtagagtagtggcattgcaaattaatagagtggttgaaaagggcatttctttggttaatacctttatgaaatgagactttgagataattaagtatttgagtaaagagcattgtggctcaaggaaacagcatgcacagaagctctgagatagcagcatgctcggtatattgtaggaacaccaaaagcccagtgttgccagatcatactttaaaaaatagagcagaaaaatgtgcattccaagggataagggaaggccaaattatgaaaagccatgttggctactgtgaggattttgacttttactctgagaaaaatgggaagacaactagagtttttcagcaggctaatgtcatattctgacatatactttcacagaattcctctggatactgcgttaataagagactgtattgggttggaagggttgaggggacagaaataagcaaaacaacagctacaataatctgagagggtggatgcccagtccaaggtggtaatagtgaatgatagtaactatggtttaactgtggatatatcttgaagtcagaatctatagaactttctgataggttgatttggggcaagagagaaaaaaagcatataaggttttggatctgaaccagtacaatggatttgtcatttactgagatggagaaatcaatgaggaagatgaggagctcgtatttgaatttgaacctattgaatttgagatatccattagacatctgattatagacagcacagaggagttttccacataaccctgaaatacacattgcaggctaagaagtgtccaggctagaggtatgaatttaggagtaatcaaattttagctatttttcaagtcgaaagactgggtatagtcatcaagggtttgatagaagcaaactctagggaagttcaaagttaagaaatagtgggttgtgaggaaaggagaggggaagatggagagagggtgagtacaaagttacaattagatacgaagaatacactctagtgttctattgcacagtagggtgactatggttaacaataagtcatagtatgttacgaaatacgtaggaaagagtttggatatccaaactacaaataaatgataaattcatgaggtaatggatacccggattaccctgaattgatcattagaaagcatatatacgtattaaaacatcaagccatatcccataaatatgtacaattacaatgtgtcaattaaaaaaaaaaaaacagtggcaataagaaggaatccagtaaagagtgtgctttctaaaacaaaaaccaggagcgtgatgtcttagaagtcaagtaaataacatacttaaatatggataaagtgagtaaatatgtagaatactgagagtttggcttaccataagatttattgtctgttttagtccttcctgtattgctataaacacatacctgaggctgggttatttacaaagaaaaatggtttaatttggctcattgttctgtaggctgtacaggaagcataatgctgacatatccttagcttctaggcaggccttagggagcttacaatcatggcagaaggtgaagagggagccaacacatcacatggcaagagtgggagcaagagagaagtggaggaggttctaagcccactttaacaactagatcacacataaactaccagagtgagaacacacttatcaccaaggggatggcactaatccgttcatgaagaatctgcccccatgatccaaatacctcccaccaggtccaccgccaacactgggaatcacattttaacatgagatttagaggagacaaacatccaaatcatattatcatccaatctggtacacttctgaaaatgaaaggggtcactattagttacatctaaactataaatacaaactggtactctttcaggaaacctggaatatatagtcaccaagtgacatttcaagtatgatgaagactgataaataatcgttgcattcagcactgtagagatcttgattaccttaagaattaaaatattgttaaaatattaggattaaaagtctagttgaatcagttcaagagaggaaggaaattggagatagtaggaacaagcaaatcaatgaaagttttgctataaaaattaagtggagctgaaggaggttgtggggaaaagatgtttggttttaattgaaataaaatacacataatgtaaaattttctagtttaatgattttaactatgtgtggtagagtgacattaattgtatttttgtgcagcaatcactaccatccctctctagagactttttattttaatgaactgaagctctgtacccattatatataatacctcagtctcccatcccctcaactcctgacattcaccattctacatcccatgtccatgaatttatccaagacaatgaccattctatttttttttttcttatgtaaggtactgtaggtactttactcactgtggatacctcatacaagtggaatcatgtagtatttgtcctttgcaattggcttatttcacttagcatagtatcttcaaggttcatttatgctgtagcatgtttcagaatactcttgcttctaaggctgaataatatttcattgtatgtgttataacatattttacttaccatttatctgtctatagacatctgtgtggctttcaccttttggccgttatgaataatgctgctctaagcatggttgtataaatattcattcatgtgagttcattcaagtctctccttttaattcttttggatatatacgattattttaagacaaaagaaattctaaaacatagtaagctttctctatgtctgtcagccagtaaagaatctggaaaagagatgaattatttgtcactatgtccagcaaatagctccagatatcatttaggaaggaaaattacaaacttaaatgacaatgagcctttataaatgctttaactaaattaatattttggggtcctaggtaggtagaggtatacactatgattaataataaagcatatttattgtctattcaaagttctgtttcattgcttggtgcctacaccttagttctgtgtgttttcagaatctaccttaatagatattttagcttatatctcaactggcaaatcatatcctgttagaagtaagaatgggatagttttatttgtataaccactaaagattgaccctgagaacgtaattatatagttattctttttactctgcctcttttttagttggctgtaatatttttgaaaaagtatcattttaatagatgtgtattgtggttgagtcttaaagttttaacttactttgaattgagtgagacattgagtgaacacacatttgtgaatatatcataaaacataagtacaagattaacatatagaatggctcctagagaatactttagcaaatagtgtaaacagcacatttgcaagatttttatagcaatgacaaccttcctaaactggtgtgtactgtattcgtgtatatggatttgtatcattgttaattgctgtgatctttgtcaataaaagctgactctttcttaattaacctattgcccctatcttaccaatagcatcagttagacattacaacattattattcaatacagtggaacacattttgtcacaggattctggcaccttgaaattgatcagtacaagcaggtttactagagaatgaaaaattttggccaagcttctgtttctatcacacaccatgttctgcttaattctgggaactctatgcacattgacaggagaaagtttgagttcctggagtattgcacgttcttgtttcaaaggtttcaaagtctttgcacacagggccacctttactcaaaaataattcctcctctttgcctctatttcaatggtgaatttcacaaagaagtatttttttgactgtatcctaagttagctccctcttatacaatatcatagcacaatgtagcactctttcctagtacttattatcattgtaactttacattttttgtatggtgatttcactaacctctgcttcacctacaaaactgtcagcaccatatgggtagagatcctgcctgctttcactcaatgctgcgtccctcttccttgcatagtgctggatactgtagtctgtactcagaaatatttattgaatgagttgaagggtaaataaatgaatgaatgattgataaagatctataaaggaaaactattttgaaatatattttatgtgagtttaatgtactgtgtagacctctaattagaaagcatagcatagaacttggttaccagtttcttcaggattttgaagacgaattgaacaataaaaagttaagagctgatatcaaggacctaagctgtattttcatttcatcaccttgaattgaaactttggaactgtgggacatggaaggaccaacaatgggcaggcatttctcaggggaagactataaataaaaaacatgaaaagggtttgttgtttctttactaaactgcttatatgagccaactgatgagttctgttttacccataacagccttaatttcacatagacagcattatattattgatccacatattttattgtattctgaatctgtcatgttcaacccttatgtataactgtaatttgatagtacagcttattttataaatcactttataatcactttgacagcacaagttactttataatcccaataaacttgagatatatgaaagtttattgaatttattattgatagtgtgaataagaaatcatttagcacttctatgactcaggtactgatttaggtaatttacatacatttttagtttttaagatattttacatttcattttcaactaaatgaaaagaaagtctgctatttccataggctgtgaaaatctaatgttactatactcagtcaagtttaaatagatatactgttactaccactgctagctgatgtgtcctcactgacttcacaagttttcacaatgaagaatgatcatataaaatcttagatctttctatgaagaattacacttctatagcaattggtatccatatagactatgtgacaaaaaggacagaagtggccactggtcatttccacataatacacatgttaaaactgtactttgctctatggctgctgctgctgctatttgtaaaactcagctctgcttgaatccctgcctcatagtcacaaagcctgccagactcctttgatcacaaagttaccccatgcctgcagccatgctctaagttggtctgtctgtttctcttctttctaagcagtgatattagaggttgtggctcagtatgtgtataaagtatttcttcttcttacctttttgcaattgccctatatcaggtctccatccagcagcggattggattagtgattctccacaattgccctcaactatgcagaaataccaagctgagggaagtgcagtttcttcttgacatagtcgatacatataatgttgttatatttttatattgacgtgatgacttagtataaattatacttcatttgtagtttttaatttcatttctgattccactatgagaatgaggaaaaattgctaagctatattaaaattctgttgttcaccattttttatttctgttcctacatagaattcaccattgaaatccaattaacacaagtctttaataaactgtgatcactgtagtgcccgtcaccttgtttcttaaaactaatcttctaattaaactatcaactaaaatagacaacataaaagacaataaattatttccattgaattataaaagattatattgaataactatatgtttttcctctgggatctattttttcacttgttaatttattacaaagaggttggatttcagctcagaagaatctcatttcctggcaattataataagagagtattccaaccaatcaagaagtccagtgattttattaataatgggtttatcctatgtgactagttcagaggccatcagataactttcgaaagttttatatttgttctggataaaatctaccttgggtattgtagaagtatattcacacaaatggtacagctgctacaatcttgttatttatgtgatatttattgagtacctactaacggttgagctttgttttaaataattggatacattctgtgattaacagagaaaaaaagaatattgttcttttgtttgtcgatgttacctacattttgtgactttctacgaaggcaaattattctgacactagtttctcacttcatttgtcagaatgattaacatttttacatagaaagtagatttttttaaaaaattgatagtcaggctcatatggagagtcctgcagaccccaaaccactcaatgttgccttccttaaaccatgttactttatgtttttgctagaaaattatcgttctgtcagatacatgtaaaagaaaagtcacacaaggcttgtagttgggatctttctgttctttataactcaaatattttgtttgaaaattatgtggaggaatgcttaacgtatgctgcagagaatcaactcaactagccctaaagggaaagactggctagtacattttgctttgttaaactttatttgatggtaagatgcagttttgctataacttttgaccttttggtttataatgtcattcatgttgtatatatcctttattctataacaattctttgaattctaggagtaactttgtaggcaatcaaatacttaaaataaccaacaacttctttactataacatcattaaaataaaccacatttaatagtaggcaatcaatgatgttcagctttgacccagagttgacccatcttctctagtaatagcaaccctatcgtttcaaattacaatcagttcacaaaatcattttaatgatatcagattggaagaaagccctgtgtggtttgacagctgtgctctatatttaagctcagataaggctcactttaaagcagcatgtctttgtagtcatgtagctccttaatgctgtgacacgtctgtgattctgtgcatcaatcatggcggcagaaaaccataaccttccctaagaggaggtgccaggcaaacaggcaacgagatgagtgttgccatgtttcggttactgtgcaggcttcctgcagtgtaaattcccaatgtcccttcttagctcccactggctctcgacactctcatcttctttataccctttccaggaatacagtctgctcttcttcgttaggttgtgatggtaggtagtagattctttgcctaattactttctttctatggattttattatttataaaaatataatcatagctctgttttcattttaaggatgtgactaataagcaccattaacaaggtggtaagaaatcatacagagagataaaaagagaaacttataaacatatctgggatagttacatattttgaagacttttttcacttcttatagtattgctctttgcttgtataataatgaccaatttgccacgtactggatgccctcgtaggcttacccagcttttcaatcataaagtcagaattcaaaccctactcataataagatcgttcagcaagacggctcctactctttgtagcaaatagtcccaaaggtaaatttaaagtgaaacaacaggaaagaaattagttcctcccatttttttagtcatttgttcatttgctttatttattcaaacactccttcatttttcactcatgatagaatatttcataatgttatctttcatcatatttattgagagctggtaaacaaaaatgaaagtgttcatacctttgaggatataatgatactttgtaagcaaaagtcttggaaagcttctcatattttagatattattctgttaatttgtgtgtgtgaatgtgtatgttgttaaaaaatattaaatatctttcaactatattggcctcatatcttctgtttccttttaacgtatatgaacaaggtcagtcataaatagttgaaccaaaaaatgagtagtacttgggtttaattcagaagactgtgccttcagtcagctacatgaggtagtagtttttaccataacattttccagagttaaaatagtcaatttttaaaaatttctggaagtatatgaaaagtacttttaaggaaatgttccaaatattaatacatctcacttggttttccagtattgagtgccactatgtggagacccacattttgtgtccatatctataaatcactttatcagcttttgaggtctatcaaagatgaacaatattttcagataggcaaaaacaaacaaacaaacaaaaaaccaaaaaaacccactgtattgtaatgcaataacaagattttataagtaacttctagaggtaaagtgttttctcatcaaatgaagaaatgaacttctaaacttatatcaagtagctgaacaataactacttttccccacccataccccatttctacaatcttataatgagtgtgtctgtgcctcccatcttctctctctttctctctcccttttcttctcctactcttcatccccctttttttttctttctctgttatttttttcagagcagatttaggctcttcagtggattctttgcctgataattctccaaattaggagttaaggtaaaggttagctcaacaggcttattgctactataaattaaatcctggccctgccaagatacaaaagctcagaatatacctgcaccaagatccaatttgcttttcacagatttaaaccttacaaggaaaagccttaagttagtgcatttggttgagcactgaagctggttactggtgaaagttaaaagaagtttaaaaatgagaaagacaaatactgcatcattccacttatatgaggtatccaaagtagtaaaatatgtagagagagacagtcaaatggtggatgccagaggattgtgggaggaggaaatggaggattatttaatgggtatagagtttcagttttgcaagatagaaaagttctggaaatttttttttcacaacaatgggaatacacttgaaactattgaactgtacatttaaaagtagttaaagtgtaatttaccacagttaaaaataaagtaaaataaataaatacataaaaggtattgacctttaagaaatagtttattccttttaaatgcagtcatttactagaatattacatggaatctcttcaattatcttcctttttctgaaaatagacaagctgtaccattctttgaagcaaagtattataaactatcttgccacatagtttatcacaagtgatcagttttgaaataaatagcctattgggataaaacatcacatttactttaatccatatgaaatggttgatactggataattttctgacacagagttttgaccaatgtaagaaaaacagaattccagaaccccaaattgaagacaaactatgatagtatgtcatagctggggtgaggaataagggaaataaatatgcatattgaaatacatgtatcaaatttaacctttatttagcttggtttagttataattttaattatttattcaaataatactcaatggcagcataggatggcatgaatttttaaaaaattatcaagcccaaacctgagaagcatttgcctaaaagtcactaaagaaaaaagtcatttaattcataattttgctaagggaggaattctacccataagttattgtgaagaacaaatgagatatgccattagtaattagatatttacctgctataatatctaaaaattaccctacctagaagaaatgtaaagttttctttatttcaaagttctcagaatctaagtactaaaaagtaattcacctagaaaacgtaattttatgtgcaactacacaggcacataaaggccatagtcctaataccatgaattagagctcttgtactgaatccctctgggtcttcagagaaccataactaataggatatgcatatatatatcttatatatgagattatatatatatatgtatgtatatataagagcgagagagagattgctttattataggaaattggtttacatatttataaaaaagaataagtcccaagatctccatttagcaagctgagacccaggagaaccaatggtgtagtggtttcagtctgagtccaaaggcctgagaataaggagagctgatggtttaagttacagttttaacctgagtttgaatacaggagaaaactgatgtcgaggctcaaatagagtctaggcagaaaaagtgaattctctcttactcagtcctttggataaggtccacccatattggggggcggaatttgcttttctcagtctaccgattcaaatgttaatctcatctagaaacaccctcacagacattcccagaatagtgtttaaccaagtatctaggcactccatgaccctttcagtttgacacaaaaaagtaacctttacaagtccaccctttgtcaacttggcacccatatgcaactccttaagtcatacttaatctccaaatgaaggaaataagaagttcataatttttcctaatatgatacagctatcctgtgtacagttgaaaatgtactaaacccttccccagaagaggaagtagagttcttgattaatgtttactcttcttcaggataatgtaatattaataatacttaaatattagaatatgaagtcaacataccttatgttacatgatgaggaaataagagaaggaagaaaacaaagatattttctatacacatgaacatattgataaaaaaaaacaaggaatatgtatgacaatgacagtcctcatttttgtaactgttcacatgggcatagctggtgtttataactaccttcttccactgccaattttgtattctctttgccttcagcaagcatctctgctgattgtgtttctttaccaggtggagtgacctaagccctgcctggatgaggttgctctagttttccattgatcttaatcacagggaatggtatgctaataggcgccctaaagatctcctacagatgcactctttcttacctccattggggagtgctattccaattcccccttggtagtcaggatcaatcatgctaagctggaacagtgactcttttccctgatggctaattcagatgcgtgaggagctcaaagtggccaggtggcagtcttaacttccagttcaatggcatcattgtgtctcaatcaacatagaagcattcctccctttgtaactaagatctctaggccagcagaggataaggtcatagggacaggaaacagaaacttagaaatttggattgtggatcactagaggaaatagtgaatgatgccacttccattttgccctgagctgagaaaaaaaggaaacataacagttattgagttatgagccattataacaattaccgttcataagtaataacaatttcactgttttcagaacattatataatatttttagaacaaaaactacctcaataaataaatttattgagtttaatatttaaaataagaaattccagttatcacaaaagtgatctccctaaccagtagtaatcagcatatcatttgcaaagaattcaggtgcaaatataaacatttaaaaaaattccttaatactacacttcttattactattgaaatttcacagttgtcttagaagtaaataattcttgacacatgatttatctatgttatgcaagttttattatataacaaacaagtataaaaactaaaaatcataaaaatataaaagaaagtcatatttcagatttgctacattttaatagtatcgacaatttatttaaaagatttgctaaaataaatgagttattaaatgctcaggattcactatttactgagcattactaaacatttactaaacatttaattcactgagctattattgtccttatctctgttgcatagaattcctttattcacagagaatcatttattgaatacattctatttgacaaatattatataaattggcaagaaatccaaatttaggcaaatttttcctggaggaaatggtgcctgagcttatcttaaatgataaaccagcatgataagagtgacgaatcatgttggttaataaaatttcttgcagagggggcattataagaaaagacatgtgagaatcagcatggaatagttgtgtgagtgtatatggccggcagtacaaatggcttagtctcctggaaagataagaattgagagagcagaggcatataatagatggtgcagcattttgtaaaatatatttttgagttaattcatttaataatacatgtagtcatttattattatgtacccagcactcttctaagtgcttgggaaatagtaaacaacaaatcaagattccatccctcgtggagcctatattgtacaacattagaaactaactagtgcttttgggggaaattgaataagataaagataatccactgtggggcagatagagtaggggctggtggcagtattaaggaggagcataggagtagagataatagagaaggtgatatatgagcgaattcctgaagaagatgagggagatagccaggcagatatttgggagaagagcattccagacacaggaaagagatagaacacatattctaaggttaaattgtgccttgcaatgtcaggctgaaggaacaataaggaggcaggggtcactccattatagtaaacagggaaaaaaaataacaggaaagcagtacaaaagatgaacagagagcaagacgatgcagggcgttataagccattgtgacaacttacacatttactctgagtcaaacagaaaatcactggagggtttttcagcagaggaagcaggatctgagatctgacttaggctttaaaactgtcattccagctgctgagatgtgactaaatttcacaaagtgcaaaggtggaagtaggaaccctcctaatgaagctattgacttaatcatctctagctgatagttgctccagcaacgctgctagtagtggaagtggtgagtagtcaagttatttatatgactgttaggtagagcctgaaggattttctcatggattggatgtaggatcagagcaagagcagtagtcaaagataacttcaagttttggggttgggaaaattgagaggaaggaatgcttctcaaatgagattggcaaggcaatgacaggacaggtttgctgagaaatgtgaggagttcattattggacatagaaagttgatgatgtttactaaaaaatcaaatagagacaaaaaacgagtaattagatattcagaaatttgcatggccccttaagcagtggaaagcctctgcaaggttttaagtttggaggaattatagccaattgtatgctgtagtttagtgctctctggtgataaataaaggagatagttctgaaagaataaaagactgagctaagggagaacagttaatagttttgtatagcaagataatttcaacaaataaacactgagtggtggcaaagatgggtaagaataggatgacttgagaaatactttacaagtaaaaatcatcatggccatgattgtgagtccaagagagagggaaaagtaaaatagttttctaaattgattgacttgttaaatgtaaatgtcattatctgaaatcaagagtgcagataaaaagcatatttaggtggaagatatttttgacttgtttcaatttcagctcatatggaatattcagatggaggcaaccagtagacagttgtaaatattagagtaaaattctggggacaggtccaagcagagcatataagttaaggcaaaaattagattaattttaaagttgaaaccatgagatcagatgtgagcatgtttgagagtaaaacatggaatattcccaagatatccaaatgaatgcaaccacttaaaatttaggtaaaggaagagagacatgtgaaagaaattatagactggttatagcaaggaaagtcatgagtcactggtaaaggaataaaaatttcaaaaataatatgatccactatgttctttgcacacagtcactctgtaagataaagactgtaaaagtatgctagaaatgagatcttggtgatagttgtgatagcaggttcagcagagggacgcaggtggaagtagaaggacacagaagtgggctgtgtacagagtcaggtgacaacaggggctcagagagtgggagtgaaaacagggcctacacttccaagaggttctaacaagaagggaagggataaggtggaactgtagctttggttgtgggcaaagagagaattacattatcctctaagagtatcatgtctccctcattactgggaggaaggaatataggaaacaggacaattggagcaaagtcccatagaaggtaagatgtgcttaaaggggaattttactttactgttaacagcatagatgttgatgaggaagaacaatccttcagataaatgtataggggttaagaggaagaaagtcaaggaaaactatgttttttgaccacgaactttttgatggagccctaagagttgtctttattggtaaacaagggttgagtacaaacttgaaatacttgcagaagaaaatagaagtaaatcctagacttagggagtcaaaaggattaatgggtatattaatttccttttgctactgcaaaatttaacataaatgtaatgactttaacaaacactgctttattactttacaggtctataggtcagaagtctaacatgggtatcagtagctgaaattaaggtgtcagcaggcctatatatctttctgctctaggatttccttgtctttttttttttttttttttttttgtttaccatctagaggctgtcttttttccttggttatgacttctcatatactcactgtcaccaatggtcagttgagccttcctcacaccacaatgcactgaccatgactcttttgtctctctcttccacattgaaaggatcctggtaattacattggacctccccgaaaaatccagggtactttccctatcttaaagtcaacttgttaacaaacttaattccgtctactttcttagtttcctgtgccatgtaacctaacatattcacagtgggctgtgtacagagtcaggtgacaacaggggctcagagagtgggagtgaaaacctaatatattcacattttccaggaattaggaggtagataccttctggaaactgatatctttgggaaaccaatgtcttgcctatgacaatggctgatgttgagggtcaagctgaatttagatacagtgaatggaaattatacgaatttgtacagggacatttacagagcacaataaaggaatataaacccttggttttagcatggattcagggttcaaacttgtggttttcatggaagaataggaatacagatgaataatgtgataatgagagagtattttttatactctctcagtataaaagaaaaccaaagtgtccagactcatttgcaaaagaaaaggctgatcagttgcagagagtggctgtgaggtgggaaatggaggaatcaaagaactggtggaaccaatgagatggaaaaatagctactatatatttaagaaagtaaaagaaccaaaagagaatattcagagaataggacatttgaatataaaaatcttagagtcagattggtactcggtgaaaaaaaaacaaaaacaaaaagaggacataagcgttagaataagtggttaaagaacagtggaaatgatgatcattgaagtggaggcagtcaagcatttgttaagttatggtgtcaaatggaccttacataccctaaaatcacctagggtgatggctgaccttgcagtagcaagaccatgagactcatctgtcctaaatcactgagggagaactgtcaggaaagtagtcaaatatggaggtactcacagtggaggtacagatggcatgagaaaaaagaagcagagatttatacttgaatctagaaaagaaactatctggaagcagctttagaaaaacagaagaagcctccctctacctcctgacactggagtctgtaagaggaatgagaataaagaaccatttcctagagatgagtgcagaggaaattttgggttgagccaggttttatttaaggcacaaaaatgatgacacggcaccataagcaggtgaagatgcagagacatttgtttaaccatagaggagcacttaaatggcacagtggaaagttttgcaagggagagtagcatttggagccagagagaggaattgtagagcagtattctatgctggtgagaacgcaagagaagttaaagggctctaagttattgaacttttaaatgacaacaaaggatagaagtgataagttttcacaaagaacgctctctatatatttatactaccacggatgaaaacagaggttctatggtttgtaggaagctgatcaagttaagagtagatggtatcatttatagatactacagcaagctcaggaacaagtctcaaatagatgggtcatctctaaaaaggaagaagggaaaaagggaggcaaggaagtaaagatggaaggatggaaggaaagaaggaaggagtcaaggaattaaaaagagagaaatagaagaaaattcattagattttttcccagtgctataatgatagtaaatttgtcctagaatactatcaacacagcccctgatattatcctttatttttcaggatggcattaaaaaccaaaaattttgatagttgcattttttgtttgttttgtttttgagatggagttttgctattgttgcccaggcaggagtgcaatggagcgatctcggctcactgcaacctccacctcccaggttcaagggattcacctgcctcagtctcccaagtagctgggattataggtgcccacaacatgccaggctaattttttgtatttttagtagagccagggtttcaccatgttggccaggctagtcttgaactcctgcccatatgtgatccacttacctcagcttcccaaagtgctgggattacaggcatgagccactgcacccagccaatggttgcatttttaaatattaaaatgtaagccttaagttaggtcaattctgcattaaaataaacacctatctaattggccacatgcacacacacacacacacacaaacacacgcacagtcttcctgaaccataagtcataggtttgacttatgatttttcaatgttatgatggaggaaatgtgaaatatattcagtactctccttgacttactatggggttatccctgcataagttcattataagttgaaaatattgtgtttgatgaatttatcatcatgtagccccattataagtcaaggagcatctatatagatataaaatgtttttatctttagagatctctatttttaaattggcattgttttggttttgctaggtgagtgtttgttaacatcaagggatgaggatacgtttgactgagaaaaaaaaaactcacaatgttagtaaggtcctgctttgaagaatggcatgaaatagtggcataactgttgtgtacctctttgtctagttacagtctatcactcctaatggaatctccatgcatttagtacaacaaaagagagaagtaagattttataacctcttacaatttgaataaatgattctgattacattactacactagaaatgtaaactgagcaagaaaatgattttaaaattgatttcttcagttttggaaagtgaatttgaaattatcaaggctactactttatacatatctgcacccagtgtatgttttaaaatgataatggtctgccatttaatctgtgttatatatatgtaactcaaaagggtttggacatactcaaaaatatcttttagctctatgtgggaagaagtagcaggaaaagggagatacagtattacaaattataatgggagatatagtcatctgagatactaaaatagctgaagcattaaatgaatatttccaaatacatttacaacagagaacatttatgactatctattctatatcagaatcactatggcaaaggtaataagacagaaaaaattcaagtgtgaatttttctcacttagtgtgttagtagcataagacaaacctccaaaaatgtataagttaaagtgcaattcctttaacatttcatgagggattgaaaatgagagtgtaacatttgtttataaagccaacctgcaacctcaaactttactaaataatattattcagaaaacatttttccattttatgtgaacatagcattattgcttcctaacaacatagttattgatcacaataattcattacagggtccaggttacagtgctccattcttattactttgcttttattttactgtaaatagtgacagtaataatgctaaagataaaaacaatgatatttttgacacataatttgaatcactgaattttacagcttgcaaaatatggagaaattggttgaattggccttttctggtaagttagtatgagaagtaaaacttgagatagcatcatcaaaattactcttcttaaaacacagcttaggtggttcatgatttcttttaaacaataaagaaactgatcagttaactggaaaagataacaaaataagtgtatgtacaagcaggcttggcctcacaaattaaccattcttacttgggttatgaatatatatatatatatattttgagtatatatatatatgtattcaaagataattactatacatatatagtaattatgtaatttagttgtatcatcttaagaatcattgtttgaagattgatccttgtattctttgtttcagtatttaaaactttccttttccaaataagaacaataatgttacaaaatagaatgtgacattgtcaataactttcaaaattattaggacataaaattaatatccgttcatttagatgggatttattttttgttcatataagcatttagaacatatgctatgtttagcagcattctcagggtatactggggaagaaatgtttgactgtaatcttgagaaagtaatgagctctttaagcaggcagagcatacatacatgcggggaaagccagctgaagaagtgtgtggtaaaattatctaactcagctctcagactgtaaatgaaggaaggggtcgaacatacttttggcagcctctgaacatgctccactaaagtcgtttctttgttctaaatccaagaacatcctgtaaaaaaaaaaaaaaaaaaaaagtcttgcagaaaggaaggatacttcatacacgggaaaaatatgagcaaagaagtaggaataagcaaaatgtgtgtgggactggtaaaaagtcttttcatatacagcagagtaatctccttagaacatctaagtgaatcttcaatttaggcaatggaagataggaaactgcaaaaagataaaaactccacagtagatgaattctcttgggacgtgagtcaaaagaatgaatgccagaaaccaacgctgaacttcggtcggggatgggagggctatttagagtgcaggtaaggaaaacaaacataatgtgctttacaggactaatcataattcatcattatcatgtacttatcatatatagaaaggactgccctaggcattgaagttttggcaataaccagattgcccttgtttttgaagcgcttacaatgtagtgagagagagagagagagaatgacaaacgtgtatacaaatcgttcagccacgtaataggtattatacaatcacagagtcttcctaaaggctgtttaagggaacaaatacacagatcaaaatgcttttttcttctgggacaatgagagaagacctcattgaatagctgaatttgaattcagtctgaaaggatgaatactgatttcaagagcagaaacagaggagatagggattccaggcctaggaattatcaggtacaaagacatgtgaaaacatactgcaagttcaagattaccaaacagctaaatggaactgcagcccagtaagcttactggggaatggtagaacatgaagttggcccactaagcagggattgggttgtgaaaggcctggcttggattttaccctgagaagataatgaggtgttaaaggatttaagcgttttaaactgtcaaattatgttatcagattctgcacttaggaccatctcttcaatagttgtgtcagggatgaattgcaagtaaaagctagagttatagaatctgatatgatggccattgacatgaaatgctgagtatatttttcttaaattgctggcagtagagaagcggagaatagtaaaaagctttagagatagacaaatcccggctacaattacatatgggtgagaagaggaagaattgtagacaacatgatatactttgagttggcaactgtatggagtatatgtatagagtgtgaagaaagagtaagtaagaaagagaaggataagaagggttttttttttttgaataaataagaagatcaagcatttatcctaactttactctaggtactgattttatgcagggaaagttccttgtttagagatgatatccagcaaatgcagaaggatgatagaattagaaaatcaccattttcaaactatcataaaataatagatctaggtgatagtcattgatgaatacggtaatcacatggatattgacagagaatttcaaaaggcaggtatcaggctgatattatctgaatgtgtaaataagtctcagcattactaaaagtaatgccttgttgtgtgatgcaataggaaaaggacagtgcctcatacgaactattcttctattaaaaatcaccctaacgttttcaagactttggatctaattaccaacttatggaaaatagtgagaatagtggaaaaagtcaaccactaccacaaaaaagtgagtgactagtacagaaaaaaaaaaaaaaaaagagagacttccgagacacgagaatcaaataaattttgtagaatttgtctgggtccttatttgtccaagttaactttaaaaagaggtccttaaatggctgggcatggtggcttattcctgtaatcccagtacattgggaggccaaggcgggcagatcacgaagtcaggagcttgagatcagactgaccaacatagtgaaaccccctctactaaaaaaaaaaaaaaaaaaaaaattagctgggcgtggtggcgtgtgcctataatcccaactactcaggaggctgaggcagaagaatcacttgaacctgggaggtggaggtttcagtgagctgagatcatgccactgcactccaagctgagtgacagagtgagactccatcttggcggggggggagaaagaggtctttaaaacaattcccaaatttgaatataaatttggccttagatatttttaagatttattgttaattttattgtgaatgttacctaaaaagtccttattatttacaggcatatactgatgtatttacaagtgaaaaatcacaatgccttggattttatttaaaatcaaacaaaaataaaataaaaaaactttgtggggggatagataaactgagattggaaatatttgctaatcactggagcttagttttcggcatagatagatgttggatcaatgagtgtttcttgtagtagtctctcttttaatgtttgaaaatatgcataattaggaggagaaaatagtttaattttaagcagattcattttagatgaccacgagatattcaggtatagtttttcagtagaacataatgtaaaaacacagtctagattaattacaaatgaagtatgactagaaatgtataaaaagagtagaagatgagaatgaaaccaacaaacaaaacatggagacaacaacatttagtgggaaggcagaggaaataaagttattggaaggtaccaaaaaggatcagagagatgggaagaaagctaagatgatgttacaaaaaaatggagagtcactaaaatgacccatgtgtacacagaataagtgttgaaatactaactacattttgaataggtcatcactggtgatcatatttaaagaaattttagaggaatgatcatggagagaacagaggagatggaaaactagatagaaatgaatttatgagaggactagaaaatgagacatttaagagggtttttcctgttattaaaaaccatagctatgacagattttcctttttgataattctcagttttttttcttcatttttaaacttatctttcagtagagaaataaaatagatgtcagaaatgtaatgggagattaatgagagcatggtcaaatttaccaaaaaactaattcaacttatgtttagagcagctcattaacgcaggccctactagcaaatatctttccaagatatgccaatgtgtgtgtaggaacacaggattttataaaagtataaaagataagatgttatctctttctacttaacttccaacacattttccctcaaatagagttgtggttgagtggccactagcatttttggaatcccactaaaacaactttgaattgggaatgaattcagtttctgttgagtgggatatgttcatgtagttcagttagagtttaaattattctgactagtcaggtgtatgaatggtttacaggaatactcctacctactgtgaaaactcattgtgacagggaagtgcaggatcacagtttgtgttgtaatatacaattgtccaatgatacctggccctacatgtatgcaagaagttgaggaaaaagcaaagtttgaaatatactgagctgtaaaaattaaaagaaaaggatttggttatcatcaatacctaggctaaacagaatttctccttgtcggggatttactaagcaacacaacaacacaacatatataatcataaatgtaccggatatgttccccttttttgatgataatcatgtgaaagtgtaattaatcagagtcccttttacagcacaagtcttcagtattcaattatgtttataattgcccgtgtgtagaataattttaaaagaagtttttccaaatttgacaatagatggcctctaaccaataacgttgtcatacgaagaaatgagtttagagtatgtggtcaaaaaaggaatggaaaaggtatttatcaagctaagtcatgtaaatgtaatatgtttattttctacatttcatgatgtctagggtattttgccattttttaaatttgtacttctagacttacagtgtggctcacgcctgtaatctcaacattttgggaggccgaggcaggaagattgcttgagcccaggagttcaagaccagtcctggcaacatagcaaggccctatttatacaaaacagaaaataaaataaaattaggtaggtgtggtggcgtgcacctgtagtccagctactcagctacttgggaggcttgcttgagctcaaaaattcaaggctgcagtgaactgtgaatgtaccactgcactccagcctgggtgacagagtgagatcctctgtccaaaaaacaaacaaaaataatttttattctccctttctgttcagtctaaataaatattcattgtcatgcctggccctagaagtatgcaactaactgcacaactttggtgtgtttttttgttttttttgttttttttttgagaaactttcacaaaacttggatttaaatctgtatgggagcccaaaaaggtacaagaaagtagaggaaaaatattcaacatttacacacacacatacacacagaaaactataaaagctttcatctttcttagcttttgtccaagaaaaaaaagcagttggcttttaacaatacagaaatcatttttccttaaaagagatattgtgaaaaatcttaatgctcaaagtactaggacacatacatacatacatacatacatacatacatacatacacacacagggtaccttacacattaaaaataaaatgtgtttcattcacatctgaagatttcttttcctactctaccctgttagtcactcctacccctatgagagaaacacaataactgttcatcccctttctttatttttttgttgtcaagtctgaggacagaaggcacataacacatatgaagatggaatattttttaaaaacaaggagacaaaatattaaacaatatggtagtgttgccttttagggaaatccgaataaactatttactatttcttggaaataaatctaaaaagtcaaatacttaactgaagtactttgtccttgacaaactatagtaacaccacaatcagcagacttaataatttatcagtacaacagaacatttagatgttctgttagctgtagattctatagatttaatctataattctatagattaaaaaggaatattaaaaaggaaatttaaattttagaagtatatttgtattctaaattgatatatatttagaagaaaataaatccatatatttaattattcatatggaaatatcattgttagtgttgtgtggatgtatcctttcaagtaaaatagcttatttaaatctttttgaagtaactcttcataaattcacagtctaacaatttcttatttttcgggagcaaaggtatatattaatgtttaatcaaggatccagcgtttgatctaaggtcatcttttgaactagaagtaaagcttttatttcaaagaaagtctatcctcttaccttttacatttacatatttaacaggaatgtagacatacttgcaaaagtgactggatgatattttgctgttgtagcacacttcaaagattagaattatccattcatttcatgagtgtagaccagcccaatttgacccatagtctttctgtgaaaatataattatcttctgaagataaaaacagggtaaattataggtggttgtagagttggggaaaatcaaagagggggacaatttgtggtagtcctgagtttaaatactgaacaagtcatctacttcttatgtgaccacaggtgagataattccttcaattataaagtatgatagcaatttaagtgttactatgttctctaataacatgagctaaccctctttttcttactgtcagaatgacactataacaaatattgcatttttccctatgaatccaaaagcttctgtcacagtcgtgattaggaatgctgtggatggaagccttacatcactggtgaatgccaaaacaaagcagtatttatcactggctttgatttcaacattattttaatattttcccacctttattaaagacgttaatattatgagtgagtatatttcaatgaaagtagcctacttgagcttggaaagactaaactaattaacaggaaagtaatgaaatagcaggtttatatcttgagcccccagtgatgaaaacctttagcaaaatacaggttacatgtttaggatttggttaattattttaggagcaaatatagagaaaaaatattctcatattttaaagaccaatattctcatttaggcctgaatataacagtgaattctctaccttatatgggctaactatccagttttgacagcagagaaaattataataccctatagacctaagtttcatcaaccctgttctctgaaatatatctgtaattattctggtacactcagatgtttatattttaagaatctatatctacaatgtagttaaagaggtgttttataattaagtaattaaatataagcgtaacttttaagtgttgttagaattcaaagtaaagcactcattccaaaatatttcaactttcttataaacatttctctttgtactacaatattctctttcccccaagtgctatgattaatgcaatccttaaaaacaatggaaacaactatctttattactgattttataattttggaaattccagggactagattccctactgttaaatttggaatatataaacttcctgggattgcagttatgacctaatgtactaaggtagcactcaaaacagctattaatttacatggaacaaagtcataaaaggccagaggaacagcaattattgtcacatgcaattaccaagagacaagctaaaaaagaacactcgtctgcaagtgtatcaattaaactccattattattaaaacaagtggtaagtgaacctgccctagaaatctattgtgtctggaactggttccttcagtgggttcttggtctcgctaacttcaagaatgaagccacggaccgtcgtggtgagtgttacagttcttaaagatggtgtgccaggagtttcttccttttggcgggttcgtcgtcttgctcacttcagcagtgaagctgcagacctctgtggtgagcgttacagctcataaaggcggccgcatctggacttgttctcctcctggtgggttcatggtctcactggcttcaggagagatggtgcagaccttcgtggtgagtgttatagctcattgttacagctcataaaggcgttgcagacccaaagagtgagcagcattaggatacattgcaaagagcaaaagaacaaagcctccacagcaaggaaaggaacgtgagcaggctgccactgcttgcgccggtggcctgcttttattcccttatttggccccacccacatcctgctgattggtccattttacagagtgctgattggtctgttttgacagagtgctgattggtgcatttacaatcctttaactagacagaaaagttctccaagtccccacccgattagctagacacagagtgctgattggtgtgtttacaaacctttagctggacacagagtgctgattggtgcatttacagtcctttagctagacagaaacgttctccaagtccccacccaacccagaaacccagccggcttcacctctcactacgttgcatagtactagacagacctaccctgtagaatttaaattaatatcctataaatactgataactctcccatattttttattcacaacttacataagtgcttaaagaatgaagatgaaataaaaatgatttacacaaaactttaataagattgttattttaattttttgcttacttttctgttatttcttcaaacctgaatacatatgtgaatatggaaatatcttcaaaatcttgctattttagttctttcctttaaaaaataattttcttcccagattttttctcttatatgcctcttgctcaccagtttttcttccttaaatgcaaatcgtctgagagaaatggatggcaataaatgcccccaagaatgactaagtgtaataagcagctgttaagatgcggttttcaaaattagacctgaaaaaaatgtttcttttctgtttgtttccatatgaataccctagatgagtagttactatgtatttattagccagtgccttatataacataacacgttcaggagacagttagcaaaagaacagtagaattgtaaatactcagagaaaaggagacatgcacagtcttccttctataaataggcttacttcagcttcatatccaataggcttaaccaagcatgaatttacactcctcctctttatacccttcaatacacaatttcactaaataatgataatgttctatttttaaatattttacaacttttttcttgacaaatttaccattgtgcactcattgtatgttggagatgagggattcactttggttatgaacgtgaaatcttattctaagttgttgtatataatttaagtaatttatatacatactattattaattagctaatattttcccctaaattaataagcgtttagttcataaagagaataacacatttttgatctacatcaggaatagtgaaagacctagattgatatattattaggttgcagtgagctgcattgaatgtgtccctttagctacagtggtaaaatagatttataattaccaatcttcaattatgattgaatttaaagcagttgttttaattggcacttttttgtaatgactgaaaggagaaagtatttggatttcaaagttttcatgcaaatatattttcttatatttcttcctgctacaatctacccagaacaaatatgctatattatatgagtaattatgttttaataggcttgttctgcaagcaattctaaatagtacttgtcttgtgagcagtgatcatggtttgtgtttgcaaacagtctattgcccttttcaaagacattcctggaatacaaacagctggcaagtgatctgctttccaaaaacttgcggtgtgtgtgtgtgtgtgtgtgtgtgtgtgtgtgtgtgtgtgtgtgtctaatttgagcaagaccacccagagaattagtagtaataaataaatatacaatgagatttcatatcctattttgacaatgtattaagtagattgaaaaccctctctccatctctataagaaaatgttatcttctgtccaatcttcatgttgccatttccctatttcttctggttcttttctcagaagtagtcattatgattcttgtatgtaaccataattaaatcattttacttttctgtatttattagttacttactatagatctgttagtgattatatataataactatctgtgagatcttattaagggctaattttaagggctaacattttgcatgttctctcactagtgttcaaaacagttcatgagaaacagattgtaatctgaacccaagcctgtaggactttatattcaataaccctaacaattgttctcattcttctaaactcttttcaagattaaaatagttatcagttttagacttctcaaatttcatcattgcctgataaatgtagattctaaattgagtgtacagggatgcttctttttcatctatatgatcctgtaactcaacaatgtgtataaatgactaatgtgctcagtgtttttattagttgcttgtaagaaaacaaaacaaaggaaatgcatttgcctattgagtctcatgagaaagtatgacttggagctccacaaagcaattacaaaagggataagttgtatccagcaaacttgtctaacaaagttgttttgaagtttaaataatataggtccagcccttggcatagtaaatactccataaacagctgttactctacatgctctgtgaggaaatagacatcacacttgtctattactgcattcctagtcttaggatggatcccagcacaaggaagagtcacaaaataatgtattaaatggatacattaatgaatgtaaggtattgtaataatggcaagtcagagtatggtgagtgtcattattaaaaatgcctaatagtcaggagatcaagaccatcctggctaacaccatgaaaccccgtctctactaaaaatacaaaaaattatccaggcatggtggtgggcacctgtagtcccagctacttgggaggctgaggaaggagaatggcgtgagcctgggaggcgcagcttgcagtgagccgagatcactccactgcactccagcctgggcgacagagcaagactccatctcaaaaaaaaaaaaaaaaagtgtctaataggagatgaattttgagcaaaactttaaggaatgtgattgacatcaattgagaaatgtgttccaaagcaggggactatattttattaatactcaggatgagaatgggcttatttcttgagatagataacataacacaatatacgatttgcagttcaatatagtgtgtactctatttgtttctagacttgaaactaatgagtgtttaactatcttaaatttacacagagaaacatgttgtgtctgtaaatttattactataaaatggtggccttttcctgtgcattaatggtgacaaaaaattagcaaatgagtaaaacatagcatttatttgtattaaaatattttttcaaggtagaaatataatttttcttataatattaatctactgttccataggtaattcatttcaaatattaatttaaatttttattacttttggctgtttttttggtaattataatcctagacaatccattattttcatttctctattggattatttacattacagatagaaaagtaaacttccaaatggttatatttaaagatatttctcaattactaacaattaaatgattgtcattgctaccaaattagtaattgctgggatatatgatatatgcattagaaaagcagttcttatatgcctatacattcttaaaattagctgtccatgaactggatctcatgttctaatatgtttctttacgtaaaaagtgaaaaaatgaaggaagaaagaattgtaaaaataattatcactgaaatgtcctggactgtttgtgagaaatcaaaatcttgaagtcgggtagctacctgacttcaaactatactacaaggctacaataaccaaaacagcatggtactggtaccaaaacagaggtatagaccaatggaacagaacagaaccctcagaaataatgctacgtatctacaaccatctaatctttgacaaatctgacaaaaacaagaaatggggaaaggattccctatttaataaatagtgctgggaaaactggctagccatatgtagaaagctgaaactggatcccttctttacaccttatacaaaaattaattcaagatggattaaagacttcaatgttagacctaaaaccataaaaaccctagaagaaaacctaggcaataccattcaggacataggcataggcaagggcttcatgtctaaaacaccaaaagcaacggcaacaaaagccaaaattgacaaatgggatctaattaaactcaagagcttctgcacagcaaaagaaactaccatcagagtgaacaggcaacctacagattgggagaaaatttttgcaatctactcatctgatatagggctaatatccagaatctacatagaactcaaacaaatttacaagaaaaaaacaaccccatcaaaaagtgggcaaaggatatgaacagacacttctcaaaagaagacatttatgcagccaaaagacacatgaagaaatgctcatcatcactggccatcagagaaatgcaaatcaaaaccacaatgagatatcatcttacaccagttagaatggcaatcattaaaaagtcaggaaacaacaggtgctggagaggatgtggagaaataggaacacttctacactgttggtgggactataaactagttcaaccattgtggaagtcagtgtggcaattcctcagggatctagaagtagaaataccatttgacccagccatcccattactgggtatatacccaaaggattataaatcatgctgctataaagacacatgcacacatatgtttattgcggcactattcacaatagcaaagacttgtgaccaacccaaatgtccaacaatgatagactggattaagaaaatgtggcatatatacaccatggaatactatgcagccataaaaacggatgagttcatgtcctttgtaggaacatggatgaagctggaaaccatcattctcagcaaactattgcaaggacaaaaaaccaaacaccacatgttctcactcataggtgggaattgaacaatgagaacacatggacacaggaaggagaacatcacacactggggcctgttgtagggtggggagaggggggagggatagcattagtagatatatctaatgttaaatgacgagttactgggtgcagcacaccaacatggcacatgtatacaatgtaacaaacctgcacattgtgcacatgtacccttaaacttaaagtataataaaaaataaataaaataagagtcaggaaaaaaaaaagaaatcaaaatcttgacattcaagaaacaattttttggtcaaagaaatcaaaaaatgttttagttatatgataaaatcaaatgaaaactttaatctttatatttgaaagcttcatggaatgtgaaaaaaccatattaatcttatctcaattttccaataataataataataatatctaatccatctaatttttttcacaggcaaatttatagcaatctatgttcatattaaagccagtactatttatcaaaatgaggattaatacatggggatacatgatttggtatgcctaaatattttcatttaaaacatgtataattaatatgagtggtcaaaaataaaagaaaatattgtttttaatgaagagtgaagagaaattaacacattgattaaatgatgatagtgtttgcatccatgtagagggtgagagtgggcaatgatccagacagatatttctggaaaaaaaaaatcttaatttactgttagagaatcctggttgttcacctttcacctggaataactaccaccaccacaacaaaatattgtgattttttttaaataggtgaaacatagaaaaaagaagaggaagatttctaaaatatatttttcctcaaaattatgatttttagaatatgattgtgctgagtgaagtgtgtttgtgttcttttttattttaactcttaatcctttttttgcaataaggttcaagaaaggccatatcacaatgtaataactgtggttcttaggtcaagaatatttgaaaatgtagttcccaaatgcatatcctcattaactttttagaaaagctgatatggtataataattatggagtgaccaaaagtatagcagttctgagtatactatttattctctacttgggagatgaagatgggaggatcacttgagcccaggagttagaggctggagtgagccttgagcacaccactacactccagcctaggtggaggaaaaagaaaaaaaaagattatgaatccattgtacctaaacttttcttgaatgtgatcaaaaagaacagttttacctgctttcttcacagaggtgttgaaaagatggttaaagttaaggatacagtgaaaatgttcctcagccataaaaagaaaaaatgtcatttatgaaataatggcatttgcagcaacgtggatggagttgaagatcattattctaagtgaaataactcaggaatgaaaaaacaaacatcgtatgttctcacttataagtgagagctaagctatgaagatgcagagcataagaatgatataatggactctggggactcggtgggagggtggaagggaggtgagggataaaaggctacacattgggtacagggtacactgcccaggtgatgggtgaaccaaatctcagaaatcaccactaaagaacttttccatgcaactaaacataacctattccccaaaaactattgaaataaaaatttaaaaagaaaatgctaagatggcataaatattaaattattagtaagtaaacaatcagaaggtaataattgattatagtacgtgtgggttctagtagaccctgttcttctaaataataattcttgcatatctaatgagtttttattcattttgcatttttctgtttcagcattatagttatatgtgcacacatgatgcacttctaaataaacaaacagtaccatgataggctcatcttttttggaactcatgtattctacaaatatttactaaagttaaaaaagtgcaaggtattctgtcagatattataaaggaagagagatgaattttccttgaacacttggagtctaggaggaaaagaaagatatataatataatattggtaatactgctcctgcatgccaaacacactactatgttatttctgctcttctcaaaacccagcacaaaacagcattataatctccattttgcaggttaggaaattgcccaaggtcacactgctaataagttagcagagctgtgtgaacagtctagagaataagaaggtaaatgttattttcactatagcacataatattaaaaataaccaatttcaaatagtaagtgctaagttctataaaaattttatagcaaaaattcatatactttaagaattaacttgtaaatatttattcttataatatgcacatcctattagccttaatgaaaattcactttccaatcatcaggcatttattttgttcactccatcaaatactttagttttgcaagaagcatttttatatgtgcattcgcttttgaaatccatgaagatgattaagttttttctaaaaccaacaccagaacctggaatgcccaataattgctgaatgaatgaatgaatgaatgggtggtgaattagcacaaaaaagtaattctttccctaatatttttagtgcaggttaacattttatgttggtacatgagatagatggaataggaaaaaatgacagtgtcaaaattcaaggcaataacaaaatcaattcattgtgggaatggtagcagaaatcaacagatcattttggtcagttattatcagagggaagcttaataattttgtttaacatagtgcttacagagttttaccagtggtgtgagaaccagttatcctaagggctaattccaactctgcacacagtaacatcatgttggtagcttgacaaagaacatggttggagtatttatatcttgaaaattgccaaatactagtcatgactttttcctgagagcagacatgttgcacatcactggcttctactcatgcttagtggctggcagaattcagaggtgataaatatctgcaattcttggaggagttcctctcaacaaaatgttgccctgtaattatctgagctgagacccctgactgtttgcttaaaaggaaatttaatttttgcctggttttgaaatttaatgaattttctgaaaatgtaactgtcatgtaaactgatgaaccactgaactttgcataatcatcattttataaaaatctctttactgagggaaatggcttttatgctgtttgagtcgtacaactggtattagtttttgttgctgccatgtcattcaatttgattctgttgaggtgtaagcacctggtgacttcagctatgtcttcaatgtggttgcgccagagcatttatatactcaagtatacatcattttatcataaaaattgctcatttctcttttatattatactcaatgcttttaattgattttttgaagccaagagtataggtggctatattatctgtgaactgcattttaacatattaaaagagcactgacgcagttcagccttttcatttccagaagagagagtgtgacctgatgaggtaaagtgacctgaccaaggtcacataactcactgacatttcagttttttaatttatctattttccattaactttcagtaaccaatattatgtgttagctttatctggaataacacatgcatagtatttgtgaaaatacacacgtagtcctcttgactttatttctaacagaagcctctgctagatttgagcaatatagcttcatctaaatcatgccgcattcttatgttcaatgacagggatttatttattaggtaatgagcccagaaattatgctgctacttttacacctttattctttttatggcacccgagaaatacatcccatatttcatatttctaagcatttggggagccacttgctttgattgaaattgctggttcatgctaccacctagacaaaagccactgacctgaatgccagagctaatgtgactgttgcatactaagctgacttttagcttcaaactttactaatgtgtttacactgaaaaagaatgaaatgaaaacctattttcaatttgctatgtcagctaaagaaagtaaaaaaaaaaatgtgtggtagatgcttaaggcagaggaaatgaggactattgctggaaatttagcactgcacaatagagaaaaacatggctttatattctaggtccccatggatagctgcctatgaatatcatagcaatgctgttctaagcaaggtaattcttctcataccagtttttctcttgctcaaggtcatgtctaagagtagaatgaaatcagcataatgctttaaaatatacgtccagtgaattcaggttaaattctaaaacgtcaggttgattctttttgtaagcttggttccagattttagcttgtgcaatgagaaaatgttgcctgaatatttttctgtacttgaattggcatactttaaagttcaaaatgggaggcaggtaaatttaagttctagaatttaaaaggtttaacattataatctgttttctgtctctgtatgtttgaaaatctttaggatatagccaacatattattctcaatatggtgctttattttccatttatgtaacagataaagtgggtctttgattcacttggctgcgacactcatttcatctatttatgcaattgcacgttcatatgtacgaaagccagctcagatttttcttcctccaaagtcctccttcaaggacttctcagagccttaagtaaaggctaacataaaatataaatctccaaatgaaaaatattactggcactgttcccaaatttatttttcctcaatgcaactttattctaggagcatctgaaaaaatgtacttctatttggcaaacttttaaaatgctgctcttttacatgatttactttttgttgttgttagtttccgatacaccaaggcctagcttccctatcacaatctgcctgttcagggaagggacaatcctctttatttatctggcacagttaatttaaaaaaagctgctcaacctttacaatgtgactgtatatttagagataactaattacagaagtctctttgattaatatatttatgtgtgtgatcattattgtagatgttgttttttaaaagcacacagagaaaccaacatgcaaaagaaaggaaaaatattgtctgcttgtttgcttcatgaatgtgatcatttagattatttttcgttatcacacttttccccatcgtgccatgttttcagacagacccttttatcatggagagaaaagcaacggcccataaaaagagtgttttgaaagctagcactatgacattaccaagtttttctattattattttttctttcaccacgtgaccttatgttgttcggtaactaagaaggtcttctaatgtttaaaattatactgatgcatgtgtgtgtgtgcgcgcgcgtgtgcatgcacctgcacgtgcacatgtgcacgtagttgtgtttttcaaaatcaaacgtaatataggaattcaaaacatagaaatgcaccttagtaaactgagattaccctttctggacttcctaaattgaagtagaatttaaactaccagtggatacacatgcaagtctgagattagctttaggattcctagtcttactattatgatatatactgcctacaaaggaaaaaataatcagtagtaattattaatatgttcagtggagattagaccttgagaatgattttcagaactgaggcataatgtgaaagtcttcaccatggatgctcatagctaaacaccaaatagttggtctaggctccctacatccctcctgtttaaggtcaggattgttcctgggtctttcagttatgaggttcacaaaccctgagagataagtagccaagacagagctagaacccagatcttttaagtcttactcttgtatcctttgagaattgctcttccaaaaataggagggtttctgtaactttgaaccagcttctccgatacctaaatatttggtctctattatatcttatctcattttagttaacaatgtttctaatgagctatgagcctcagtttctcatgtataaaattcataaaataatacttgtatatagactattaaatatgtatacacatgtataacatttattcagaataatagaattagcttaccttactgaagatacactttagacatagaattataatagttcttgtattgaatatttacaggcacagttcaggtactatactgaaaatatatactcagtacatttttgaatttattttgtttttatgtatgagttgattaaacattttaaaacaattggaacaaacttagtgagatttgaatgctttagagttctaattctctagtgaacaaacaaagggaagcttaattggaaagtaaatgattttgtgacattttcagtttatatacatacaaaatgacaaatcaaaaaatactcacattttaaaattttgtcttacccaaaatggaaaatacaggacttatattgttatttggggtaaatagttaaaaatcctgaaaaggaactttttttttttcattgctttctttatatgccagcatacctcatgcacacacaacttgcagcttctttttgttctcacacataatttgatattataagtagggaggatttaaatgaggatttagaaatgaatggaaacctcaatggaagcaactgcatgttgaaataattctaggttctacaaaaagaaaggagaatattggcaacatagttgaaggaaatgaactttaagaagtagattccaacaggattagtctactactgtgaaatggaagaagtaaataaaacaaacagaaaaaataattaagtagaaaaagaacttacaagacctgaattcttctgaattccagacaaaagagtaggcaacaataatgataaaatgtatacatctagaatggtactgaggacagaaggacaatttggaataatataatactctgaagtttaacatggtcactaagaagtatatagaagtagaaaaatatggaaatgacaaaatcaagacttctcaattaaagatgtaatatgttgagttaggtgcactactcgctgaggacaaggtgtatgtcttccttatgtttacacttctagtctgcttgtgctcagcactgcacttgccatgtagcaggtattcattcaatgcccttttatttaacccagtttggtaatccaggaagctcattgtattagtccattctcaaactgctatgaagacatttctgagactgtgtaattttttttttttttttttgagacagagtcttgttctgtcacccagactggagttctgtggagcgattttggctcactgcaacctccgcctgccgggttcaagtgattctcctgccttagcctcccaaataactgggattacaggcactctcctggctaatttttgtgtttttagtagagatgggttttcaccatgttggccaggctggtctcgaactcctgacctcaggtggtcagcccacctcaacttcccaaagtgctgggattacaggagtggccacgacgcctggctgatactgtgtaatttctaaagaaaagaagtttaatcagctcatgatttcacaggctgtaaaggaagcatggcagcatctggtcatattctggggacaccttaggaaactttcattcgtggtggaaggtgaatgggaagcccgcactacacatcgccagagaaggaggaagtaaagaaagggcaaggtaccacacacttttaaacacccagatttcataagaactctatcacaggaacagtaccaaagggagaaatctgcccccatggccaaatcacctcccaccaggacccatctctaacattggggattacaattgaaaatgagatttggttggtacatgtatccaaaacatgttactcttatttggggaatgtaagaaagaactaatgatagatgatgataggagctaaagatttttaggtcttccgcaaaaaaaaaaaaaaaaatgaacacttaccaagtaatctcaaatagatgagctttaatgagaaaatgccacattgattttgcactttgaaggaatgtataacacttaaatatttgttggatgtaatttatacggtacctactgaaaatgaggaaactgaggctcagtaaaattgaacattataccattaatgtgatctgagatatggttaccctcagggactatataccacaccatgtcaccatgttgtattcatatttagtcttcttctctctaggaagtgatctcatttttgtcattcttcactcattggatgagtcctcattcacacacatcacacacacctccaactatctgacaattcttagtcttagaaaattctctgaactctgtgattcccaagtgatgcagagtcaaactgatgttattaaatgacaaagggactgagggctatttaagttttaaaaatctaaatcttagcctgaggcctttacagaaaaagaaaagaaatccccaagaattttaaggcattttttggtattatttttgtgatttccatttttgaagggctaagattcacagtttaggttacaggtaagtcatttcataaataaatatgtagtagcttaaaaaagatgatgcccgtgatgtttcttaaaatcctagtggtcatgtttaaaatgtaacatgacacttgataccctgcataatctatatgactatatgtacttgagaagaaatactaatgtaatctagtaactctttattctcttaatgaggtatgctattccatagctctttagctttttggtagggtaaaactcaaagagacaacccacataacattaaaaagaactcattaaataaaatgcaacattttgagatgcataattttcaaatggaaccactgtgtattacagtgagataattaaatattttatgttttacctgaacttccagaataagacattgatatatacatttacagtatatagagccactgattttaccatgcatagaagtggatggaatatcaaaatgctttgttccagtactttgtgattataatgaagacttatggttttttaaattttgacaacttttaggcaacagtaaatatgaacacatagattatattttttgtttgtagagtatttattaactatataagcaacatctgtgaagtatagaataatttccatctacaaaaggaaaatgttgtaatacatatttagtttataatagtatgttaagaaccatcaacttattcttttaattccatattccacagatgttcattagacacctaccattaaatgttaacaaaatttcttcatgggtgaattgaatacacttagaggcaacccattttttaaaaaagtatgagtataatctggattcctgtgagtataaatgtagctcatatttattaatgattgtttactctaaaaatattcagactggtttggcaggctctctgtctgaggcttgaagagcttgctctgggatccttgttttctcagcctctctaattgagggcaccttcacagtttcagggtactttacagcacggagaagaacctaaaaacaaaacgaaaacatgatgggtcataactatgaggaaataaaaagaactgtataaattgcaaagtctgaaaatcaaaaatgtaatacttgaactaaattcattttaagataatattaatgtggaaaggaatgcatctgattgatataaaaagtgtaagaacacttgcagtttaatgttaagcagttacattgcaaagactagtctcaaattttagaacttcattgaaaaatcagtcataaattgtttctccataaacaattaaaaaccagttttctgattctggttaattgtttctttttcattaaatttgttaaatggggatcactaaaagtaaggtctcacaagatagtgtgcatattgctttacattttaaacttccatatggcagatctttcccctgtgaacttgaaaggatagatagtatcattttattttataaatgatgacatccacagaggctaagtgattagctgtgtcattccaacaaatagtagactggaaatctaaatcagtatttctttgaagggaaatatatacatctacacctgtgtgtgtgtgtgtgtgtgtgtgtgtgtgtgtgtacacgcatttcttatgtcacaggactaacacaatgaaatgttattttaagaattgaaacttagtgtgagaagtattatgtgcaaatgtataaaacattgtcacacattatacaatcgatcccagattgtgtcccttagttgcctgtagcattgacatttaacttgtctaaaactaactttatcatctataaaatgcaactaataatatctgccttatctcagagatagataaattctatgtgtcagtgcctgggaggattacatttgttttagctaatcattcatttatgcatctattcatgcaacaaacatttattaagtgcattcaatgtacaagcattagtgaagatgttggagataaattaatggacttatactgcatgaagaagaaatgtataaatcataaacaatagtacaaacacaaataataccatcgttaataacatcagacaattataaacatgttgcattggttggagaggaagctgaggattgctgcagtagtctatgcatgaagtgagaagggcctctactggaaagatgctgctaggaatggagaagacttcatatttatgagtaatgcattttaagtaagagagataaggtttctctctctccagtagaaaggaatagagaaaaaaagagctgaggaaagtcagttatgatgtaaaacctaagataaaggcaaaatagtaataagaacactaaggggtgggcagtattagaggaacagtgacaatttcagttttgatcaggttgattttgaggtgactgatacattcaagatgaaagaaaattcaaaattggaatttagatgaaagggtagtgcatgtattcagagttagcagtacttcggtatgaggaaaaactaagtttctgattaaatgttaaaagaccaaagtcagagcttaaaaccatactgatactagaatgcagaatgggcaaagcaaaaatgaaaaaaaaaaaaagtagtaatatcccagaaaactgtgaaggaaagaatagaaactttgtgaacattaaaattagcacaacagccaaaaatgaatactgaagagaaactatcttaatttaataataagcagatactttgtgacatttgatagagtagtttcagaaaacttgtgggaagtacaatgggttacagaaggaacggttggagaggaggtagagaaagcagatgttgcactgcaaaatggtgtgaagtagctgtaagacagagctattcaaatgatgaattagtaaaatccatgatggctgaagagaagagatggaaactaatggagaatataggagtttccagaggaagacgttctcttaagatcgaatgaagcagattttaaaagctcagctacagtagatgactcttaagaatctaaaggaaaagatgaagggttatgtcttagcaaatagggagttgaagttttggggagcaacaaagaatgtccagacgaagggaaggcaaagttcaacattataactaataaaagttggattggatgacttggggacttagaataacaagcaaagcaagtctcttaattcttccctttggaattatatagactgaactgacccatctcaggcatagctgaacaattccagtcttctctctcagtcacctttggttgctccaatgattttgccaaaggtagatcagaatgtgtgttttggtgagcagatttgctcacataagtgaaacaatgaaatgggggcaagcaagaggcaggctgcaacatacctacttgcttatttctttgatatcacctataggatgagtcattcttctttttggtgggtggggagcaaggctaagaggccataatttttctccttcgaaattctttccctttatggaacttagaatagggtgattaccaattatagcttaatatctaagacggacctaactttgttcccagaatgcacctgcattgggtaatctgtgtaaaacacaacacatcatataattctttatatgaaatttttataatgtgttttgaatttttttggtggtataatctgtctttgatagcataggaaaggataattcatataaaagctgaagaatgatggtttaatgtgttgaacagaatataccatgagcaaaagcttgttgatttgggtaagtctctaccttgtttctttaggagaatgtcatttatgactcctcctgcatttgtataccttcgtaattctcagtaacatagaaatttgatttataggtatttttataatgtatatattttacataaaatattttgatgcatctcacttattttttaattgcataaattatattgaccacttacatctattattaatgacatacctccccaacttcccaaatccttatcattaacttttctttttttttatttttagacagtctctctctgtcgcccaggctggagtgcagtggtgcaatctcggctcactgcaacttctgcatctgggttcaagcaattctcctgcctcagcctcccaagtagctgggactacaggcatgtgctaccatgcctaactaattttctgtatttttagtagagacgggcttttgccacgttagccagagtggtcttgatctcctgacctcatgatccacctgccttggcctcccaaagtgctgggattacaggcgtgagccaccgtgcccagcctatcattaacatttttatttatctcagaatcatagtatcaggatatcttgaaggatttggccaaatatatttcagcaacatattcaacaacattatgttaaacatgaaaaacatgaaaatcacataggtatgtatatattgagagactaaagggagcagaaaagcaaggtactgataatacagaagggctgttgttcctagaatggaaatagctgagattgcaaaggggcaattagaaagatgtcatggtgttaacataactttatatacgtatacacatgctgtgttcatttatgagcggcagtaaacctatagtgatgccgtctataagaaagaaacagagaaatcgagtaatatgatttagaaaataacaaagaatctgttataaagtaataattatcacatgaaatctgactttcatattttctcaagcactttgaaatgtacaaggttctgttccgagtataaagcttgctgaagaccatttttttcaaatttatagacaaaatgtaaaaacaatttgataagttctcatttcagaaagtttatgtcagtgacatgaaaacatatcagtaaatgcattgttaacaacttaatcgagtaatttgcctgtcatcatgactcctgggtaatgtcaagctgtttacagctaatgtaatttttggtagaaaaaaatctatccattggacatttttcatttcaccttatgggaaatattttattatagtagacaagtttccaaaaagagattattatgaaagtagttattctagcagtaacttctcagataaatgatctgtataaatatttttctcaatctctgaatagaatcccaatcaggagtattggtattacatgtaatccaacttctagctctatcgttatgtatttgtgtcatgtcagacattattttttactggttggccctcaattttctcaccttttgtccttagctttgaaccaatcaagttatggtaattgtgtttattgctcgtcagtaaaggcaactataataagatattttgcataaggttagaatgtattacagttgtttaataaaattaactgattaaaatgcagggaatatttttcaaaaagagaaggatgattttcagggtgggatccagtcgtgagagttgcatgagtttgcaggcagaagtaccataaaatattaaataaaagaggttcttgaatgccaagtcgaggagtgtgaatatatttaatatctgtagggtatggaaggcagtttccctcactgagtgaatataaaaggccatattaacccatgagagttatccgcagttagcatttgtgttgaagtaaagttgcactaaatgtatgtagggttataggagaatgatttagatcatatgaaactgtgaagggagaagaacataccaggatgaaagaagtaatttaagagtcaaagctacagatatttcaagtaatatgtaggagaaaaagaagcttaacttcaatttcattaaggatagtgaaaatccatctcagtagtgttcaggatgataacagattgcaaaagaaatggaaggaagagatggtgagaaaaatgaaggcagctggcatacatcatatcttctaggggtctggcaatgaagaaaaatagagaaaaacttcctaaaatattgggatgaaatttacttaattgcattttggcatgttctcgaggctttttaacttctcgtctgtggtttgtcagaagtaaagacagcttttcacatttcctgtcttttcaaatttggcttccaagccatgttgaggatggagttatcttcaaatttcaggggtgtgatgttgcgtattggaccacagatgctcctcaattctgtgaggatttttcattattttgatttcttttttcctataaaagtttgcatttcacccttctcatttttccctcagttgttagaggctgcctcagtgagctctaaattctctggcagatggtactcagggatgactttgagagaattcctagatttcaaagacatataccttttccctgcctccttgaataatttatgttctttggcttctcttacccatgacaatgggccctgaaggagacccaaatctaatctgagatgtaatctccagggaaaactgaaccactggggaaagctcagttgtggacaacctgtgtcctaaggtgagaaggagggccactagcataaaaacaacttgaacagaacttccttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcacatttgccatattctaattattagatacaaatcaataggctcgaggtgaggggattacacaaggacaaggatactgggaggtggaatcatgggaaaccgttttacatgctgcctaccactcacgtaatatcctagtataataaaatcatcagctcttactaataaggacattttaccttttagttttcattcataaaacatctattgcccaacagagaaaacgatgctgaattttaattttataaggagaaaccacaaaataaaagacttgtagaagtgttctcttttgccccttcttggtttttgtttgcaaaaaattatggaaaattttcagcagtaaaagattaaaatattaacaaaattatatatagcttttactattttttaaatgcaaaaattcatttgtttcctacacaagtaaccagattttcaaattctactatagacacttgtaaacacaaacattcatatttaaaatgtattaaataaaatattttaaattttcaaaattttaattttataatgatttgatattttattcttaagctagtaatgacattggcttttttgatcaggaaacaggaaataagagatattaaagacatggaaaattatgcatggatctacaaatacaacataaatttaacttctcagtatatcctaacacatatattttttcttctaaaatggaaataaattgcaaccaaataaaaccttatatttctgtattagatattttaatactttactgcagaaatatatataatatataccttatatttgtgtattagatattttaatacttcactgcatatatatatatggttatatatatatatataaccaaactgtcgatttcatatacttctagtgaacagaaatgtgtatttatatatggcattataaatttatagaagggccttggacatcctctagtcctaggtttgtactgtgtatctaactaaactgaaacacaaaggcatcaggtgaaaggctgaaggctacacctaagtagctgaagtaaatccactttaagtacacgcatgcttactacactttaaaaaacttttatgccttgacattattgaaatattctgcagatactttgcatagaatcacagggccagaataatttttagttttatttacttggtctagattttgtcatcacaaatctgagaatggagctaaaaatcacagcctgtaggattcctccattctatttttggagccaatgaagtttcttacatttggccagccctctctcaaatgcttgcaattgggtaacattgttcctgtgagggaaggtcgaatatcacagaggttatcttataaaacctcatcatttttacaatgccaagatatatagacacttagatggggagtttggaagagtaaaataaaggtcaattagaaaactatgcacatgttcatgtaagagatgatggtgacattgactgaggttataatcatggggatgaaaaggctattttttgaaaatgtcattctcctaatcaaaaaacttcagtactatcccattcacattttttaaaggccaaacttctaaattgaacttttataaacgttgttgagcatttgcagtatttttctttcatagaaaaagaagcactatttttcttacagtaaatgcaagaagcttttaatctacttgaaattcactccacctgaaattcactctaccgtccattctttaaaaatataatcctttcttcaagtccctgctcaaatccctcctgctccaacaagacatccctggtgagcctagctgcttttattcctcctacctctaatctctttaatatttctttgttttgttgtgcttttatcaaaggcaccaacagatgctgccttttatgacagttagggttatctatctgtgaaccactagatcatgcttcgcaaggcattgtattccctgtgtccagcactgagctttgcaccaagggcacatttcataagtattttttgtaagataaatggaaataatgaattcattactagagctgatggtgccctcagagcaactgatctcagatatatttgtggctgaggtcaacaaaagacgagacaattactggttttatatctcttaaaagctgagtcaaacctttaataaatttactgtgactggaaacctattccatatttatttcactattaactgttctccagttttcagcataatttatatgcaccttactctatgaaaacttctaagaacagtttgcctgttcattatttatgccaatgcctataacttaaaagtaaattattcctattttgcttaatttaattttattatatataagccatttgataaatatacataaacactttcatagttatgtaacatttactaatatagattttaaagcacatataatttgtatagttgccatgcaaacatcagactatcaaatattgataaactggttactgatagaaaatccagtctctacatttaagaaagagtttttttcttctaattacagaaggagtatcccttctctgaaatgctcgggacaagaagtgtttcacattttggattatttcagattgtgggatatttgcgttatacttaggttcagtattcctaatccaacatgcctcaatgagtacttcctttgagcatgatgttggtgctcagaaagtttcagattttggaacattttggattttggagttctggattcgacatgctcaacctgtattattttcttatcaacttcaccactttattgtcttccacagtcaaagcaaggtatgagtcaaagatatcaaacttagagggaagaaaatcccattgaggctactgtctatgcataaacaaaggaaattcaaatatcaccacataagttattacaaatttacatattaaaacatggatcaactccccttttctaaattggcaactataattccactcaagtgacaggtttgtatacaaataagaggataagctgttagcagttactgaacactgagaccaaatcataactcaggattgcaaagtgctcatgaatgtggagagatatagtcattgcctaataattaattttaattttttaccaaaattagacttcttataatttcattaaaagtcacaaaagaatcaaatcagtataatttttaatttactctgaaaggcattttctttacattttcctaacatctgtattattagaatatctttggccttatatcattactaaataatgagatagttgaaggaaatgacattttaggagttctaaatgagggacatatctcctccatattccataatccaaaatggtgccttcttgaggaaggataaatgtggagaagaaaggagaggggagcctgcttaatgagatgcagctggattcatagtgtggcctgatagtaagtcccaaatcaaattcttactcacatgcttttgagatagcctcccattagaacccctttcctcttttcccaccccacatacttagcatggcagagggtaggcagatgccaggtgtattttattatgaggtcaatgagtaacaattctgttcctctctcttttgaagcctgttataatacggctacaatgttataaagcaatcatattttattcttttccccagcccacatcatgaatgttaagcaaaaggggagactgaatattacattgaggatgaactgcaaaatactaaagtcccttatgatagtgtttaatcctttattgatcaatgtttcacaaaggtgcattggtcattaccactgctgtacctttggttagatccatttatctgcctggaacatcctctcatttctcatttatctcacttatatcctactgatatttccagaccttgttgaagcccaccttctacatggaactaattttttttttcttgagacagagtgccactcttgacgcccagactggagtgcaatggcaggatctcagctcactgcaacctccacctcccgggtacaagtgattctgctgccccagtctcccaagtggctgggattacaggtgcccgccaccatgcccagctaattttttgtattttttgtagagacagggtttcaccatgttggtcaggctggtcttgaactcctgacctcaggtgatccacccgcctcagcctcccaaaatgctgggattacaggtgtgagccaaggcacccggccgctttctaattttttaatctactttaggtgaatcacaccctcctttgatatcttcctgaatatttcctataccttgtgatagagacagcagagtatagcacagtctttcccaaaatatctttctaatatccttatttgaaaggaaatgttgaagacttaaaaagcatattgatgtgtggaagtctttgaaaagtccttgagtaaatgaagaagtttgttcaactttttaaaactgaacatttcttaaacttctacaacaattgcatctttatttcatgtaataaccttcttgcaaaatacactggagaaatagaaatatatacaggtttggggccagacagacttgagtttataccttacttccatggcttaataaaccatctcattacatttacttaaatcactttaagcttctgtttttgcattaggcataaagaaatgtttcataccagtaggtattccaaaatatgcttcttttatattgtttctccacaggccctgaaattcaattgttttatgcagtttagtgtgttttcttctacagagcaggatatatgttgtgtgcatcttttaaatattaattacaatcttgcacatgataggtgtgggatagattatttctgcctgagtaaagctttatagtgtggctacattgtttagcatttctgatgtagaagatatacaacttttagattcattaacaaaaattttttacattagttctaattttgaatgcccgatgtcattattctcttacatcaaccatatatttgagagttggtggattgttgggttgtctatctaatttcatgagtatattcaatctcagttattcctcatgctgaaactgtcttatcattattgttactgctaatgcatgtcagaagatcacgtgattctggtggtgctgtgactatgaaaatttcataattcaagatatttataaaatcacattatgggaggattccttaaatagtggactctctttaataggcaaactcacacctacaaataaataactttgttttagccagatatgtagtctttatctctgagaaagtttggattgtggttttgaaagatgattacttttggttttgaattcatttcttacaattagtctaatgatccattctttcctggagggcttaatttgtgagttctgtcctctgtaacaacatgaaatctccttgaaaagaacaagttcagtttatttagactgaggccattgcaataaagaacaaagttcagtttgtgctgttctctaagtgccatagataaaattattctgattttccccaaggttaatgggcacagggtgacatttaaatgatattgtaataatctaataatttccagtgctaattagtacaatcccaaaccatgagtgaacataattaaaaatgttttctctttttgagggtaagtaccataacttcacaactaatctaatggtaggtgcttcattacagtttatgcaaacattgaattttactataaatatttggataaattatattccaagtagtactaacagtcaattctcattttttctgcattgcctgctttatgtagagcccccacacacagatcagtgaggagctgctatgtctcctgtgcccggtaggcccgacctagaaacatgaaggaacatagatgggcaatgagtatcatgagaagaacctgggctttggagtccaaactggatttgaatcttggctctccaaaccacattttatttatctatgatgcctgcctcacaaaattttagtaaaaattcaatttatctttactaaggctatattaaaatatgtaatcgttttacatacatcatgtatatgtaaaatgcctggcagagtgccctgatgctaagagctctcatatacatagttcccttttactatgaaattttactacggaatcactttacagtcttatatttatcaataataagtaatgtaggtattctatttatagttctaaattacccaggcctactctttttctcttggagtcagctgcatatttgatagaatcttcttcccatgactttgagactgcctcatgagtggcagtggcctttgtggagtaactattatcagagtgatttggggaaggattaaattgtcatccctccaccatgctccccgtttctagtttaatggtttaaaaaatggttttatggttgttaggattatgtgctaataatattagttaagcttttagaaagtttggaaagtgagaagctgctaaggaatggaatgagttctctatgtcctcaactagaagctcttttcccctccactacttgtttgtggtatccttcaagagctagtaggcttattaacttttctgcctcagtaatgtgtgcataatatataaactaaagaagtgctgagctggaaaattgattttatgcttatagtggtttaaaatttctaccaagcctaataatattactatttttttctctaagagctactattttccgttgcaaaaatagcaggagaggattatgtatagttctaattttaccacactcctcctgaatacaattcttccagaaacacttaatgcttttttcttttttattctttaatgactgcctagtatattgtctcagtattataagtctctttccttaccagattttcagcatatgactaatgagggaagccagtcaactcagatcattttttatttctgagatttatgtaaagttaatgacatcttaaatataattgtgtcaaattagtcagatatttttctgtatcttccttctagttccaacctactcagttacctttacttctctctacaccttctcatggaccctagtgttcagctaaatgaaatacctatcagtgcgcactccatacattatctacttccatgacttttcttacgctgttcctttctcaatttgtcctttctttactctttaatgtcttacttctacctattcttcaaggttctacttaaactatattcttctacataacattctttcatctatccatgatttctgaatctcttttaatctttatatatttaatccaaatacatggattatgtcacattttattacatatttggaaactcatgggtctgtcttacccttagtcctagtctatacaccaaatgaaataagaaattatgtctgtggtatttaatacttaggtttcatccatatggggaaaaataaactctaagaatcagacaaaaattattttaaataaggctaacttatttagaccatagtcatacccatatgaaattaatgtgatttaattaattactagtatgcacagaaaaatatgaggtatgaaagctgattttaaaaaaatcattgttgcccctgagggataaaattttaatggagaagaaagacatataagcattacattagtacaaatcaaggttgatagacacttaaacaagtgccaatagagcacctgataatatcgagaggagaggtcatttcatcttaaaattcatgataatataaagcattcctttttaaatgaaattgaagaaggccatctctttagagagtagaagggtttctatcccttatcagtactgagaacaatacagttttgaaaataaagaaatataaatttaacatctaaaagaatctcaagtgctctcttcggcagtacatacactaaaagaatcttaaacattcctaaggcaaatgtttcagttaaagggggttaaccaatacacttaaaatgcaaacattactttgtgaaacatgttgaaattaaaaataataaagccaaactatttggaatgtcatatatttataaaatatatattttcgtgctacaaggccaaatatatttttttctttccagtcctaaaatatgccctgtatcgtcagtgtagtttgtaggtctgttcatcaaaagagtgggaagtatatcatgccagaatgcatttgctgttcccctatcaagtgatcaccattgttattggctttagaattattagcttctgtacctggatctgaccttaattttaaccacaaatgtgggaatggttttgacaaggcatacagttttggcaagtcacctcacttgggtactaattacttctgggtacccagttactcctgggtcctaattttatctttaaatgcttgttatgttacttattactttcatatgagaattttgataatatgttgtattaaaaaattattagttttatagtgatcaatcaatgaggaaattctctgaaagtgatgtttctttacaagaaaagcacccaggctggaaacaatataaacattgtaaaaatatgtgaatcaacactgtcaattcatattatttttcttagtatagttttagtttactgaattcatatgcttgctaagagctagaagctttatatatattcccactttatatgacagtataagaagatcaaactattatatcccacaggggaaatattttaaatctttcacaattgctggttttccccttaacacaatttcttgattataacatttaagctattatactgctatctatctatctatctactaaattttatctatctatttatctatccatttctatagctagactataatctcttcaagactggtatctgacttcagtttctactactagttcctaacgcagcggtacagttcctggcatatgtacatactcctatagtgtgtgctaaagaaaggaaagaaattaacaagtctttttctcccatgttgtataagcccagtactagttgctctcagacactagtgaataatttattactgttcatagtttaaagaatgctgataattgagtgtattggtttgttattgctgtgtaacaaattaccacaaacttagcaatttaaaacagcacatatttattaattcacagttttgtatgttagaagtctggcactgtgtggttctctcctcagggtatcacaaagaagaaatcaagtattacctaggttgagtttacctatacaatccctatgtgtaagctaggaatatttggaaacagtggaggttcatgtgttcttcgctgaccgtttatggttttgaaggcctaagaggtttcaataaactatgtcgatatgcctagcagctggcgcaaaatttttggtgaagtatttacttaatttggggaggtatgtgtgatgcatgttaagataaaagtaaagctgctcaatggagagcatctcaaaatatgattttcatgcatagaaaaaagctaaaaaatattattcaattcaatatggaaatatttctgtttttttttaagatggaaaatgatgccccagagtcattattctgcatagcacgtaactatctaattgcatttagagaaataaaataaagtttgccaacaacgaaaaagggggaccagaaaatttgttgacagcatatccaatgaacacagtttcggacaataggatgcatgttaagcctgactggatctattcattctcctgtcaacagctggcatgcctccttcacaatggcagaaaagctacaggaagtttctctttggaaaacatgttgagaaattttcttgtctctctatgctccttactgtacactgagatatttttctagagaatgagtgaagaaattatgctattactatagagtgataactaatttacactatgtaaagggatagcacagatattgttttattcacactaaaagcaaataattggaagaatttctatgtaactatgaaaactagaaataaatggtgctaaaatgtgcaaaagatgatacattttcaggcacatattacagagtttcactcaaagtatgactagtatgtgaaatgctggtactcagttgtggatgattttcactgcagtggttaggtaggaaagcttactattaaaagtttttgaatcttatatccccgtttctgaagagctgcccactctggagatttgtttcactgtgattaacattgtacctctcatttacttacttgtcagaggttttattcagttagtatctttttctaaatagttacaccttaaaagtttaaaaatgatcagatttgtatttgattgttcactacttcacttgcaaaaacaagtattacagaaaagtaatatgttaacattagtttatgtatgaaataacctgcaataccaccaaaacttatcggatcagataacctccagttgacattagcaagctttctaatggtgtcatttcttcttttttgaattcctttataattccctctgacatttttaacttcaaaattatattcttctcaaataatagaatatgttgttttctactacatataaatgatttaactacacagtggtttttcttatttttgagttagatacctgataggcttacatttgccacttctataggaaaatgtgcttgcttagattcacggcatatttgaatatctatagcattactgaactgtgatgatttctgctggttcgtcatatcttaattcaagaaggatacttgggaatttgttaaatatttgcgctaataaatctaattgcatttagagaaataaagtttcatcgggaaaataggatgctagagcttgcagcttttcaggacactcttcaattagtgatttataaaagcatctacaaggtgaagtcaaaggcagataaacctcagatatgatctcttgccaacaattttgtctcaagaacttggtatacatactttaagtattctttagaagtcttactacactattaattttatgattgttgatatcttttaaaatattcaatcatataatcgtattttatctatctattcaatgaatttctactacttacctaatatgcgatgaacacatttctttgcattggtaattcagagttaacacagcaaacaaaaccccttgccctcatggaaagtgcatttgaaagagaaggaaataataaacaagagatatatagttaagatatgtaatgcatcagatggccatataaactatgaagtaaaataaagcagggatggcagaaagggattgaaggcagaggctgcagttttaaacagggtcatcaaggagggtctcactaagaagttgagcaagacctgaagcagttgaggagaagctgtgtttttctgtaagagaaggagcattacaactagaaggaataacgagatcaggactgctgagatgggaatatactttttgtattgcaggagcaacaaaaagacttgggtaactggatgtcagtgaggaagaggcggaatactaggatctgaggtctgaaatttaacaaagtgtctgattatagaagactcaataagccctgggaggattttgacagtttctacaggtgtgtcgagatgccattcaaggctgccctgacatacaaagaaacttttacaacaatcttttgtctccccatggtttctctcaagttttttgttggttcctcagatatgtgctacctttattcttctgaagtttctgaatatttgattttggtggcgggaatgaggaactctactagtctgtcatcttgtcagaacttgaagtgcaaaatttcattaaaaaatatgtattttttcagttttatttcaagttcaggggtacatgtgcaggtttgttatataggtaaacttgtgtcatgagggtttgttctacagattatttcattacccaggtattaagcctagtacccattagttacattttctgatcctctccctcttcccaccttcaccctccagtaggtcccagtgtctgttgttcccctccatgtgaccatgtgttctcatcatttagctccaacttataagtgagaatgtgctatatttggttttctgttcctgcattagtttgctagagttaacagcttccagctccatccattttcctgcaaataatatgatcttgttctttattatggctgcatactattccatgatgtatatgtaccacattttctttctttttttaaattcccaacttttaagttaaagggtacatgtgcaagacatgccggcttgttaaataggcaaaagtgtgccatggtggtttggtgcacagatcatcttatcacccaggtgttaagccaacatccattattcttcctgatgctctctctccttccaccccacaccctccaacaggccccagtgtatcttgctacctgacatgtgtccatgtgttcttatcatttcactcccacgtataagtgagaaaaggtggcacttggttctctgttcctgaattagtttgctaaggataatggcctccagctccatccatgtccatgcaaataacatgatctcattcatttttatggctgcatagtattctatggtgtatatttaccatattttctttatcctgtctaacattgatgaatgtttaggttgattccgtgtctttgttattgtgaatagtgctgtaataaacattcacgtgcatgtatctttataataaaatgatttatattccttcgggtatatacccagtagtgagagtgttgggttaaatggtatttctgtctctaggtctttgaggaatcaccacattgtcttccacaagggttgcactaacttatgttcctaccaacattgtaaaaacagtccttcattttccacaaccttgccagcatctgttgtttattgactttttaatgtctattctgagtggtgtgagatggtatctcattgtcattttgatttgtatttctctaataatcagtggggttgatcttttttcatgttttttggctacatgtatgccttcttttgagaagtgtctgttcatgtccaatgcccactttttaatgttttttttccttcttgtgagtttaggttccttatagatgctggatattagacctttgtcaaatgggtagattgcaaaaactttctcccattctgtaggtggtatttttactctgttgatactttcttttgctgtgcagaagcgctttagtttaattagatcccatctgtcaatttttgcttttgttgcataacttttgatgttttttcatgaaatctttgcctatgcctatgtcctgaagtgtattgcctaggttttcttcaagggtttgtttagtttaccactttacatttaaacatttaatccatcttgagttgattttcatatgtggtgtaaggaaggggtccagtttcagtcttctgcatatggctagctagttctcagagcaccatttattgaacagggtatcttttcctcattccttgtttttctcctttatcaaagatcagatgcttatagttgtttagtcttatttttgggctctctatgctatttcattggtctatgtgtctgtttctataccagtaccatgctgttttggttactgtagccctgtggtatagtttgaagtgagatagcatgaagcctttgggtttgttctttttgcttaggattgtcttggttatttgggctctttttggctccataagaattttagaatatctttttctaattctgtgaagaatgccaatgtgagtttaatgggaataatattgaatctataaattgctttgagcagtgtggtcattttcatgatattaattcttcctatccatgagcatgaaatgtttttccatttgtttgtgtcatttctgatttatttgacagtggtttatagtttttcttgaagagagccttcacttcccttgttatctcctaggtattttattcttttggtggcatttgtgaatgggagatcatttgtgatttggtgctcagcttgtctgttgttggcatataggaatgctactggtttttacatatttatttttatcttgagactttgctaaaattgtgtatcagtttaagcagcttttcaactggatgacggagttttctagatacagcattatgtcatctgcaaacaaggatattttgactccctgtctttgtatttgaatgtctttctttctttcttttgcctgattgccctggctagaacttccaatactatgttgaataggagttttgacagtggacaagcttgtcttgtgccggttttacaaggggagtgcttccagtttttgccactcagtatgatattggctgtgggtatagcatatatggctgttattattttgaggtatgttccttcaatacatggtttattgagagtttttaatatgaagggatgttgaattttatggaaggtcttttctgaatctattgagataatcacatggattttgtttttagctctctttatgtgatgaatcacatgtattgatttgccaacaaagatcaaaagagacaaagaaggccattacataatggtaaagggatcaattcaacaagaagagctaactatcctaaatatatatgcacccaatacaggagcaccaagattcatagagcaagtctttagagacctacaaagagacttagactcccacacaataataatgcgagactttaacaccccactgtcaacattagacagatcaatgagacagaaagttaacaaggatatccaggaattgaactcagctctgcaccaaatggacctaatagacatctacagaactctccaccccaaatcaacagaatatacattcttctcagcaccacaccgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaaagacataacataccagaatctctgggacacattcaaggcagtgtgtggaaggaaatttatagcactaaatgcctacaagagaaagtagaaaagatctaaaattgacaccctaacatcacaattaaaagaactagagaagcaagaacaaacacattcaaaagctagcagaaagcaagaaataactaagatcagagcagaactgaaggaaatagagacacaaaaaacccttcaaaaaattaatgaatccaggagctggttttttgaaaagatcaacaaattgatagactgctagcaagactaataaagaagaaaaaagagaagaatcaaatagatgcaataaaaaatgataaaggggatatcaccaccgatcccacagaaatacaaactaccatcagataatactataaacacctctctgcaaataaactagaaaatctacaagaaatggataaattcctcgacacatacaccctcccaagactaaaccaggaagaagttgaatctctctgaatagaccaataacaggctttgaaattgaggcaataattaatagcttaccaatcaaaaaaagtccaggaccagaaggattcacagccgaattctacctgaggtacaaggaggagctggtaccattccttctgaaatgattccaatcaatagaaaaagagggaatcctccctaactcattttaagaggccagcatcatcctgataccaaagcctggcagagatacaacaaaaaaagagaattttagacatttattgatttgcatatgttgaatcagccttgcatcctggagatttgtgtatgttgaaccatccttgcatcctacttgatcatggcagataaactttttgatgtgctgttggattcggtttagcagtgttttgttgagtattttcacatagatgttcaccaaggatattggcctgaagttttctttttttcttgtatctgtcagattttggtatcagaatgatgatggcctcatagaatgagttaaggaggagtccttctttttcatttttttttggaatagtatcagtaggaatggtactggcttttctttgtacctctggtagaattcacccatgaatctatctggccctgggctttttttggttattaggctatttattactgcctcagtttcagaactcattattgccctgttcaagcattccgtttcttcctggttcagtcttgggagagtgtacgtttccaggaatttgttcatttcttctagattgtccagtttatgtgcacagacgtgtttatagtatcctctgatggttgtctgtatttctttggggtcagtggtgatatctcccttatcatttctgattgcatttatttgaatattatttcttttcttctttattattctagtgaggagtctattttatttttttcaaaaaaacagcttctggatttcagttttcgaagggtttttcatgtctctatctccttcagttctgctctgatcttgattatttcttatcttctgctagcattggggtttgtttgctcttggttctctagttcttttgttgtgatgttagagtgtcaatttgagatctttctagctgtttgatgtgggcagttagtgctataaatttccctcttgacactgctttagctgcatcccagttaatctggtatgttgtttctctgttgtcattagttacaaagaacttgtttgtttctaccttaatttcattatttacccaaaagtcattcaggagcaggttgttcaatttccatgtagttgtatggttttgagtgaacttctgaatcttgagttctaattttattgcactgtggtctgagggactgtttgttattatttcaattatcttgcatttgctgaggtgtgttttacttccaattatgtgattgattttagagtaagtgacatgttccactgagaagaatgtacattccattgctttggggtagagagttctgtagatatctatcaggtcaacttgatccagagctgagttcatgtcctgagtatctgtgaatttactgtctcaatgatctagtattttcagtggggtgtgaaaggctcacagtattactttgtagaagcctaagtctctttaaaggtccctaagaacttgcttatgagtctgggtgctcctgtattgggtgcatatatatttaagatagttagctgttcttgttgaattgaaccctttacctttaggtaatccccttctttgtcttttgttctttgttggtttaaagtctgttttgtcagaaactaggattgcaacccctgctattttcctgttttccatttcctgggtaaattttcctccaacgcctatgtgtgtctttgtatgtgagacgagtcccttgaagacagcataccaatgggttttagttctgtacccagcttgccattctttgtcttttaaatgggggcatttatcccatttatatttaagattagtatttttatgtgtgtatttgatcctgtcatcatgatggtattataactggttattttgtacacatgtttatgtgattgctatatagtgttactggtctgtactttagtatttttttttttttttttttgtggctggtaatggtttttgctttccatatttagtgcttccttcaggagctcttgtaacacaagtctggtggtgacaaattccctacacattttcttgtctgaaaacgacctctttctcttatgaaaggatctcctctcctttatttttgaagctgagtttgtccagatatgaaattctagattggaaattctgttctttaaaatgttacattttgccctccaatctctgggttttagggtttctgctgagaggtccactgttagtctgatgggcttccctttgtcggtcacctgcgttttctctctagctgctcttaacactttttctttcattttgaccttggagaatctgatgattatgtgtcttggggatgatcttctcatggagtatcttattggggttttctacatttcctgaatttgaatgttggcctttcttgctaggttggggaagttctcctgataatatctagaagtatgtttgttaaattatttccattatctttatctctttcaggtaccccaatcagttatagattctgtctctttagataatcccatatttcctgaaggttttgttcattcctttttctctattcttgtctgactctcttatttcagaaatatagtcttcaagttcagaaagtcttgcctcctcttgacctattctgctattaatgcttgtaattgcaatgggaaattcttgtagtgtgtttttcagcttcatcaggttggttatgttcctctacattgtggctattttgcctgtcagcccctgtattgttttaccatcatgcttaggttatttgcattgggttacaacatgctcctttagctcagcaaagtttgtttttatctgcattttgaagtctacttctgtcatttcagccatgtcagcctcagcccagttctgagcccttgctggtgagatggttcagtcatttagaggaaaagggacactctggctttgtgagttttctgtgtttttgcaatggttctttctcatatttgtggacttatctacccatgatctttgattttgctgacttttcgatgggtttttttgtggtttttgttgttgtttgtttttatgtttatttgttttagccttgctgcagtttgatgggggtcagctatagaccctagtcacctcattttttcccaaacctggaggtatcaacagtaaaggctgcaaaacagcaaatatggcagcctgtcccttcctctggaagctccattccaggggatactgactggttgccagcctgaaccctcctgtaggaggtggctggagtccttgggcaactcttcagctcccaatcctttagggctctcgaaggcccacagtctggaccagctgagatatttgaacagccaaggtggtggccacccccgttgttctccagacactccctcccagagagaaattagaactgttggctcttgaacatggacagggtggccagaagccctggctgggaggaccctcccatgagaaggagtggatcagggtcccccttaaagaagcagtctggatatgtcttgacaaacagctctgccatgctaaggaaccgcctctgcccattggcttggactctccaaagcccacaggctggaatggctgagttgtctaaacaaccaaggtggcaatctgcctttgcccgagggcactctgtaccagagagaagtcagcactttatctatagaatatgtgcaggcaggcatggctggagaccccagctgggaggtcccatccactgagaaggaatggaccagggtcctgcttatggaagcactccagccatgttctggcaaagcagctgtgctgcactgttggaatccttccttgtccggaccatttggactctccaaaacccacaagctggaatagctgattggactaaacagcagatatggtggcctggtccctcccccagagggctccatctcctctcaggcaggctccactctgttgctggtggctgctctggattccaaaccagtgggtcttatcctgtgagatgctatggaagttgggcctgaagactggcactgctcggctccctggattcagcccccttcctagggacatctcctaggaaggaccttctgccttgcttgagctgcagacaaccttgccagggttcctggggctggagtatgtaaagctcctggatctctgcatgtgcctgagcatctggtctcctgagactttgcccagcttagtgtgtcagacactggtggcatgggcccatgatgggacctcctgatccatggtttgcaaagctctgtggtagaagtgtggtttcctgggatcacacaatcactcatcgcttcccttagctggtattggagatcccttggctctgttgctcctgggtgggccattgctcctgggtgtgccgttgccccaccctgctttttttcattctgggtctgggatctgttctagcccctcttctttctctttgggctattttttaatatgataacatcttgtctcagatttttaatttccaaaggtaccttgattactttcaaatatatgtctgcagttcagacatctttctcttaagctccattttctacatatttaattgccaacataaattctccattttgattttaataggcttcagaagcatagcatattcgaaagggaaccattgatttacctcttgttactttgtcagttatcactgtttctgtaaaatggaatctccatcaactcagtgatcaggggactggaagtttctttgtggctgaagaacagatgtaatggaatgagtcttgaaaaaaagactgtgtagagtgttagataatagatttcaagatttctcatatagagtatacaggggatgtcagggacctgtcactggctgtgggtttagtggaggtataaacattaggattaagaaaaatgagattgagttgttactaaggtaaataagtcaactgttatcaccaaggatgatggtaggaccgaggacagagagaaagatgttgaaccaggtttcaatttacaaaatgaacttagtcatctgggcaggaggtagtcaagtgacagtgatgagaaggatcagagggtaggacagttaaatggcaagggattcagaagagatgattttactccataatggaagagtaactgtttggcattgtttttgaggagctaagcaatgttagctggttgtaacaggacttggtatgtgaaaaaataaatctccagttgaaaggactacaggaagagcaaggtcctctagagaaagctagaatttaataaaagctaggattcttctataaaggagttgaaaatattaatgaaatggaattaccatggaattaggtggtcagagtggagaacaattagcattgtgtaaaggtatggtgggcttttgtcaaaggaaaaacaatataaagaaaatgaggagctgatgaatggttagagatatacattttgggcggtaagcaaagatgccagtggtgaatcacgatgggattagctggcctcaaagtctcagtgagaatctcacataaattaaatggtgttttttccaaggttcaagtgaagatttgggatgacttactaaaattttctgaaacttagtttcttcttcttcttcttcttcttcttcttcttcttcttcttcttcttcttcttcttcttcttcttcttcttctttttcttattattattattacactttaagttttagggtacatgtgcacaacgtgcaggttagttacatatgtatacatgtgccatgctggtgtgctgcacccattgacttatcatttagcattaggtatatctcctaatgctatccctcccccctccccccaccccacaacagtccccagagtgtgatgttccccttcccgtgtccatgtgttctcattgttcaattcccacctatgagtgagaacatgaagtgtttggttttttgtccttgcgatagtttactgagaatgatgatttccaatttcatccatgtccctacaaaggacatgaactcatcatttttatttaaaatggaattattaaaagatagagcctctcaggtctggctgcctaaagcttgaaaagctacctctttaataaagcaaaagatatatggaaaacaacataattaaatagagaataacatcttcagaaatttatggaagcatggcctagtgactcacacctgtcatcccagtcactctggaggctgaggcagttgcttgagttcagaagttcaagaccagtctgggcaaactcatttcaacaacaaaaatatcattatctatctatctatcaatctatctatctatctatctatctatctatctacatatttgaattcttgtaattaccattttgacatgcatcatatatattttgttcaaactcttaataatgtagtaccagattacttcatcattagatcacaattttcaaaacactgaaatgcacatcgaggtcactgtaaattttcatctatttaccaaaaaaccagaattcacagatacaaatgtttgccaatttgctttatagcttatgttaaaggaaggaaacttgtttcttttttatttaaacaacaatattttttgagttttaatctgaagtcttaagatatatatcatagtagaagatcccgagaaatctccttatgtttcccttatgtacttcaactatggtcttcatacaccaggagggcataagaatttatccaaacgtgacttttattttattttttttaacttgagctctgtggtaaattacttaatatcaagttccataagtaaacattcttgctggacatattttgacttttagataatttttcaatatgtgtttaaaaggccacagtgtatactctatcatcgcttttaacatggcccacaaatcatttataaattattcactctttccagctcttttttgtttctttttcttcaaaagaggattactacattccatgtcttggtgtcaaactgtctaagaaaataaattaagaacacagtttgaaggcattcactgtttttctctttccctaacacattattccaaaagcagaatattttttctcaagaatggactacatttttaacatagatacagtttatataggataaaaactataggtcttggaacccagagagttttagatttaagtcctatatcatgtatgttttagcatgtgattaagtaattcatctaacttttctgattcttagtctcctcaactgtaaaatgaggattaagagagataacctacaaaaatgataaagtttaaaaacattatttcttttttcttagtatgaataaaacttacagtggcaagcatacacaactttgaccattttgtaaggtttattttctagcaagttattattaaaatactatttagaaattgatttttcttaagtaattgatatacaaaatgtcagagactgtgactatgatacagatcttaaaagatgaaactgagtctattatactatatatgtatacatatgtatataatatatatattttatatatgtgtatatattttatatatgtatatgtattttacatatatattttatatatagtataatggactcagttaatttcatcatatctacatatatacatataaatatatatatagtataatttgctgttatatatattgcagctaataaatacctagaaaatttgccgtccttctgagggaaactcatgtctcctttacagttgtctagtctacagttataatagaatttctgttttcttaatgcttttgaaatattttacatggcaattccctggaaatatctgtatattttataggacatattggaaaaataatcagtggatatctgtaaaatcttcattgttgctagttaaatgtacattcatgtaataaagaagaagaaaaaaattacaaatgagttcagagttaataaattatgaagtttgagatttatattggaagagtaccattttcctacctgaaatattctacaggctgcaatctgttactttagaactaaaacagtagtttacagaagttttaaaatgctcaattacaagaaacttatttattttggcccattcagataggtaaaatgatttttcatctcaaagtagagtaaatttttgtcttaaacataaaattagaatttttactctgtagaagacagcctacactatattatttgtgtgcaaaatgagtttgacccttctaagaggatcacattcacattatggtttcatacagatatttctttggcatatgattttacttatagtagtataggccaattctcacattttttttgtggaagttgaaggtaatactaaaaaggtagagtaaattgttacaagaagaaaaatgttaaatctgttcaatttctaaaaatatctgcaacttttctccatgaacatacttttcagtagctaccttatcagctttttgcctatttgtttttttttttttttaaatgcatcaggtcagtttgggaagaatttgaattggtgtgcagtgttcaaagtgtctattgtcaaaccaattctttttgttcttgtcatggcagaattttgtaataataggatattgtttcaattagatgtatgcaatagagaaagagactgcaacatagcacacaaggttctggttgaatcttcacggattcagtaagaagagatgtaaactaatttagagttaaacattgctgcctttatacaagaaaaaatccagatatttgagctttcactgtccagtccccccacccttttttttttttttttagaaatagtcacaagtactctttaaaaaattgcaaagtattcctattcaaagaattgatctttgaaatgtttattcactaaactagtataaaatgcataaactattctgagaggattgatattccaacatgaaattattttaaaaattaacctcttactatgctccatgtggatgactcagcttacctgttccttaggcaagcaccctacatttccttttctcccacatacttctggaagacacacagcagtcagacttttccagtgatagtattatcagtttaaatgtgctttgggtttctggataactatacaggttttccaaacgaaatgtgatttcacatgttattggagagtaaggctaagaaaagggtcttgtgttagaatgaagaatccctttgaatttgacttatttcacactatgagcaaatgtcacattcaaacataaatctctggagaaatctctggagacagtactgaaaatttctcttcttggtctatgatttagaccttctcattttaagtcactatatcaaaaatatattgaagaaaacagaatttaaaggtgtctgaattattaaaaatatttcggacactagctaaatgtaaattacaatgcacattcaaggatttctgtataatcattttaaatatctgcgtggaattttctccttccactcatacctttctacactatatcataactaataccctctgtgatcttgacaatatcctctttgaacttgatttcctatgtttaaaataaaaatgatgctttcctataggctaactaattatggtgggtggaatggaagttaatattataaggcactttgaactctcagaacaaagtgctaagtaagcactagacagtggaaaataacgagccagatagtttctgtacctggccacaatttgaatattatagacctaagtaaattatcaatgttccttaatatataaagtcaataactttatatattttatacaatttttattttatattttattgtcactctcttaggattattcgtcactaaagtaagcaacaacaacaacaaaactccttagaaattgaaaggctagagatttgttctgaattctgcatttaaaaatatgtcatagtccatattctattggaactcacttaacactattccaaggtaactgcaaagattgttatttaaactaaggtttagaaattcatatcaatttacatctttatatatattaattatccctaaacacccttaaatataaagtttgtataaaaacaggtaaatcaacttctgatatagtataaattaaatcactgagacaaatattgaacttcaaagtatgcaaaaagtactagaaattttataaaaatatgcctaattaataaaattttataaaacaaaatgtaagactgaaacctatttgagaattttaatatacaataaaattttattataattattatgaaatgatgggtgttgtggcttatgcctgtgatctcagcgctttgggatgcagaggtacagtgatagtatagtttctcaagtgaggaacacttgagctcagaagttcgagataagcctgggcaacaacgtgagaccccagtctctacaaaaaatttaaaaattagccaagcttggttgcatgcccctgtagttccaactactcagggagcagagacaggaggatcaggtgagtcggggagattgagactgcagtgagccatggctgtataattacactctagcctgggtgacagagaaagactctgtctctctctatatatattattatgaaagtaaaaatatacatattattttcttatctggaaatttgttttaatgtatatattgccagttattaagcttctagtgttttcagaagattgctaagaaactgagagctgtggattctgcagcaattattactagcttgggcctagggaaagttacttaacctgagtttcatttccctcaaagggtttttatcagaactaaataaaataatgtctatgagccacttagtacagttcctagtactaaaaaatattaactgccagtgtttctaatatttcaattattataaattggagagaaacacaacagagcacaattgtctctaattcagaataatatttgctaattgtcatgaatttgatgtatatccagcacctcctttccaacaattagagtcattgttttggtttccttctttagtcagtcagagtgcttgtgaagggttagataagatgaactgagaaaaatatacctcatgataaaaagatacagggttctgaaaaccctatttcatgcctgcaaggatattagcatagaacatattaggaaatgttctgttaaataagaggctgctgaaacatttgtaatacagaattaaattgtgaatgatatatcaacttaattaatatttcctgagcagataataattatatatatatatatacacacacatacacatatataatatacatataatttatatataaacacacgcacaaataagcacatttattacatacacacatatgtacattcattacatatacacagttgtaatatatatgtgagtatgtaataaatgtacctatttgtgcatgtgtaatataaatatataaacatgaacatgtattacataaatatatacacatatgcatatgtgcatatatatgtgtatatatttatatacacatatatgtatatatatatatgtacaaacattgccttcaccttcattgtaatgatatcccactgaaatagtagctgatactatgctaagtgaagatgcttattggtgtcaaagatactatctatgcttaagtaaagatactaaattgtatcaaaaacgctaatctcttttggtcataatactgctaatttctcttactacctagtagttttgaacatgcttaacattttttctccttgaactgagggtaacatgaatgagacaatgaaataaaggagaaatctgatttttacaatatttataatgccttttattatttgccctccttttaaaatgcctgtataatttccactggcaattgtaggaatgccatttgtagatgaaaaaaatgttataaatctcttgacttggatatatgcttacagtgcaactaacgtgtatgcaaaatgcattgtcagaattaaattaaaaactcacttgtgaatagtagcatctaaaacagaaaggatatatgatgatttaacaattctgaatagctctgcagaactgtaaatcctactgtgactaataaactccccaaggcagaaggttgcacttttttctttattttaacttcctaaactaaagtttttgaagcttctcaggcaaaggaattaaatttcatgtaaaactagtcttacgatcagcattttactacatttcatcaattttataaccttcatggcttaaaataaatggatttaatatgctaatcatcattatagtactatttattgaatatatatgtatatgtgtatatgcacacacatatatgtactgatgtaccctctgtctatatatagccaccataaaaaaaaatgcttaaagtgaaaaaagcataaaatggcagacatagctccaaacttgaaacaaggacacctaacctcctactctacatcttgtaacctttggctgtgtaatttgggtgaaaacatttaaaatgtttgcactacaatttatgaagcatgagaaggttttcataaaccatctctaaaattcctttcagctatgagtttacaaaaacaacatgattccttcttttcatgatcttcttatggcatcttatttccactatggctttattaaacacttaacccatttcaaatatttggccactaaataatttgttaaagagcacagtggcttggctttgatggttttctctgtgtttaggaaagattggtttgatgaatagatggatgaatggctggatgcatgaatgtgtgaacacaaagagaaaaagtgaggggaaaaatttggggggtagagagagtgagagcatgcacaaaagaatcatctctgttgttaaaaagaaaataaaagattcattgcatgtagcatctttgctaactttcagttaagtttattccttttatgattacctaccatatataatttatatgttagtcaaaattaagtgagtaaagagattaaaaagtttgaactttctgactaaaaaataaagatcagctatctttgattttatttggaattatgaaatccaacgaaatatttatgcacaaatgtttttatataagtttttctagatgatatgctattgatttgcaagaggaatgtagatgtgttgatgcttggtttcaatatttagagtcttttattttaaacacaacttgataaggttgttatagaatatgtatatcttccaataattctattcgctgtggaaaatttcttcaagatatatcaaattttttctcaatattgttagaggaaattatgtgcaggatgaacacataattttttctctactatcttatcaggtaaataatgtttactccacttgcctcttaaatttataagacacaaaattttcaatattcaaactaaaatgcaagtttttagtatgattattaattaccttgtgtatgattattaccttgctaacttgggttttctggaatcgtaataatgcctgtgacaacaaattaacatgcaagtacattttcaagtctacttttgttttaatttaggtttaggtgtaacttatattttatccatacatctgaatttaggtattttattttataagattatatctattttataagattatacctaatttaatgttaaaaagatttaatcaatgattcttgagtgtctaaactattcaggctcttttatacacagtgtaagtataaaaatagattatatggcctaggaaattatattttgctaattgataaggactacctctgtggtagaggaaacaccaaaaataaaaccaagaaggagaaaaatcttcgaatgtttggagacttgttgagttggttaggttagtgaacttataaatattttatttaaaaggcatatttgtgaatgtatttttgggtgaaatgattttatgatctgaagtactgacttatttcaagcacaaaaaatctacacacacacacacacacacacacacacacacacacacatacacacacacagacaccaagcatatatctattaggttaaaagaagaaatttggattgtcattttaaaaattggcaagtaagtatatgtattttgggaatatttaaatacctttctaaaacataattatgtttttttaacagaagtactgtagcttgtcagttagctttgaattgtacaataatttatgaattttcaaagggcatacctgcattaatacttttacatatgacacttcacaatgaaaatttaagccattatcattgctttaatattactataaattgtaattaagttgacaattatatttttgtagaactttgtctaaatttggtatttttttcatatatatgctaattggtccattagtccgtgaaaattgttttcagtagcattacatgtagtacaaactcataaacattaatatttttctaagatataagaagacatgtaaacatgatatagttttcatttaaaaatatatattttggccacttgcatgtcagtatgtttgtataaggattacataaagcctttatttctccccccataaaaggaacagaatatcaacctttagtgatggaaatgactaaaaattgctgtaataggaatattcaggaggtgttcctttcctgctttattgattggttattcttcccttcagtttggccaataagaaatatatagagagtactgatgaaatgctgtgtgtgtgtgtgtgtgtgtgtgtgtgtgtgtgtgtgtgtgtcagtggtggaataattattttatattgacaggtctaatctgcttttcccatgaaggttataaaataaaactgagtgtaaaatcatgctaataaaaatacctgagaaggatctagatgctttgacatcatgttaactacatagttaagaatgttacatttgagcaactatatagttaacaaagtagatctagtacctatagtattggattatctagattggtaatatttgtatattaatacaaagaatagagatgactttgctgtgactattggaagtgggtgaaattagaaaggaatttctgtcccaggatccttcctgtggaactaatcacattgttttcagaatgcttgtgttgaagacaaaatactgcatgcactcctgtagtacaaagtcagtttaagatgagatttttatagctgaagaaaaaagtaaataaataactgggatttgaaatgttggataagattttctgttctttgattacactgtttgcaataagatgaactgtttcttctgtgtacttccttgctgtttgcagaaagatgaactgtttcttttatccattttttcagtatatcttaattctgcaaaggattgactaatgtgctatcatttctgcaggtttctgctgtttattaacccaagtttaatgtttaaggcaatattaagtgttctgccatgtaatagtaaaatgcttccatcaaaaatgtattaccaatacagcagaagtcaataacgtcacctgctataaaacaaggttgataagaagcccttttttaaagactcatttagaacccacgacaacttgaaacatctttgtataaacacacattactactttgcgaatagacatttagattatctggtttaaaatgaattggttatttcagcttcaattgtaaaaaatttgtatcatacttcctaacaaactattaaagaaatttgtatatctaaacctgagagtattaaatttcaatgtaatgattaatctagatctacaaaggattatcacatattaaaataattcttatgaaagctgcttaaattagcaagataggtcaaacatttattgtctaaatgtttttacaagagcttagattaaaaagcattatctggttcagaaaagacaggttaagtaaaaattaaagtctataatatatatttgattaataaaataataatattctcactagtaaacatctgataacatattaaggaagtactcaatttatatgtcaattttaaaaattctggccaggcgcggtggctcacgcctgtaatgccagcactttgggaggccgaggtaggtggatcacgatgtcaggagatcgaaaccatcctggctaacacagtgaaaccccgtccctactacaaatacaaaaaaaaattagctgggcgcggtggcaggtgcctgtagtcccaggtaattgggaggctgaggcaggagaatggggtgaacccgggaggcggagcttgctgtgagccgagatggcgccactgcactccagcctgggcaacagagtgagactccgtctcaaaaaaaaaaaaaaaaaaaaaaaaattcttcattagtttctctcaagttctcagccatggacaggtattcaaaatatataggaaacaaggctatggcttgaggagactgatacaatccatgccaatataaaagagcagtgatggccaggcacagcggctcactcctttaatcccagcacttttggaggctgaggcaagtggatcacgtgaggtcaggggctcgagaccagcctggccaaaatggtgaaatcccgtctctactaaaaacacacaaaaaaatagccgagtgtgttcgcgtgcacctgtaatcccagctactcgggaggctgaggccggagaagggcttgaacccgggaggcggaggttgcaatgagctgaaatcacgccattgcactctagcctaggcgacagaacaagactccatctcaaaaacaaccaaccaaccaaccaaacaaaaagagcagtgaaaagataaagccagctccacactggctttataatacacactgtgtatataatgataatacacacaatgtgaggtttaaacaaatgtgtttaatacacacaatgtgaggtttagacaaatgtgtttaatacacacaacgtgaggtttagacaaatgtgtttaatacatacaatgtgaggttagacaaatgtgaggtgtagaatttgagcatgttgctcaaggtcgtatacttaacaagtgacggtcagtatttaaaatcagtttgctcttagaatcaatgtgtttaccaaatattccattaccaatcaaatagtcaataaaagttagcacagtgtttatcatcatcatatttacacatggataaaaaatgctataattatccattaggacttacattagttccttgagaaatatttatccattccctctgcacagagatttgaatgtctttacattttctataaatattattgactttactattataaaagataatgaaacccgtgttcaaaaaaatggggggagtaagaaaggaaggaaatgaaaaataaattaagatcgcaagaaaggtttgattcctatatattctatgaatggacctcaagaagttttctgaggttatttccttttattcagaaaagaaatcttccagctatgaattccttaaaaatttcatgatataagatatccaatgtattggatactttgtcatgtagaagctttttatacctattatgttttcttccccatgacctccccgcaataacactttgaggtactatttatcattccatttggaagaagtaactatattccttctcagctattacactgcttccagtacaatgtgtttcattaataaataaagtgcatgctctaagtgaaagtatatgttttttaaacacataagtctccttgtcatatttccagaggggatgacagaatatttatgttattatttaatggcaaaattcacttctttctaggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaaggtaaggtcatcagtatttattttggttttttggttcaattcaagtggcaatgaaattatctttgatgaaacttattaaacatggacatcatttttgtatcttgttgataatagggcattattttccttggagatcactgttttgtagatgttaatcttgtattccagttttgaaagggcagaatgtggaaagttattatattaattgaaatataatatgaaaatgaacaaatatttacatgtaaaagctttgcaacatttttatgacttcagtgtaaatgaaacatctttttaaaatagtattttctaacagaaagtttactttggacttctctgagataactgccaccttgggtattgttacaacttgggatgacatatcaggtgaactcatgacaaatgtactgctgaaagaaaaacccttggacactacatacaaatcaaagattttgtattaggactctaacatactgacctacgctataaattttactctctacgaggcaccaaatattaaagcactttcctccttttcctctgtaaacctgagtaaattaaattttttcattggtgcaaagtaatgcaaataccaattatttttaatatattggaatcatcattcctattatgaaggttttgattgaaagatcctagaaaaatggaattttctgtttgcttctattagtctaattaaacatttagccttgatccagaaagcactcactttaaatgaaactattggttgataattgggaaggtctgaatgtttgtgtcccctcctaccccgctgcataggttgaaactgaattcccattctggtggtattaagaggtggggccttcaggagatgattaggtcatgagggctctgtcctcatggataggattagtgcccttataaaacaggcccaagggaacttgcctgccccttctgccattcgaggactcagcaagaaggcaccgtctgtgaagcagaagaagatctctcacaagacacctaatctgctgggcccttgatcttggatttgctggtctccagaactgtaagcaataaatttatgttacttataaattacttagcctgaggtattttgatgtagcagcctaaactaagaaactagtctaccttattttttattgtgatgatgtatttaaactgaagataatgaatgcaaaattaatttagtcaaataaaacatttgcctcattaaaaatttaaatagaatttggcagaagaaaaggcagataccatattaactgtaacaaagttgggcaggattttttttgtaatgcaaacattgaaagagtaaggaaaataaaagtgtctgaaaatgtgtacttttcatttactgttttatctgcttgatgcgcaggtaacatttattgaaatatattttcaatcaatagcactggctactgttgaaacttatttatgttagttagaaaatagatatgtgattggtggtctaaaagttttttccttgttaatggaatggagtaaaaaatcattattttttgaaatgaatagaactgttttaagtaaaaactggctttacaaagaataggataataatgtttataataatacaatgagattttaatttttaataagtaaacattaatgcaaaaagtcagattgaaataaccattcagttatttacattttaaaatcagaatcatcccgacaatataaggatttcaatactggaaatgttaataaatattaataaattttctatggaaatatttaaaagcagtataaattaatattagaaataatagaaggatctggaaaatcataacatagaatttgaagataccaaatcattttaaagatatattcaataggaaatatatgtcattcatttttaagaaatctgtattatttttctttcttaactcttatttgtaaggaccagaatgtgagcaggaaaaacgtgaggactgatttctttctttatcttcttagtaactacatattaataattgtgaattaacttcaaagacaggctaaactacctatgctttttaaaaattaaccttgagtaaaaaagtagtaagaaaaaaaatgaaatgaagacaacacagtggtgagaaaccggaattataaattaagaagaaaaagtccctcacccctttattaaagactataatttgaaaagtaatgacagttttttaaatactacacctttttttttgtttcaacattgctctctttaattattctgctgccagctaaattctgaaaacaaaaatatcttgcaatagtgacgtgacggcactgaaagcaaattgagagaggcaataaggttcccagatagagaccactaggtatttgtcaagaaaaatgaaagagctggacagtttgcctgatggtttctgatactaacaggatgttctccaccagttattgtgatggtcagctttgggtaataaacctgaaatgagttccaggaagctttaaagacaatttgtttccctattcaatatcaagaagggtttcagttaatgttagaagtaaaaatacttatttatagaattttttttgtaaaacggtggcttgaaaaaaataagagaaaatattctattgaaagataacaaacaacccattcagaagcactattttcttcaatgttttgaggaagtaatttaggagaaaacctcaactgtgccattgaagatagtcaactttctctcacatgtttactgcaatactatgcaaacttgtattgagagggactaacatcaccttgtctgttttcatttttttacagtctaaagaaggaaaaaagattcaatgatacaattataagtgattgcttatatattagcactcctaatgaatttatagaaaaactcatggttttgatccctctgcctgtttattcaaatttgaaagtctcatccttgaacaaatagcatcatcaaacatatagatagtaataatgacaaatgataatagggatcactcagaggttagataagtaaaatctaatagcttgaaatcctcaatttattttattgttagaatttcctctaatcagccacatttaagagctggttttttattttaaaaatcaaaatttctgttcactgtatctttctactgttatcacttaataagagagaggaattcagtgacagcctatataacccataaacagtaataaagagtattggtgttttggaaatcttcctttgtagctttggctacagtacatttttggatagcaattaatcctttagaaaatgagtttctagacagatacctcagttataacacggggtacacattccattctctggagatcaatgactgtatctgttaattttgtcagtatttggtaacattgatttcagatctttgaaatacatgaataatagaaaaaaatttctgttttcacaaaagttatctggaaataaattacctattttgagattattcttttttcctttcttatgaatgtatttgttgataagccatttttcatcttttgtgtactgagctgcaggatattaactaagggcaaatacattttcaaaccttaactcacgaggttttcttgacaattttttttttcatttggataggctattttggtatctaggatgtagtgttctccgtaaaaagataaatacaaaaagaaaaaaaaaacgtatatgggttatttttaaaaaccttgagaattataggggtggaaaattatataaatctggttgaatattttcacaatttagatgaaataattgagacccagagaggttaaataattttccctagttcttctagggttaccatgcttgtgtgtagcagaaaaagaactaaaccaagacctcctttacatcactagtccagtatttttcttgctatatacccacccatgcatatatatagacacacatgagatagcacaatgtattataggacttcagtaaataatgtaaggactcaaaaaagtagcagatttatgttttgatatttatttgctatttattatttatgttcaaccatggaatagtaggaaaatttcaatctaggtgataaagaccagttacattatataaatcaatcttgttcttttggccttggttttcctcatttgtaaaaaatgaaggaatctgaatataatgtatttttaaggtaactttcatctctatgcttctatgacccttaagaacacagttctagaattagaaccttatagaaacgatcattatttagtgtccctttagagaaagtttcacgttgctgaaattgcctcctagtttttctgtgtctgactttaaaatagattaaacagatatagggtatccattgtttgttctgccacctcattcaactattcaccacaacccacagtactcattaccaccaatagaattcaaaggatcttgtgctgattcccttaacctgaaccaaagtagctgttcataggttactctttttattcataagttactctttttattttctcttataaattttttcttctgtggcatctatgtacaacatttagcataaatgtacaaatgtttttgtgaaaaacactgctgtcgtttctgaaagcagtacttattgtttatattgttagctcttagctgagatgaacataaaatgggccatgaaaggtggaaatttataagaaaacaaagtcaggaaatgtaaggatggtatatttgtagaaatcctcaagtcaaaaggtgaatgaagtatgaatccatatataattcttacatgtatttgatgtattaagaaggaagtgaagcatcattctttgatatttaatgacaagattcagctaaacaattttgaaataattgctcttattagaaaaatacctaaaaataagctgcatcgtgaatataagggcaacattatactataaagtcacaaatgattctgtttgaaagaaaatgtattaaactataatacttttttatgtattgcaaaacattataaacaatatcattataatttaaaaacacaaggtttttgaaaaaatgtccagtgctttttgaaatataaaaatttgaatcaatatctcaaagtacaattcaaagaagcaaactcttattgtaatatgcagtaatgggattcattaaagttaaactgttgtgatgctggaaatatgaacacaaaataaatgatatttttaatatatataaaaaagttgtagttaatagagatcatcttgcaagtttcagtctggtagaccttacgactacttctttgcatatcttaacaccagtgttgattacccattgctcttgtaaaaggtaaacatttcactaataaaatgatgatttcaattagatctgcctcatatatcttctaaaataaaataatttccagtatatgattatgcttataaaacaataaaactgcattcatttttggtttatgttaccaatctcatttctttatagttataaaaatacatacatatttatttcatgtgtgtaaatgggatgacaggaaattagcacagtcagaaaaagtgcaaggaaatataattaggaaaaagcacatctccaaaacacattaccatccatggtgaatatttctggtcattgattaaatctaaatagtctagtccaaagaagatgtaaatagaatgatttgtgtggctgcattatttgacacttctttccagggattattctcatttatatttcatttatttgcccactgctttaatatgacatttttactgtgattaaaaaatctgctaatttcaaacttcttacactggattctgcaactttcctagcataatactacagtatgtgtaccccaacagcctgtgtttcctggaccaattttgataacttcaattccagcttattttctgaattgtctgacaataaactaaacttgagaattgttgtctgtaggagctgagaaacaaaactaggagatcatgtgggtatgattctattcattcattcattcattcattcattcatccattcgttcatttattcactgttttcattcctactttccttcccacatcaaagtcaaggttgtgccttgagtctcaatgtctatcccagtgctctggttaactctggaccatctacatgtgtgaattagtggaaggagcaaatcgtgttgttgaacagccatctccaaacacctgcacatcaggagggatgctggatgtctattcagtgactaaaccccctgttttcctctatgagggaagatacttagcttggtcctttccccagcaatctcctgccaaaacctgtattactttttctccttgcctgtcacattctaaagactgggccacaaggtctggaattagaatctatcttatgtgtgatctttagtgtccatcatcaatgtagtattaaaggacaaataattctatgcttgttagagacaacaccaatatgcattaagaaaaaaaaaaacagctcacacaaaccttttccactgcagaatttcccattaagagcaattaaaaatatatatatttagaacctaattttgagattactcagtcaaattaatttattcaagtgcttattaaatgcctagtacttccaagattgagccagctacaatgggagataaccaaaaaacaaaagaacacagcatataactccaggaataaaaatgtatttgaggaaagctgtggatttttaaccatgaaaaagcatgccgttcccctctacctttaacttgaggtttaattgtgttaataatagaaggaacaagatggtctagctttttaagtatacttttcaggaaagacaggtattttcttttttttacgatcattataccaaatttatttatttttatttttatttttatttgtttaatttataaaggaaagaagtttaattgactcacagttccacatggctgaggaggccttagaaaacttacaatcatggcagaaggggaagaaaatatattctttcttaaagaaggttattactttacctttaaacaaaatattaatgaagatacaaattgcatagtctaatcttttttcctgttatttgttgttttactgctgtatttgtatgtctttcccttacctcatttgatatcatactcttgaagtaacaggtctctactacagtgaatggattgaaattcagatgtttacagacctctacatcataattttatagcctttgtgcttcgaggacttttacctcactatctacaattgtgatctgttgtgttacctcataaaatatatattttagcaatttgtgctgctctggattttgttttatttggaagagtctttagcagcgttctgtgaaagctgtgtttaaaggaagtaaagatttgttcttttgttgtctgtgttctttcttctaccaattcttttctcctaataatagcacatcactttcttgtattcttctatgtctgtatgtatggtgcatggatatggtaacataattcacttttaatcagtcttttttgaaactgactcattagaggaatcactacatatcttaaattaactctgaatatctggttgatttgattaaaaaccacatttacctacactcgcagttgtaatgagagatcattatgtagtcataaaataatttaagttcatgttgacaaaccaatgatgacttcagtatatttggaattttcaatctgttatcactattatcaatatccaacttttatatgatccagtttacctggttaattttagaagaaatagcaagctgacatttactttcacatttaacacctattttttgttgtccttgacaagtgtaatgaggtttatgggaatcacactgaatagtcttttgggactcatgcaatagtttgttatcttgtaattttcaaaataattattacagaaaagctctcttttaaaaggaacatgcaataagccagtgtgcaataggaaattgcatattctgggaaaaaaaagaaaatgaatccgccagtaccttttgggtgcctgtgaacattcagtcttgtgccaactactctgcacactgtcatgctctccattggctgccctgtcgtcttacatggttaatttggcctttactctgtaacctagtgttaggtcctgacctatgtgtacctctcttctttttgccctcccattatagtactatttttaaactctttatttagcccccttttaatccttgactctccatattatactgcagacactcaaaatgtctgcatttagttcggtatgtaaatcttaaacttggtttcatttacctcgcagggaaaaacatatatattaagttcatagcccatggaattagatacctgcctttattttatgtatgaattctgctctatgtcttattatctgtgggcccttgaacacacctactatttctgagtctcagtttcttcacatgtaaaatgaggataaatacatactccatagcattaatatgattatgtgattattgtgtaatgattatatgggattgtaaatatggtagatgggttcctccactaatctaattacattttaatgatagtgctgtatgtgatgatttagtaccattgcatgtgtccctcagtaagttttcacccgtttccaatatttccttcccaaacatattctagtacttttattagtggttcccatggatacctctgagcctaaccttattacctgcgtagtcagcgacatatttttgcccaaatgggactttccttaccaagattttgagtgctgtggttttaaatatatataatgaaatgcttttcctttttttttttttttttttttcctgtctctctctctctctctttccttgggctggttctgctagtcagcacaggaagatgagaattatacatgtagtgtaatttatttggcaaatagtagtgatgttgcaacatgtgtacttagggttgggaggatttaaaataccttgttaccatttctgggaagtagagaaaggccatggaggccaaattaaagctttctgatgatttgtgtaggcttaatacaatcggtgaagtaaataaggcgctgagtcatagctaaatggaatttggctgtagagcaacatagtgttgtaggagagtgatatatatgaaggttgaatatagaaattaattcaaggaaagctttatgctttgaaagatggatcatctctggcaaatttatatctgacatgattgtttaaaaggttatctttccatgctttgcacatttcattgcaattatacatagggaaatattaactttaaaaactcagtcatttgcttatttgaatttcttgtactgtacttcaaaaacacatgatatcatgttattttcttaagaatttatgcctcacttcaaaacagatttactttttggtctttgatagactaacgtgatatgatggttagatgggttaagtccatttcttaagctatatttcaaacataaatatacattaaaatgtctactatatataaaaaatatatattccaggccatgcaccgtggctcacgcctgtaatcccagcactttgggaggccaaggcagatggatcacgaggtcaagatatcgagaccattctagccaacacggtgaaaccccgtctctacctaaaatacaaaaattagctgggcctggtgccatacacctgtagtttcagctactcgggaggctcaggcagtagaatcgcttgaacctgggaggtggacattgcaacgaggcgagattgcgccactgcactccagcctgggcgacagggcaatacttcatgtatgtgtgtgtgtgtgtgtgtgtatatatatatatatatatatatatatatatatatatatatatatttctcagaatgtattttaggggagggtgtaggtggggaagcagttgacaaatcaaagtcagaaacaatcttagtatagagaatattcttgaatagtattaccttgaatgctaagaaatatttttgtatttttgaatgtatacttatacaaacagaaagttctgaagtggtctcatgtactcattcatgttattaaacctgagcaaggtatagagggctcaggtgagagagggtaactagaggattaaaaattaatacacaaaacagaaaaggtcacattcttacaggtcaagggatgagaagttgtcatattagcctcattctacctgctcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacggatttatagctgaattctaccagaggtacaaagaggagctgatagcatttcttctgaaactattccaaacaattgaaaaggagggacttcaccctaactcattttatgaggccagcatcactgtgataccaaaacttgccagagatttaaaaaaaaaaaaaagaaaagaaaagaaaaaaagaaagaaaaagaaaaaagaaaaagcttcaggccagtatccctgatgaacatcgatgtaaaaatcatcaataaaatactgggaaaccggattcagcaacacatcagaaagcttatccacaatgaacaagtaggtgtcatccctgggatgcaaagctgtttcaacatacacaaatcaataaacataattcattacataaacagaactaaagacaaaaaccacatgattatctcaatagatgctgaaaaggaatttgataaaatccaacatcccttcatgttaaaaactctcaataaactagatatcaatggaacatacctcaaaatattaacaggtgtgtatgacaaacccacagccggtatcatactggattggcaaaacctggaagcattcaacttgaaaactcgcacaaaacaaggatgccctgtctcacgactcctattcaacatagtgttggaagttctggccagggtaatcaggcaagggaaagaaataaaggttattcaaataggaagagaggaagtcaaactgtctctgtttgtagatgacatgatcttctatctagaaaaccccatcgtcttagtccaaaagcttcttaagctaataagcaacttcaacaatgtctcaggatacaaaatcaatgtgcaaaaataacaagcatttctatacacaaacaacagacaagcagtcaaataataaatgaactccaattcacaattgctacaaaatgaataaaataccttggaatacagctagcaagggaagtgaaggacctcttcaaggagaactacaaaccactgctcaaagaaatcagagaggacacaaagaaatggaaaaacattccatgctcatggataggaataatcaatattatgaaaatggccatactgctcaaagcaatgtatagattcaatgctattcccattaaactaccgatgacattcttcagagaattagaaaaactactttaaaattcatatggaaccaaaaaagagcctgaacagccaattcaatcctaagcaaaaagaacaaagttgagccatcacactacctgacttcaaactatactacaggctacagtaaccaaaacagcatggtactgacagaaaacacacacacagaccaatggaacacaacagagatctcagaaataagagtacacatctacaaccatttgatcttaaacaaacctgacacaaataagcaatggggaaaggattccctatttaataaatggtgctgggaaaactggccagccatacttagaaaactgaaactggacccctttcttatccaaaaattaactcaagatggattaaaggcttaaatgtaaaacccaaaatgataaaaaccctacaagaaaatctaggcaataccattcaggatagagggagggacaaagatttcatgaagaaaacgcccaaagcaattgcaacgaaagcagaatttgacaaataaatataatttaactaaagagattctgcacagcaaaataaactaccatcagaacagaaaaccaacagaatgggagaaaattttcacaatctatccacctgacaaaggtctaatgtccagaatctacaaggaacttaaacaaatttagaagagaaaaacaactccattaaaaagtagtcaaatgacaagaacagacacttctcaaaaataaaataaaaaaacatttatatggccaaaaacatgaaaaaaagctcaacatcaccgatcattagagaaatgcaaatcaaaacaacaatgagatactatctcaagccagtaagaatggcaattattaaaatgttaagaaacaacagatgctggtgtgactgtggaggaagaggaacacttttacactgttggtgggaatgcaaatcagttcaaccattgtggaagacagtgtggcaattcctcaaagaactaaaaccagaaataccatttaacccagcaatctcattactgggtatatacccaaaggaatataaatcattttattataaaaatacttgcatgcgtatcttcattgcagcagtattcacaatagcaaagacatagaatcaatccaaatgaccgtcaatgataaactggataaagaaaatgtggtacatatacatgatggaatactatgcagccataaaaaggaatgagattatgtcatttgctgggacatggatggagctgtgagctattttcctcagcaaactaacacaggaacagagaaccaaacaccacctgttctcacttataagtgggagctgaacaatgagaacacatggacacagggaggggaacagggaggggacttttgggggttatggagagagaaagcatcaggataaataactaaggcatgtggggcttaatagctaggtgatgggttgacaggtacagcaaaccaccatggcaaacatttgcctatgtaacaagcctgcatgtcctgcacatctatctcagaacttaaaataaaatattttttaatcctatttattatgtctgacaaaatggaaacaggcaggctttatgtcaaaccactgtccttcagcttacccacaatttatgccagggatccatgtgagcacagaataaatcaccagttgatatagttaggcttcctttttccacccaaatctcattttgaattttaatcttcataagctccatattccccacctgtgaaggaaaagaccaagtggaggtaattgaatcatgcgggcagtttcccccacgctgttctcctgatagtgagttctcgcaagatctgatggttttataagggggtctttccccttgcttagtatttctccttcctgataccttgtgaagaagatgccttgcttcccctccaccttctgctatgattgtaagtttcctgaagcctttcccagccatgctgaactgtgagtctattaaatctctttcctttataaattacctggtctcaggcagttctttatagcagtatgaaaatggactaatacaccagtgtacattttctttctttggaaactgcttaatgcttaaataagagaaggggaggccaaatgacggaaactaggaatttccaaggtcaatttattctttcaaaaataagaatcataattgttcacttatttgtaggatacttcttattcacggtacactagattgggatttatacagatgagttagactaatttaattcaagtactcaaggaatgtatagtctactaggggcaatatacaaagagatctagaaaagttgataattttatttatagtggaaacaagtgacataaaataatgatactaaaataacaggtagaatgtgtatgatttaaaatcaagggctcattttttataagatgatgatgatggatgccaaaaacaaacaaaaaacctttaagatttcaggttgagtagtagacagacatgaaaatatgaagggaatagcattccaagctatttcatatgggaaagtaatttggaggtaggagcttgctgtgttgaggaactatatgttcttgtggacactcaaatttttattctgttgccttacaaatatttatttccatcatcaatgtcattccttgcttgtcaaccatattacttgtgagttttttacctaaatcagctttggttccttatactccccttggacatggtgtgtattccgaaggaaaacctggtattcctgcagatctcactgacattttggcatggagacttttttactggaccctttttagattttaaattcacctgctataattctgattttgaatttaattatggaaacataagagcttttcctgtaagtgttcttctttccaggaaaactaaaataaataccaaaatttgtttttgaaaataaatttactcagttttcctgttcttctaacacagagtaattcacagagatatattattgaatcctaagaaagaaacctcattttgtggcttttatagttttctgtacacttgtacaaaagagcctcatttgataaagccaatagtaagagacatttattcataacttatcacatccaatgaactgttgaaaatactttgttttctcctgatctttatactgacttatgaggtataaggtagttactattcttattagcgttttacagatgaagaaaatgagcaacagctgggttaggttaacttattacacctggaacctttagaatagtggctagaacactagtttcgctttaagtctgctgattgggaggttcaggcatgtttcagtgagaggaagaagaaagaaggtaaggcatttattttctgtcttctgtgtgtggttgtcttaagctgactgtacctcaaacaaaattgatgtatctcttgatgcatcctgctctgtatcactctcttgaaattcactgtcttgtcctttatcctttgggcctggaactggtaccacctcactgctactagctctgggtttttgcactattcccctttcgttggctgcactccacccagacctgcgtaatttaacccattgaaaaagaagccctacctaaattatcctattttgagttgccattgttttctattggaattttaaccaacatcattatttaactcatatttgtctaatctaatcagaaagtgttacatctttgattgtattataaagtcaatctatgtatcacattacaaaacacagtaagggtgcctcacaaagatttctagcttctgtgcattgcaagataaaatctgtatgttcatggacactttaatgttgcagcaaaggtcgacatgatgttggagatactgagtggcagcaccccttccaaaaggcagtaagtctgagcagaaacacagctatctccaaattgccaatacacagcatagttgagtgtctgaacttactcatttatgcctggttgcaattttttgaatttttgcaatcagaccttggtaattaccttgagcagcaggatataaataactcccacatgcttagcgttccaataatggaacactaggcataagtgggtgaaggaaacatcactatttttaatttaaataatatgacaaatgaaataaacacgaatgttaatgctgaagttatatatttaaaatgtcttcttttaagcctctactttggttaaggaagttgatgaatcagttattcaaaaatttcttaatattttattttttgtgataagaatttttcagtgtttttcctttatttcattctttgtaggagcgttatactgtgtaaactagactcattattaagttactgggggtggggaagaaccgcaagttactggtgaacatttttcatagccaagattttcttttgcttggtaactttctgtcacctattacctagaataataatgagaaagtaacgagttacaacagacctgtttgcatctcatatctttttgtttcccagacttactcattaaataagtgctaatgaacagcaaatggccaaacaccaggcagtagagcaggcagaagagtaggaaaggtcttacaagatgtgatcagtataataaggttctcaactccatcactaattcaacattgttcagcctttcagcacaagacactgaggtagaattagcgaagaatgtagaggtaacttagaagcactctacctcttccaaagctttaaactatgaatgaagatgaaaaatgtgtgcgtaaacaataggataacaaggcaatatgtgtaagttctgtgaaggagaaacaaaatacaaagttcagtagaaaaagaggtgacttataactaaggatggcaagttgaggggggaaggaaaaaattaatgaaagggaaaagtagtaagctctgctttcctttctgaaaggagaaaaagtctaagcaacagaatcaggtatattcaaaaataaatccttgcgactgatagaaaaatgggaggtaggggctggaagatattgagaatgtaaacatcatgctgcaaggacagaaacagtaacttttctctcaagatctgtgtcctattcccaacttcaaggacacctctttcccaaactagtggtgcaatagtgaattcagcatggaaagactcatgattcagcaagtaaaattgaagactaataaagacattaataaagatatcaatcttcatataccaaagtcttattatttcttttaaaatgcagcaaaagtaatgaaaatggtttgagttcaaagatgccgcttcaaaggtacaatgcctccactgtgttttaagagcaagtgatattttaaaataattattctacatcttcaatggagtaattgcttttcacattaaagaaagagataagcgcccaagttttataatataaaaagtgctatgcatgtgtattaactaattctctcaaaggagttttactacacatttggcattgtgtgctataactcagagtgtcatggtgctgtgctcttacatgaaaacatggatggtttcctaactgagttagacagaagtagataaagaatatcaatatcatgtactgtggttcctttatatgcatagtttatggttactatttttttcattaagtgagataatgttttaacataagtatttttattggtctgattattacaagtggccattgaggtttgtttattctgaataaaacaagctcttcaatttgtaaaaattggccactttgttaatcgttcatttattctttcacccaaatatatattgagaacttataatttgcaaaatactgtaagtgctaaataccaaggtgcatcaatgtgctttctggcttcaaaaatttgttgtttagcaaataaaagacataaataacattaatatagatgtaaacagtcataatacaaagtacagtaagttataaagttttcattagtaaagatgaagtgttagaggattttgagaagcactgatgttggtatgcttactttctgttcttcacacacagcttgaaatacttgtttttccttacatgcttagtgtatccccaatatttggtaccaaatatataacagtctgctcgaggttatttaacattatttcagtcttgagagccttactatgtggttaagttttcattaatttaattaatgtaacaaatatttatcgagtgtctatgtgccaagtattagtctaggaattcatggtaccagtgtaaaacacaatatcttgctctctgggaatgtatattctagttgaagaaaaaaaataataaagacaattccagattgaagagttagtattaaaaaaaatgaagtagcatactaggcataatcatgatgatggtgaggtgccatttaaaataaagtggtcaggaaaatcgctttttgagaagatgacttttgagcagagacctgaatgatgaaagggcaaaagtgatgtggctctccagtggaaagcagagtgtacaacagttactggaaataatatatattatatatatataataatagtagatcactataatttttctttcttctcgtgaccacattagtaccttatttccatttatcatgtaactgtcatatctttgagaataccttcttcaattatctgaccactacttgcagtcacttatattttcacaccctgccttgttttgaaaattcatttttaaatcaaaattacacatactatagatgcagtttatctgcatatttgattttatttagaaactctgatcttgaaaagagagccagtgtatctgttaattaggcataatctctttactattgaaaatgtatgtggattatcactattatctgttaccataatttaataaacttttcatccacaatgttaaactattcaaaagagtcccttaccctcttctacagtagcagagttttagctgggtttatggtcccccaaataagattacatttcatacctttccttgatcctatacagagggccaatggaatgtgaacagaggtgtggacaacttccaagtcattccaacttaaacacaagctctttgccttagactgacaccccctttcaatgacctggaatatttacgttgctgggacccaggttttaccaggcagatggggacaatgcattaggggatgactgagcaacaagataggaggaacatgattctcctgtagagaagagttgccctggctggactgctatgagtaagagaaaggcatctctgtcttatttaatacccactttatgtgtgtgatattgttccacttttaaccctaaacataacgatcatacctgtctctaaatatttcactacatgtaacagaagtatcattctgcccaccttagtaaggatatccaattctgagaactcagatgctccacttctgttttttaccattttcttcttttcctttcccttccccctccttttccacttcctcgtccttcacgctgtactgagacatcatttagttcatcttattaaaatgtacaattaaactattaatagtaagtttacagagttatatggccatcaccaaaatccatttgtagaacttttccatcacccaacaagctctctcaagtccaatcaattgacagttccatactaccttcaagccaaccacgaattgtttctatagattagcctcttctgggcatttcattaaatggaattagataatacaaaatcttttgtgtctggcatcttagaatgagtttttgatgtttatctatgttgtagcaagtgacaagatttttttcttttaatgatgaatagtgttctattatagggatatatcattttgtttttccagtcaataattgaagaaacttagtttccagcttctcttaggaaaagtgctgtaatgaatatttattgaatagtctgtgtgtgtgtgtgtgtgtgtgtgtagctgtatatatatatgtgtgtgtgtatatatatatgtgtgtatatatatgtgtgtgtgtatatgtgtgtgtatgtgtgtgtgtgtgcatgtgtgtgtgtgcatgtgtgtgtgtgtgtgtgtgttttagcctgcttaggctgcataataaaatacaacagactgggtgtcttaaacaacagaaatttattttcttacagttctggagtctgagaagtccaagatcaaggtgccagccaggttgaagtctgttgaggactctccacttaggtttcagagggccaccctctttatatgtactcatatgatctcttctttgtgtgtgcatgaaaacagagtgtgctcaagccctctgatttctctgcatagaaagacactaatcctatcagataaggactccatccttatgccgtcatttaaccttaattacctccttagaggccctgtattaaaattaatccacactgagcattagtgttcaacatatgaacttttgaggggacacaaacattcagtcatagcatcttactagggtagatatttagggagaaattgctcagttttatgatacattaatgtttaccttcttatgtaactggacagctgtgtactatttcacattcccaccaatttcttcacatttttgccacttttgtaaaatacgtgaagtggtatctgattattgttttactttgtatttctctaatgattagtgacattgagtatctttttactgacatctgtgtattttctttgatgaagtgcttgttccaatcatgcatacatatttatttgaggttttttgacaatcttatttattttgaagtattcctttataatcttgataagagtttttttttaatcagatacatgtttgcaagtatcttctactagtccatgattttcccccctattttcttagtggagtattttaaaatgcaaattaaaaattttgctgcagttattttttaaacttatgtgtttagctttgatattgtatctaagaatatattccaaggtcattaagattttttttcatgtcttctagaaaatgcctatatttaacttttatatgtaagtctatccgttattttgtgtttgtgtttgagtatggtatgaggcactgttttggcatggggaaatccaatttaacctgaactatttcttagaaaggttatcctttcccctgttgaattattttggcacttttgttgatagtatgttgaccatgaatataggagtctatttcagaatactcgtgtcttccattgatctaaattcctgtctttatgctagtaccatattgtagctttatggcaagttttgaaatcttgaactgtaagttttccaacactttttttctttctaccgacttatttttggttattgagttctccttgttttcatataaatattggtgtcagcttgccagttgctgcaaaatagcatgctgggaaattagtaacaattctgttgaatgtataaatcaatttggggatgattaccatcttaacaatattgagtatttcaatttatgaatttagaatacatatccacctatttatatctgctttaatttctatgcagaaagatttttttggctttcattatacaaatcttgctcttctattaggttatcttaggattttattcattttgatattgtgaacggaatcatttcttgtagttatattgttcttgctaatgaataaactctattttttgtattttgatctgaaaacttatggccatgaggaactcaattgtttgttaaagtttttgtggatctgtcaggattttctgcaagtaggatcatgttatgcaaataaatacatttacagtccttccttttaaatctagatgccttttctttcttttatcattttttggttgcagtggcttgaacctccagaacaatggtgaatggaattttgaaagtaaaaaccatttcctgtttctaatattaggtagcaagcatttagccattgagctttaaatatgatgttagctgtatattttccaaagatgctatttatcatgttgaagaaatttcctaatactcatagtttgttgagggtttctaatcataattgatgctgagttttttgaaatactttacttgctcattgaggtgatcatgtggtttttatcctttattctgttgagatggtatgttgcattaattgattttcagatgttcagccaaatttgcattcctgggataagtctttaaaggttatggagtaaaatattttttacatattactgaatttagtttgccaatattttgttaaggactcatgaatctgtattcatgagatatattgatctgtgatattctcttcttgtgatgttttagtatttctttggtattttaataatgacttcaaaataacttgggaagtctgcctttcccttttgttttctagaaggctttgtgaaggattggtattattccttctttaaatgtttgatagaagttagcagtatgttctgaagactttttgcaataagattttgcattattcaattatttacttgctttgatctattcagatttttctcatcgctgagtgagtttgatactttgtgtctttctaggaatttgtctattttatctgctctgctaacatgaagttgttgataattttttttataatcctgtcttgttggtagagaggttctctttcattccagattttggcaatctgtaccttctttaaatttttgtcagtctagcaaatgaatcaacttttgattgtagtgatttttctcctttgtgtttcttttttatttcactgattttgctctttattatttccttacttctgtttaatttgtgttatttttgttttttaaacttttttacttggcacatgataattctgcatatttatgtgatacatagtgatgttgagatacatataatatatagtgattatatcagggttattatcatatccatcacttcaaacagttgtttttctgtgtttgttggtgcattccatatcctccttctagctatttgaaaccatatattattattaactatagtcatcctacagtgctatagaacactggaacttattcattttatctagctgtaattacgtgtgctttgacaaatttcttcctatcctgcctcctctctacacgttccagctgccagcatcctcagttctactttatgcttccatgagaccagttttcttttagcttccaaatatgaatgagaactatttgctttttttctgtcttaagttagcaacttaggttattgacttaggatatttttttcttttccaataaagtcgtttaaagccataattttgcggttaacactgctttacctgattgctataaatgtaaacatgttgtatttctgcttttattcagttcaacaattttttttccaattttgtcttgtaatttatttcaccaatgggtgcattgtttaatttctgaatatttgtggacttctcaaatttctgtatctttatttctgttttttccctatgtgaccagatagaatactgtatgatttcaatcattcttgattcattgacacttactctatagtccagtgtattctattctggagtatattcatgtgtgcttgatagaatgtgtatttgctattattgggtagagtgtactacagatgacaggtcaaatttgttgatagacttgttctggtattgtctttccttgctgatttcttacctattaataactgaaagcaagtattaaaatcaatagcattttattattgaattccctagtctatctttgattctgtcatctagatttgcctcgcatatttaggtctcagtttcaggtatttacatgtttagaattattatattttactgatgaatttagtcttttatactttgctatgttttttttttttcttttagtaacctcatttaccttaaaacttattttatctgctgttaattatcttagtctggtcaggctaccaaaaaccaaataccataaacagggtggcttaaacaatagtaatatatttcttaaaagtctggagactaaaagtccaagaacaatgtgccaacagttccagtgcctggtaagggctttctccttgggttgcaaatgcctgccttctcactgtatcctaacatggtctttctttgatacataccgaggtggggtggggcagggagaaacacaaagcatgaaaacccaaaggatcaagctctctgaggccttttcttctaaggacactaatcccatcatgagggctctgcctattgacctcatctaaatccaattacctctgaaagacaccatcttcaaaaacccatcacattgaagcttagggcttcaacatataaatttgagaggaaacaattcagttcataatatcagtgtagctacactaattcttttatggttaccattgcatgcagttcatcgttataccatccacctatttgtatttgtgttttaaagtgtttctcttacagacagcataagattagatcttttttcttaatccagtctcaaaatttatgccatttactataggtgtttaaattatttatattattgtaatatttcatatcattggatttttgcctgaattgtgctttttattgctatacctcatcatattattctggctattcttttttactgtgatctttttgttaaatatataaattgaaatgtgtcattttaattccttattagtttttgtactatatatttatgaattattttctatttgtgctaggtatacaatatgtgccttaatgtatcacagtctacttcaggttaatattaacttgattccagtaagatatacaatattgctcgaataacttctacccactgttgttatttctactcactgttattatgctgttattgtctttatatgttgtatgttcaacaacacagttttgtaattgtgatttatgcatttcttttaaatcagttaaagaaaagagaaaataaactatgtacactatcttcatatttgcccacataattatcttttccatttctttcatttgtttgagtggattcaaattagtgtctgatttcatttcctttcagaatgagtgctgctgtagtgtttattggaagaaaaatctgctagcaatagattctctcagtattttaaaatgtggtaatattgtgatttcaccttcaattttgaaggatagttttcctggatgtaggattcttggttgacagattttttttttatttgtttaagcagtgtctttccactgccttctggcctcctttgtttcttgtaaaacatcagctgctaatttattatggtttcattgtaactgatgagttacatttctcttgtttcctttaagtttttttctttggccctgtctgtcagtagtttgactatgatctgtctaggaatggatgccttcaggtttctgctaactagattcattgaacttattgaatatatgaatttaatactagcttcttgaaatttggggaaatttttacccataatttctttagatttttcccctctttcagagactcttattacatcattattacatatgtgtgtttttgttattatatatgttttgtttttgttctttgtttttttcctcaaagaaaaaaaccagttgttagacttagcatacagtgttcctgtatttgttgactacagggacattgaatttcttccttgtatttattgatatctgggagtatttagataatatattatagcatattaggtttgcaatcctttgatatttgttaatatttttgtttgcttttttgattgctgtttttttctagagaatcattctctgctaaatcttttgtgcatttttggcagtcttttaagatgcttaaacttggcccataataatggcatatatttatggggtacctagtagtgttgtgtgatacatataatgtatagtgattatatacactaatgtatagatcagggtgattagcatatccatcatttcaaaactttattatttgtttatgttgggaacattcaatatcctctctctcgttatttgaaactatataatatatagtttcaaactatatatatcctacagtgctatagtacacaagaatttgttcctatctagctctaattttgtgtctgtgtacccttactaccctctagtatcctcagttctacttttgttttttaaaggatctagcatgcaagtacagattgtgcaggtttgttacataggtatacatatgccatggtggtttgctgcacctatcaacccgtcatctagcttttaagccccgcatgtattaggtatttgtcctaatgctctccctccacttgtcccccatccccgacaggccctgctgtgtgatgctactttttacttccattatataaattatttttggctttcatatatgagtgagaacatgcagtgttttacttctgttcttggcttatttcacttaatgtcctctagtttcatccatgttgctataaatgacaggatatcattctttgttatgtctgcatggtaatgtattgtgtaccacattttttatccagtaatctgttgctagattccttggtttgtttcatttccttccttttctctacatcccggccagcattttttattttttgttattttgataatagccattaaaactacagtatgatacaacatcattatggttttcattttaatttccctgatgattagtgatagtgagcatttttttgtatacttgctagacatttatatgtcttctttgaagaaatgtctattgaggtcatttgcccttttcttaattagacgattttgtgttgttgttgttgttgttgagaaatttgagtttcttttatagtctagatattaatcccctgttgaatgagtagtgtgcaaatattttcttccattctataggttgtctttttatgctgttaattgtttcctttgcagtgtagaagcttttaggtttgacataatctcacttgtttatttttgtgttgttgccggcgttttgaagtcttcctcataaaatattttctcaaatcaatgtcctgaaatatttttcttatgttttcttctaaaaattatatattttctagtcttacatttagatctttgatctattttatttctgcatagtgtgaaaggtggaggatctagttttatttttctgcctatggatatccagttttcctagcaccatttattgaagagattgtctctgccttaatgtatgttctggatgcctttttcaaaaatcagttggctgtagatgtatggattaatttctgggttctcttttctgtttaattggtctatatttctgttcttacgaaagcaccctgctgttttggttactacagctttgtagcacattttgaagtttgatagtgtgacaccttcagctttgttcattttgcttaagattgctttggctatatagatccttttgtggtttcatacaaagtttagagatttttttccaattctgtgaagaatgtcatgaataagagttgcattgaatctataggttgctttgggaaatatggtcattttagcaatattaactcttcctatccataagtatgggatgcttttccatttgtttctgttattttgggtttctttcatcagcattttgttgttttctttgtagggatcattcatctccttggccaaatactatacacttcattgaataaatacttactattccgaggtaatttattacttttgtatctcctgttagtgggattatggtttttatttatttttcaggtaatttattgtctgtgtacagaaagactactgatttttgaatgttgatattctatcctgaaactttttgaatttgtttagcagttctgagagattttgtgtagtccttacatttttctagatcctgtcttctgagagtggggacaatatggcttcctcctttccaatttggatgccgtttattgctttctctctgatatctctgtttagtttttgtttgaatttgtctttgtttttttaagcctggatatctaggagttgcttttgagtcactatagcttaatggtcagccaaggattattcagagcttgtgtttacgtagtatgagtaaattttccactctttgctgataggtcagtggagaaacttatttaaagttcaggcactatgttggcatgccttggctttgcattttgataattctatttgtgtttcttctgtgacagtgcaaggtcttatgttggagaagcaatatgtaggcagctagagccctctccagtatttcctgagcatatgcataactttgctaatatatgcagcttcccagaccaggaggggcttatagagtttatcaaggaccactgtgttgctgtctcattcctcagatcttgtaaaatttctgactagtattctaatctgttgcttgaccaagcttgtattgcaacctcaggtttgttgagatgttggccttccttgatttttttaaataccaaaactgttatcatttttggcaattccctgagtattgttttctctacacaccattccaaatcaaatcagctcccctcccaaccccggcatggaagctgttggtttttatggctttcaatgccatgctaaaattcagtgtcatgctaaaatgacacagacacactcttcttatgtgatgttcagtattttcagtatttgctattaaataagtgatttccaatttgttgtatgtctttgtttttttgtttgtttttagaatccttaaatagtttcacacatgagttttatttagttttatcattgcctttaaggagatttgctgagctccttatttggccatttgcgaagttacacatgcctttttttttcccccacaggagggatagagaaatttagaccatgtgattcagtttttatggaataagtgtcattgtaggtgcatcatgaattataggcaatatatgaaatttacttttcatggtaattctgatgaaaagaagaatgtcagaaatgtggattatgggtagataacagccaatagtgtggttagtctggaatactatctattttgaggaccagataagactggcatgggagattgaaatgagctagtaaaagattttgaatgtgaaactaaggtttctaaattaatatctttaggtaatatcaaagagtggaatggtttgagtgatggaatgacatgatttatagatgtgcttcagggaaaagaaaatagctgcctacaatgtaagtgatggattaagggtcaaaaaactgaaataaaaccagtcagcagtcttgtaatagtccaaatggaaactaataaagtctcaggatagttattatcagaagggaaaaaagtaagctactatgaagctatgttacaggaggtcttgggaaggacttgaataacttattatatatctgggaccagtaaaagagagactcaaagaacgcttctagcatttggcatttggtaactggacaagtatacaattagcacaaataaagaacatagaaggaaagacagatatagggaaataattgtaaatggtagttcatatttattgaattgttactataattagatatagttatgagttttatgtaaattattagttactccttacataacactttgcatataataggaaacaaagggagccagattagtcaactgtaccaaaataaaatagctaatatatgacagtattaggacacaggaagtggaacatcacacaccggggactgttgtggggtggggggagtggggagggatagcattaggagatatacctaatgctaaatgatgagttaatgggtgcagcataccaacatgacacatgtatacatatgtaacaaacctgcatattgtgcacatgtaccctaaaacttaaagtataataataataataataatgaagacacattagctagaggaacaaaataaagaatgccaaaaaaaaaaaaaaaagaattttaacccaggcattctcagatcagagctgagatttttttctgacttttaagttgaggggtacatgtgcaagatgcacaggcttgttacataggtaaacatgtgtcatggtgaattgctgcacagaccatcccatcactcagattttaaacccagcatccattagctattcttcctgatgttagattagagctgagattttaacccctgtctgaatataggtctcaggacacatttagaaaaggaaagatgaagtgatggtttaagattttattgtctgagggtgaaaagttaaaattgtgatattggacaagattgtcaaagataaacatatgagagaagagaaactcattggcaactatttacattttgtgggaaaaaaagtttaaaattaaaagatgaaccagtgcaaaatattatctctaaggaaaaatgattattttggtgtggttattttaactgtgatgggatgttgcttggatcaggtgtataaaaactccatagatgaatagttggtgcatacctatagtcccagctataggaagctgaggtgggaggattgtatgaccccaagagttcaaggatgcagtaaactatattacatcactgcacttagcgcagggcaaaaagcgagacatcatctcttaaaaaaatccataaattccagagataaggaaccaagtaattaaattatggagagaattttcattatggtagtagtggttttaaaagaagagcagtaccagcagtaaggagtgagtggatggaaaggattaaatactgtaagtagaatttttcttcaaagtttgataatgatgaaggtaaatacataagaatagctagagtttggtgaaacatgaaacacacagaaattttctgaagaaagagaaaaaattcgaagagagagagattatgatgacagtttggtttagaaaggagctaaagaggagaaatttgttaaacattgaactattgagctaatagaacaatcatgtttgttattagtgaagaggaaaatggaaattcatgtggagtggttataataatctcagtaataattgaggcaatgtggaagtacagtgcagagtgaaaaagatttgaaaatgctactggggagagtcaattagagatgatggataatatttctgagtcatagtaagaattaacctgagatttcatagcaagaatctgtaagagattttataataaccatttcatattttcctgtaatattaggaatgccaatactaaaaaggtcacaattttagatatggatgttgctttactgttttcatggttaggcattattttctgaattttcttataactttaagaactcttgagtgaatgagtcttcagaaagaaaaaaattctcttggagtggatgctctttcccgactctcctaatatatgttaaggagattttaggaggatattttaagagatttggtaatatttctgtacaagagagtaataagaatgaggggaaaattaagtggtttaacatttttggaataatactattttttccccttgggatttcccaaaatacacttgttcaaagtgaacatcagtccctcatttttaaaaaagatttcctaaagatatttaagaggttttatttatcagatagcattgatagagtgtattatttaccacttggtctggatcagtcatcgtcatcatcttaatggtaaagtggagagtgcatcaaattttgagtctaaagcattagcttcattcctgcctctgactcttaggaaatttatctaagtacatattcctgagctgtaaaatggggataaaaatacctaaatgacttcacaggtttattgtaatatccaataggtgatagattggaaagtctatgtgaattattaagtcatggcatttgtttttaaatgccatatttatcaacaagcaggcccatgctaggctgaagctgaagcttctgtgtcttccaaaaacattttgttagtttaaataaggttcatcactattgggaatcttttgaagatgaaaaacttgttttctagaattaatatttaaatcaactttaaattggtctataaaaaactaataaaatttcaaagatttcaggctgattatctttcattataaaaatattttaaaatagttattttataaaaaacattcacctgcattagtttatgtacatcaaggcaatatgttcaattaatattgtattcaatagaataagtactttgtattcttcatatgattagaaagttctgtactagcatctgaactataaataaataaatcttaggatatatatatgacctgcttatcctcagtgtaaccctgcgacacaaggataagtaagtacaaaaaaaaaaagattaataccatcaaaaaaatcactctctggactggctaataaaagtgattcatccaagatacatgaaacaaagccataatatttacttaattattaactgaaaactatatgtaagcacagagctaagttctgaaaatatgaagttctccatctgtgatcatgtgtgcaataagaatttgagtggaataaaatgtgtgtatcttggtagtcagagacagtagtggcatgtgttcatggcaaaacagcttgaagaagaaatttattctgttaatgtaagcaagatttatttatttttatttctgctatgattatcctggagaaattaccacagtaaaagctgtggcaccgctaacacccacagtcatgttccttctgtttatgtgaaaggcagaaccattgagttggaactcaagtttttacttgaatgtattattcaaaaaaactttatgaatgtaactgatattttataccatattctataagattataatttttggcagttttttcaaaacatgctatataaaaggttagtctgcagtccctacacctaacacacatatacacacaatgacataaacatatccggtaaagctacttcctagaatttactatgttaagcatcattgattgtggtattatagactgcagaacatactgtagataattattcttttctactttcaattcaataaggtagcacagcagcaacatcatcacaatattcagcattaattaaataaattatgttccatgtcttattctacattcttcatatgtattaactcattcaatccttacagtcctatgacgtagtgttttaattatccaaagtatacacaagaaacttaaggcacacagaggtggagtaaagtggcacaaacaatcttattaagtataagagaggaactcgggcagtctggctccaaagctgcgctcacaacaacatgctatgagtgatttctcatagctttattatctacttttagttcatagcatttgcagttattgatccatggtgttttctcaaatgacaaaatagtataagattctgttttgatcactggatgtaaagtgattgtggttagcatgttgtgtcttttgattggacaagctataacagccaaatatctcttgatggaatgctcgtattgaatttctcatcaaaatatttttttccaaattagttttgaggtatagatttgctatcaggaagtcatatgagataacattacatttaaacttttcctttcagagtttctctcagtaaattcgaatgtttgaaaacaaggccactgtgaaccatttaagaatcttcaaccaaaggaaaaaaaaggttaaaatatccccatactcttgttttcagcaataatagagaatattttcacctttcaagtacagactaaatattgatttatacatacagaaacctactatgaatgagattattttattaaaaaggaaaaaaatttgaagagtataaatacaatctgaaaggttaaaaaagaggtaatactaagaagaattcagtttgataaagacatattgtgatttcctctggttactttatcgccttaatagttcagactaagaaagtcactaaatttttcaagttaacttaaatttttggtggtatacctttttagagtaattcattttctcactgtgataatatctttatatgctaaaaagcctgaaagtatatttttgtttaatgttcctgccatcatttaggagagaaatattcagtatttttatatactgaaagttatcttgattcctgagagcttacattattaaatcttagaatgcttgactatattaattttttctttaatttaaaagtttttcacattaatttttcaattaaatggttaatttgcaatttcatgatactcaagaaataattgtctaataggattgtgctatcacaaaatcttagagctagaagatcctcagagattaatctagcttaaatcactaattttacacttgaggaaaatgaggtctgagaaaatatgtgagtcactgaagatcaagtagataattagaggcaaaagtagaaagagagtcttcagactattgcctctaagtaagggatatttgaattggaaccagggaaatagtgtttcgatttatactatgagatagtaatacacagtggttagggcacaggctttatatcaagaaagcctgcatttaaaaaaacccaaccaatcacttattaactttatgaacttgacaaaatttttcagccctagattttttatctgtaaattgaaaataacaatattagttacctcaggagtctattgtgacaatcaagtgggctaataaatgtaaagcatttacaacgatgtctggtacaaagtgattcttatgctagcctatattattgtaaaattgcgactgtttctcatctccaatgcaatataaatctgttggaggaatgtttgaaaaatacaaaaaatcagaaataaaatagataattgataatacctaaaacgattagccatgtacttcaagatttttttatttgaatcttttattctgtgtacattttgctttttcacttacattttaaaattctgttttacaggattatacttagagatctgatttttggcatcagggaagtctagatatcctaattttcacttgctacaaaatacctaaaatactgcataaaatacaaaaataatatttttgatgcattgatgagctttcagcaaaataagtaactcaatcactcatttaagtccaacaccaagccatatgacaaatgaagatagtattaatcctgaagatgtcacttagcatgggggtatctataatcagaacctgagtggcctagagatttttaaatattgtggtaagagcatcacacaaaatgtaacctttaacaaggttttaatcattaagtataatattgttaatgtaaagcttttcatggacctttgcaatgcgtatggaaaagagatttgggcccatgggtggttggggttttctctcaggttgtgtaatcttgaatgcacaaaggactatcagtaggagtaagtttaaaacgaaaaacacaaaaacaccaaacaacatagcgattaaaggggaagtggggagtatgaaatttgtctcagccttgactttagatggagtgtggagaaaaatctcttctgagaatttattgtatgagaaggctgtcatgtggaagtggagccttagcacatgttatttgtatagtgcagaggaaataaacctagattaagtttaaaatggactcagggctttcccaagtattttacaaaaacatatgtaaaatcttccttgagtgttatatcttcaacccatgcattttatgattctcacagagaagataccacaacataagcaaaatcacaaaacaattatcaaatacacaagggatcaagggaccatgggtgagagacagcagacaaaaatgagaagcaaagtataaaataggtatggttaatttgtttaaacaaataagacagagtcaaatcattaataaaagcaaaatacattcacaaacaaccagccagaatcaggagaaaagggaaacataaaacaaaacacatgaagaaaacagagaacaactggaaataggaaatataataactaaggtaaaaactcactggaaagttagcagaataagcacagctgaagagaaccatagtgatcagaagactgatatgaagacattttgcagaatcaacaatagagcattaaacatactttaaaaattagatacaggttataagacatgagagattatcaaggacctagagatctatagtatacgtatggaatgggcaacaaacagtattttaggaggcagtggatgttagcatctggtagcagggagaatgaaggaagctaagggtccaatttcatagtagactttagcttacattctctatttttaacttaaatctctccgtttttacctacttgttcctgttttccagtgatgtgctaattaatgttggttcgctgaacaaaaacataacttaaaatgtaggtgtatatgttatatatatgtgtttattgtaaatttttctaatataaaagaagtgtaacaaataatattttactgttattagtaaattattagctgagtgtacattctctatagccaattgattctcacagaatgctttcactgatttttgctaacttcttatatccatagccaacatatttgtgcaatttaataataatttggccattggtgatgcatcccagcccactaattctttatacaataaaattatgaaaatttcttctgatatgttttctactgttaaactatttctcattcttctaaaagtatatttactaaactgaaatatcaccttgagcagcagatacaacacacttttaggtttgcctgcattatttatattttcactattactttattaaacctagacaaacaacaaaacaataaatcaagctctgatttgtagtgtttgctgatttccataagtgtgtaaatattgacactatggccaatttcatttgagctatcagtgtgattttactgagtgcagagttaaaagatgtgcagtgacacatcattatatagtattgtatagtatttccaccatactaatacagatacagacaaaatatgatcgagagcatagctaatagtaaaataattaggaagatgagaatttttattttatcatctttgtccttaatataattgagagtttatataatttaattattaataatgcctatgtttaacaattgcttaccacatttctaaggatacaacaatcagctctcattagccagcaggagaaggtgcctgtttccttctggtgtccatgatcacggagcagctcccacttattttctccagagagcattctcctcttatgtggcatgggagagggaaaaagatgacagcagtaaaagattaagaagggcactggaaattcctccctgttctttttgttttgtgttgttttgttttgttctgttctgtttgagactgagtctggactggagtgcagtggtgcgatctcggctcactacaacctccacctcccaggttcaagcaattctcctgcctcagcctcccgagtagctgggactacaggcacagccaccacacccagctaattttttgtattttagtagagacagggtttcaccgtgttgcccaggctggtctcgaactcctgaggaaaggcgatctgcccgcctcggcctcccaaagtgctaggattacaggcgtgagccatagcgccaggccccactgttctgtttacacactttcagcaaatacttttgttttcatccatgcctgcacccataacttccacagggactcatgcctccaatctgggcttctctgagggcaaattggatctattattattgttcctcccattgaaggcatttaatatgaaactgtccattctcctaaattggttgctatgattcctgtcgtctccaaatcacttgaaatcttttattttcttttaatcattttcctttcactttttctttgtgtgttagaattttattttgtgccagtaattgtggggtggcaggtggctgctggagaggtaaaagcaataattgctggtatcagtccttcaatatttaatcagaaatatcacttgatgtttcttatattcataatcccagggctcactagatacagttaatagtgaaaaaacgatacaaaatacggaatagtaaatattccatcatgtctttgtatatgttacctcagattaaacagtagaaataataatttgttgttttaaagtgtactttatcaacccattgaatttttttttctcgtatgtatgccaagaaaaaggtcagtcctatgtcctcagatatgcaacatttataggtgtcagagtctgagaatcttaataaggtctattattttggaatgttaataaatagtaccatggtatcaggtgctccatcttagtatggacaccatataagatcatttcaaacctcctcagtacatctgtcatcttatatattgctataaatcatccccattgaactacttcaaaatgtttcacaggcgactcccctaggtattcaattaagcactgaggtttgcagaaaggtgtcaaaagtgaaggggaaagaggtggaaaatggaattggatataacatgcttctttctgtcagacacaatttcttttcctcaaatagccagaaaacgtgttaagggtttgtaacaatatataaagaagtgatgaacagaaaaaggcataagcctgttagtgtgtatatgggaaaatgggttctacacatgtataaaaattagatttttaaaattttaatagctgaatgttagatcactaacataactgaagcacatattttaaaatatgttttttcttttttttttttcttgttctttactgggaagaacagggaagataaaattgtaggttttattcacaataacacaatgaaagtaattatataataaaatcagtaattatattatataatacatatttataaattatataattatattataaattatatattttatattattatataacaacatttataaaatttaaatgcaatgcttataggaatccatttggacagtagtgttagaataattcctgagctcagataattataacagtgtgataaaatgttgttttattcattttggaaacatttctgcactcaatattgtctatgttcccactgtgaaatctcgggtctagacatctgtcattttacaaaataggctataaggaaatcactgttgaacatggtgtagccgttatctactgctctgattatgtgttttgagggagcagaatataaaaaatggctaccctgatgcttgcatagcttatttctccatccttgtacttcatcacaaactccgtgtgtattctgtgttgcacatataatgagttagagtacttagattcaacttcttatatctcagttatttgtacttgtaagtggacttgtagttcccactgaaataacaagtctctccttttctgccccacgaaaaccttctcactctttagtaactgctcaagtgtcattttctttagggacttagcctttgctacatatgaaagctttccttaacctgatgtgttgtcctaaggattcctctctttagttcttccacagcatcctatgcttaatgcaggaactattttcctatactgtaatcagcctttttcttggttttagctcgctaaatcctaaacatctttagagcatggcttgtgtcttctttttattcttaaccgaaagtaggtatttgtaacattaatagtttgtcagtttcctctagtgaggcattttattgtgatggaattaggcattgataagagtgaagtaggaagaaaatacattacggaggctggaaagattagtaagttatactataaatgcttactaaattagatggttttaaactataatccaattgtagacaacatccatgtgtgggattaattaatgtattctatgcattgaaattgtgaactaaaataaataacaaagcttctgtataaagggttatcatattccaggaaggaactatttccttctttttttatagtgagtattaatgagtataatgagaaaaaaaaaaagaaaaaaacaagagatctatctctctgttcttctctttttttcctgtttctctttcagaagtaatgagttttgtaatgttccctaaagccccaaaattcagatatctgctaaaggctctcaaagtcaacataataaaaatcatgctttagataacaatatgtatcttccaaaaactatagaactcagatcagtgtccatacaacaccagaaggaagggtagaaagtaaactctgatttgagatgatggatagataagccttaatttagaatgtgacataaagcaaaggcccagggcttagtgctggtttactgagctctaggattatctatcgttagtcaggacttgaatgaaacccttgagttattttacctgtaaataacaggttaggttctattatgtgtttttaaaatttaaatctttttaaaatttaaaacatttatgtacaaatgatacttctcttacaatcacaggatttctaattaggaaaataattttaaatactttcaaatgttgttttcattttttaaattatttttttaaattagaaatcctgtaattgtgatagagaagtctcatttgtacataagagttttaactttttgttttaagtagagtttttatttaacttgggttgcagctgaacaaaacatgtttttaacattaaacaattttactttcatatctgtttgcctatcttcaactctgcatggaaagtatattgaatagatttttaggatattgtcaaatcttgtatcaaatccaaaactctgatatctacattgatataggatatttcatttagtcgcaagagaaactgttgataaaagaacactttccccaatgaacgttttaatagcttttcaagggtattggatatgcttgattttgtgttcaatttttttctgcccaagaaaacactttgtgttactgtaatcaactacaaataatgtcttcacatttaaaaggctgaaaggttctcagtttttaataataattagaaataatgaatgctttgttctgtctaaaatatatttcattgatgttcagaatttcaaacacttcatgtattcactatttcaaaggtcatttaaatttgaagactttgcgctttaaaatctgaacatggccttaaaatttatatcttttagcatccttgctaagtacaattagctgttttttggaattagactattatcacttttatcacatattaaaataattctttaaaagggcatcagtttacctatttttccactgaaatagtttttaattttgtattttcattcctttatatggtttttatgcacttagaaattcaaagaccagtccgggcacagtggcttacacctgtaatcccaagaatttggaggctgatgcaagcatgtcacttgaggcctggagtttcagaccagcctggtcaacaatgcaaaaccctgtctctactaaaatacaaaaatgagctggtcatagtggcacacacctataatcccagccactctggaggctgagacatgagaattacttgcacctgcagacggagtttgtagtgagccgagatcgcaccactgcactccagcctgagccacggagcgagattctgtctcgaaagaaagaaaagaaaggaaaggaagggaagaagtgaagaaaggaaaggaagggaagaagtgaagaaagggaaggaagggaaggagtgaagaaagggaaggaagggaagaagtgaaggaagggaaggaagaagtgaaggaagggaagaaatagccaaagaccatgactacaaattatacattgaaagtagattgggttaattaacaatttttacagtgttttctctttatggcatggcaaaataatttcggatttcattatttcatttcatattttaatttatcccctagtatctataagaatataaaatcatttactgccaagatacaatgggaaaaattaacagtaacttagaagggcacttgaattgatgagacagatgtagcaccaaatcccctacataagtaagccaattaaatctttgtcagtgaacatgcagcacccaagtcccacagacgtgaagtgacaggcttggactttgaacccagggccataagctctttctggtgcatgacacacattctgagcatataataagtgctaatgtatgttcaatttttcattgtatttttctgatttgatgtttgttgccaagaacacagtatattgagtatgcagacacatctcaataagtatttcccctataatgtgaaagggaaaaaaaaactttgtttctcagtagctttatgaaaatacaacttaaatttggaaaattagactgcctctaaaagagcaaatggtgcattttagaactcctgggagacacaacaaagggaacaaacaaaagagccagatggagaggttggaagggagaagaagattttcattttgttagatagcaacaaatttttcattcaactacatataacgaattcctagatcctaactacctggtttatatattcgtaccttctctctgtcttctgttttccactattcttgagtcaatcattatttgtgatgtcatggagaaaaaatgaggtaaggatttctgattatctcaggtttgaggttttgaagagattgaataatgattttggggtacagcttgtgtctaaatgtatttacattttcaaaggaccagaatatccatagattaaacttaagggcataatggccatatttgttaaaaagctaaaaacaaaattaccagtttatcctaaacttaactaaaggtgctctaaatacacagaaatcatcattttgccaagtcaactgcattctactatttttttttttttctgatgctggagaatttggcattttcactatatgaatcaccatcaagattattactttcacaaaagagaggaaatcggcagaactgaaatagataagcacaagtttacctctcttctctctgtttttaccatcgtctatagcaggggtgtccaatctttttgattctgtgggccacattggaagaagaattgtcttgggccacatataaaatatactaatgagctagaaaacaaaaattgcaaaaaaaaaaacaacaaaaaacaaaactcataatgttgtaagaaagtttacgagtttatgttgggccacattcaaagccgtcctgggccacatgtgattggtgggcctacagtattataaaaggacataggagtcttatgtcttatttattctctacaaatttaaaaatttgaacttctaatgttttccaaggtgatgtacaacagaatcatgtcagagctgaatattgtaactgtattgttcctagggcactcttaaaacttccacagctatggctgccacaaagtactgcatttgcttaacactcaaggttattggcacatgtgcccttttgcatttgaacaaaatctgtgttttattcacgtacaaccaagatgtcactttataatgctgcaaagacatagaggaaggtgtagaaacacacacttccagaaaaaaatactaagaggcaaattactgattaacatttaacattctaaatcattacttaaataaataccaatttttgaagatatggacagaaaatgaaagcagtcaaagcagtgtttggggcacatatgttaatgcattttaataagatggaagaaactaaatgacagggaaaatatattagaaacatttcttttttttttctttttttttttttttcagacattgcaggccatactgaaaagtcactgattttgtatttcagtgtaatatctaaaattgaattttaattcgcatgcattcgttgcagagagacagagagagagagagagagaaagagagagagagagagagaaattgagagatttaagttgattcactgggtcagacagaagtatttgcagctgcaataaagaagctttccccaaactgcattgccagatcttctcagctctgacccacagtcactgtgccaaaagctgccaggaatgccaagtgcatggtgattttgtgacgtagagaaatagggttctgggtgagaatacttaattgtcttgaactacaatatttgcttggtatccgagccaaagtttccagacataaaaaacagtggtaaaaatccacagacacaaaaatactttgtatctactgcctcaaagtaagcaggacctttgagcaagcagcactttgagtttgatttcggctgttgtttttaaattgtgatggctaaaggaaggcagtctagtttgtttatgtgtatccttgagactaaagatatgctctcagttgcccttagactcccgatatttgtaacttagatatatttgctgtatcttctcttctgaggttatatatgtctttattgtttcttaatcaaatttaagtataggaacatctctttgttatttctcataagtttcttgggattttaggtgttattcggaaagtttttttttccttaaatatttgaagtttggggttttaatctgcgttgtttgtattttaattgagctatgggaaattatggaattttttcaaattcttgtggaattcactctatacctttaggaaagaaaatacgttgaaaacttttatataatctccagggtaaaaatccttacaaaaatatatacaattttaagctaatttttattagggaacatttcaatacaactaacatttttgaaatacatttttagtgattgaaaatgatcttcagtatttcaatgatttcaggtacaccatgttgctaccaattaatccttagaaaagtcattttatttactagagtttattgcatctggttttgtcatgtaagtatccatttaacaatattatatttgcataagaactttttgagtacatcatagtagagtaagtgatgagcaccttctgttttctgaaaaaaatgggttgataagaatgaattcatgcttggagaattatgttaaaaattggtgcctgataaatcataaattggacaggctgcctgtcttgcataggtcttttatcaggtattatacaaacaactgattgtaggatgactgcatattttaaggactattgaaaattagtggatactgattttactgttagaaccctagagttggtgggcctgccgagtcctgcttgaattactatttcgttgaagattattaatcaccagctgccatcacacagtggcaggattccaaggcagcactctgaggactcctctgttcattcctctgtcgcagggtgacatagtatagaagcctttttggcttctctgcaaaagaacataactgcctctaaaatgtgtgcattatcaccaagtttaaagttagaggatgttcaggaaaaaaaaattctcagatattttattgagaccaactgagtacatatgctttttgttaagaatcatgttaattcaaaaataaaaaagttccaatatttttgctcacaatcctttgttctccctctatccatccatcacttggtgatacatttcacagtcacatggtggtaggggacagtgtgggaaagagaaagactttggcctttgagtcctgtaaattattcagttgtacattctagtggtttccatttcgtcagacttcaacatactgtgaaatggtgacatgtcaaaggttgcattattggttgataatgcagctctgtaaagtgtgtgagctcgggtcccagcgtcccctgccaacacacacagatcccaggacaggtgcaaatttgacttcacacatcacagttgaacaagccaagcctgaatataacctgactgggcttaacttttcacttcttttgcaatctgctttcttatcacttcttagattgttttttttaattttatttgtaagagtaagggaaatttggtagtttataagcctgagttcaaacttccatgatttctcagttgtcaaacgtattttctgagaaatgccctcatcaaagtaatcagcctaatattttttatttcttattaaaattacattatatttattcaaatttcaggtaaatttaaatataatgtaatttttcaaaataattctttaatattacacaaataaggaattattgcctttagtttgttctcataatgtttttgaataattgcctttcaaaatgcttgacttaagaagaggaagacatctacaataaaaatttactatgcagatttttttaaatttacatttgctactttttagtagcctttaaaatatcattttcatctaagaagcatgctgtgactgtgtttacagggttaatcacataaattaaaggaatgatgggaagaagttataagcagtatgtagagtaagttaactaaaagtggcatgttagctcaaaatagaatgtatatttttggcataatgaaacacaatgcttggtcttcttctaagttaactttttaaattaaatacttggagttgtattgtgaatatattcgtgtccttataaaggaccacataacttgtatctgagaacttttctttttgttgagatataagtttaaaggaatgtgaatttctaataagactaattcagttggatctcttaaatcttaatggattatggattagtgactgaagaaaaccaggtagagagagcaaggatattgaactcctatacatctttaaaactttaatcattgaacttatttgcgtgttctttggagggaaattagccctccagctggcttccaactgtgacagcagcttttattctaacattagtagaaagaattgtataatgatgctagttcagacttttttccttcctgatatatgttacaattatttgtcatggacaagagtccatgttttcaaaagagaatagtatctggtaatattatcattctattccagctagggtaatgtggggaatagaagttgttagaaacatgtgaatgcaaatttgcaatttaggaaactcaaaatagacattactgctcttcatttcaaagcaagttttagtgacattaaatcaaaactctccagttttatttttactataatctcctgacatgtatagctcacatcatgttttattgtaatgcttagtgtcagtcatttctagatttttttgcagtgactaattttatttttgctttaaaaatttatagaatagggggattatttatttaaaatctcttaaaataaatacatgagtgtaaaatctgagacccttgctgttgctcacattttaaatttgaccatgctaactcagtgtagaagagccagagaacaaactctgtaaccagaaacccagcttccattgccctctttagtatctacatgccatgttaccttgggcttactgtacaatcagcacctcagttccctcttgttaaataagactaatactagtacatacaagggacaaaattatatatataaaatattaaataatatataaaatacatatatgtataatatataatatataaaataaaattttatatatatagcacttaacagtaggtaaatgttagctattcttccaattgactcattaatgaatcatgagaatcttttatgtgataatgaaattcgagagtactaagtgaaataattgcacagtgcttataaatagggaaataagagtgaaagataatacaaattaattgaaatatgtaatataaggaaaaacagatgagaactcttgtaaataaaagattaatgaaatttagaatctattgaaagggatatttgttatttttaataacaaatttatttttaatattaaaaattttaatatttgtctttgaaaatttaatatttgtctttgaaatatctaatatccaaattctcaatatttcatatgatagtttttgttctatttgttcagtttttataaataggatatttcttacaaaatgtgtttgattttcaaatataactttatcattaaatttgtttagtatccttatgaggaaatttgcagtcatatttgataagtacgcataatttatttcactttccatgcttcagtattattttataatggtattttcaatttgtaaaccagactgtaatgaaactcttccctcataattgtttagaaataacgtatctttagaatgtgtcaataatttgtgctctctagaaagactttatttgttatactttaaaagtggaatctatttatatttctgttgcctaaccaaaatagcatatctaaaatatggatagagttactgcttttcaaagaacatatttaagatttctcttaatatcttaatttttatcttatatatagatcttatgtatgtctaaaagatacattaggtctcatatatctaatatttgctacagttaatataaaaacaaatgaagattaattgacttagtttaatatttctatgttcttgcttaaggaactgattggttttctcatagggcattgaaagagcctaatgaaaaaaatgctataaacgttagacttaaaaagatctagcttcaagttctgttctgccacttgtaacctgagaggttttgaataagcagtttagtatctgtgaagctttgttttctcctatacaaagtggagataatcacatagagttgtgataacaactatcacattaagatgttatgaaatgggggaatgaggggggcctggatgatgagaaatgacttcatggatacgacgtggattattgccatgatatatatactaaaagccctgacttcaccactatgtaatgtaacaaaattacacttgtaccttataaagttatacaaataaaaattttaaataaaatatcactctaacaaaatatgaaataaaatgagattacatatgtaaagcacttggaacagtatctgataacagtttttgcaataataattatataaatatctggcatttaactactaaagacatgttcgtatgtgtattatgtaaaattgaggccttcttgaatcttatgatttctaacacagacacttcggctgaaatgccataaaacacttagagatagacattttgcagagtacctggcaatggcatatataatataaaacacatatatttagtgcataatgtgcataatcctcaaataaaattagctacttttagaatattgtttttcttttaataccgttttacacaaaatgggctatcagaacagtagatcacatatttatttaaaaactaaaggagtgagttgagagagatacatgaaagaaaagaaagtgccacatgtggtatgccacctttatagagatttaatcttatataaaaagctctaagaattcctgttttaaagaaccttagacatttacttcaaacataaagctactaagattatttttgattgaatcatttttagatgtatttatcaacattctactgaagaaatgttccactgagcaaactattaaatggtaatgttagaatgcatgaaaaattaacgtaaaatcataggtcaaacagaaatgtaacactatagatctagtttggaaacaattaacagctaaagcccaggatatgactaaagagaaaggatctctgcttagattacagaatggaagaaaataaattctgataactaggtaattaagtttggcagctagggatgaaaaagacaactgaaaataaaatatggaagaagtaagaatgaaacacagcaagtactcttttgagaagaaaaagagttaagatttttctgtcccagcactttttgaatctaagtcccgtaatatatataaaatgagggattagactatattgcctctaccaggttattgcaagcacttaaacttgtaattctcatataaaataaaaaaaacaaaaagtatattcttccaatattttccttaaatatttacacattacatgatacattttatttgtgaataactttaatactcttaaattagaatgttataaatgctattaagttatctgttttaatataaggtgtgtgtgcatctagtaataggaagaaaagaaggaaggaagaataaggacgacaaaagaagagagggaaggaaagaaaaaacttgtcaaatatttcatagctgatctaattttgtgctctttttttctgtgccacatttattcccagaagtttctttggtggatcaagagatgtgaagccagtgcctggtatggaggagatgaacatacctgaatctctcaattttaatgacaatttatttttttactagacatatagacatcctaaatatatatattatgaaaatttcatattatattaaaaggaacattgttcctttttgttactttattaaatttaatttttttaggacaggatcttgcacttttgcacaggctggactcaatcatggcttactgaagcctcgaaatcctgggctcaagcaatcctctgtgtctctgggactacaggaacatacatgccaccgagcctggccaatatttttttttcttttttttttagaaatagactttatgtatttaaacataaaaactgtgaaaaagaaatcatcagaattcaggaggtagatgatgagaaggggaagatattgatcaaaaggtacaaaacttgcaggtataaaatgagtaagttctggaaatgtacaacatgatgacgtaacatagttaataatcatatatgcttgaagtgtcctaaaattattttaaaaatgccaacttttattttcaatacagggggtacatgtgcaggttttttacatgggtatattgcacccaggtagtgagtatagtacccaataggtagctttacgatgcatgccccctccttctccctcctccagtagtcttcagtgtctattcccattcttaggtctatgtatgttcaatgttttccttccacttataaatgagaacatgcagtatttagctttctgttcctgcattaatttgctttggaatgatgaaccctagctccatctagtttgccacaaatggcattatttcattcttttatgactgtgtagtattagatgttgtatatgtaccacattttctttatccaatctaccattgataggcgcctaggttgatttcattatctttgctcttgtgatgtttcatgttcagtgctatggcaatgaacatttgggtgcatgtatctttttgtataaggatctgttttcctttgagtatgtgcctagtaatgggaatgctaggtagaatggtggctctattttaagttctttgagaaatctccaaattgctatctacagtgtctgaactaattttcattcccaccaaaagtatgtaagcattcagctttctccacaccctcatcaacatctgttatagtttacttaatagtagccattctgactggtgtgagatggtatctcattgtggttttgattggcatttctctaattcgtgatgataagcattttttcatatgtttgtgggctacttgtatgtcttcttttgaaaagtgttgatgtccttttcccatttttaaatggagttatctgttttttacatgttgacttgagttcttcgttgattccggagatgagacctttgtcagatgcatagtttgcagatatgttctcttgttccgtaggttgtctgtttactctgtttatagtctttttgttgttgttgtttttgttgttttttttaaatgcagaagctctttagtttaactagctcccatttgtcaatttttggttttgttgcaattgcttttgggaacttggccaaaaattctttgtcaaggccaatgttgataaggaaatttcctaggttttcttctagggttttttatagtgtgaggtcttccacttaaatctttaatctacattgagttaatttttgtatatggtaaaatttaagggtccactttcattcttctgcatgcttgtttatctcagccttgttgaagatcagatggttatagggtgtggggctttatttctgtttcttattctgatctattgatctgtttgtttttgtaccaataccatgctatttggttactgtagccttatagtatagtttgacgttaagtaatgtgatgcatctagctttattcttcttgcttgggattgttttggttatttgtgctcttttttggttccatgtgaattttagaatagttttatttttttaattctgtgagaatgaccttggtagtttgataggtataacattgaatatgtacattgctttgggcgctgtggccatttcaatgatattgattcttctaatccatgaacatggaatgtttttccatgtatttttgttatgtctgatttatttcaccagtgttttatagttcttattgtggagatctttcaacatactactggaagtcttagccagagcaatcaggcaagagaaggaaataaagggatctaaatagaaaaagaataagtcaaactatctctcttctctatgattccatagttagaaaaccccaaagactctgccaaaaggctgctggaacttataaacaacttttgaaagttttcagaatataaaataaatgtacaaaaactcactagcatttttatatactaataacatttaggctgagagtcaaatcaagaacgcaatctcatttacaatagctacaaaaaaatgaaatatctatgaatacagttagccagctaattaaataaaaaatttctatatactgggtctccttatgttgttcaggttggtctcaaacccctggcctgaagtgataccttggcttcccaaagtgctaggaatcacaggtatgggcctctgcacctggccaaatttaaaaaaaaattgattgtttaactgtcatacatgccttgatttcagaagatattttacatttggtgaaaaatgagcaaatttgagctcttcatctgatgagaaattcaatctaatcagaattgtctttttcaattgcaaagtgtaattttctcaaggatcacatattataatatctatattagtaaattactatacacacatttatttaactcattgtcttatgaatgctttattaagattacatttacattgcaagtagagattagttatcctgagagacaaaaatctacaactagatctgactgacatgattaaaaaataacagattgtgttgcttataaaaaaagggtagtgttggcagaataacctgcaacaatgcttgatactttctaacatctttttcattgaaaaaagggatttaacattctataagtattgtagccatgatgtaaatggatacaacataaaattaaggaaattatattttattaaatgatacaacatataagtaaaatgtatttatagatttatgcatacatatttcaattaattttcctatttgatatcaatatgcttctccaaagtaataaattaagtctcactaaaataaacaagatgaagaatttggaacaaaacctcaaagcctctcaagaaattgtttctagattgtgaagtaaatagttgtcaggctgtagctctcatttttattcagctcttatatttgccagcttttgatgttatggctattaacttttatagatgtcatacatttttatgttaatcgttcagctttttgtctggtgagtagctagacttgtgttccttgaacaaattatatgagcaaattaccacatgccttcaacatctttaaaaggttttgtttcctgtttgtcattttagaattgatttttaaaattaagaatatttcaaatacttattgataatggacaaaatatgtttactctttttgtgaggtcatctttaagataatataagagttgtatagttcaaataaactttctcaaatttattagaagacaaataaatgtttatattcatataagtcaaaatactacatcaaattttacatagtaaaatatttatgatttatgtgcaacagatatgttatgtaattatttccctttatctcttttttttctcattatagaacagctgtcatccaaacattttgatggaaacttcacttttattaaggaatatttttaacatatattcttataaatattttagatctagcttctaacataaacataattgcaattatatctcaaacttaaacaaaaatattctagtatattcaaacatttcattagtatttaaactttcaatcttcctgtaagttctatattttataaaatatatattaaatttgaagcatttgttttaaaaggatccaaataaaattttcatattgttagaagttgataggcttaattccatgtgtgtcttttctttttccttggaatgtgtttgttactgaaactgaatagtttgtttttgtagttttctacagtatgtttcagtctgattgcatcactgcaatggtgtttaacatgttccccttttctccctatattacctatttatttgtagttgtagtcaagaaatgaaagaaggccaaatttaattgactttgttttggtttcattttgatacagttatgttataggaagaactggtttgtctctcaaattttcttaacagtactttattcatatgtactttacatattgagcataaacattaaatatacagtcccatgaactgtgatacatctatgtacctgagtaagtaatatccagatcaggatatagatttctattactccacaaagtttcttcatgctcctatccagacaagcccccatctccctgctcactacccccatgagcgaccactatgatttttatcaccatggactgctccttaacttgacatgtattcttttgcatctgacttctttcttccctcaggcttttgagactttcccatgttttaaaagtattgatagtattttttcatcaaattatttccccgtaagaattagatcacaggttgtttttcctgtctcctgttgatgaacattgatgggattttttattttgggctcttatgaataagctgccgcaaatatctttagagaagtcatcttatgtgaaaaacgcattcacttttcttgcagtcaaatgtcctaggagtagaattggtgggtcataggatgacaactgaaaaagaattttccatcttgattgcactgttttagactcctaccggcttcgtaggagagttctcgtcgtaccacactcttggcatcacttgttattgtctgttttcgtaatggaacgtttgggtgggtgggctatctcattgaagttttaacttgcagttcatctataattaataatgtgccatggagatactttcttattatgtgccactcagctatcttcttttataaagtgcctgttaaagtctttagcccaatttttaaaaattgagttattttctctcgcttgtaataatttgtgggtattttcaaaactattttctagatacaatttcttgttcagtttgtgtattgtcaaatatattacattattaacctgcctgtacagagcagtagtttctaatactgataaacttttacctattaatattttttcttgttcttaacacttaaatcttgactaaaaaaaaaaaacttgttcactctgaaatcatgaatatttatgttttcatctagaaatgctatagttttagcttttatagccttagcttttaaatttagatttataacccatccggaattattttttgtctatgatgactgctggggctaacagtttaatccttttgatttgttattatgactattaaaatgtaaacaaatgtaaaacaggttattgaggcaaaaactattttcatggtgtctattcaatatcttcatgaacataagtatccttgagggaattttaaaattgcacccattttgtgaaattatttcgtattctatttatgttttcatttatcattattatcactcctgaattagtaaatgctgttaataatcaacaaacttatacaatcacagtctttgaattctttttttttttttttttttttactttttcctcaagcctttatcctatatcaggtgttgtacttggatttagacattttggaaagtatccaactgtttttgtaatttcggtagtagcagtacaacttgttccctaaaaagctaaatagccacaacaaatgtacaatgatcggttagagtgggactgagaggcaatgtttcccaatatgtagaggagggattcagaaacatttaataatggtgtgatcctgtataacttactttatctccttgtgtatctccttgtttataagataaaatcatgatagtgtctgctgatagggttatggggattaaattaatgttaacatttgtaaagtgtttggaatggtgtcaaccacacagtaaaattatataattgctttactattactattgtaagattttttttgtaaggggacctgagataattttgttttttgaacaaagagaaaacaataaaaaattctaaccaataaatgatacagtgtgaagttcagtctaattagatatacaagtaaaccttatccaaccataggacaatgaattgttgcaaaatgatcatggcttgaattatggtttttttgtttgttttaaataaggaaactataaagccactctttataagcatttataaaactgtggctccataatggtttctcattatttaggtaaagtgacattgaagataaaatacatattttctgcagaatagttaaaaatttctatagcataccaacaattttagatcactttatatgttatgaaattttccttagttgattgaactttaagagaaaaatgtgactaaggaaaataaaaagaaatcttattttcttaaacaaatatgttacattccatatacaagtttggaaattcattatacttaacaaatttaacatgtatgtctgaacccagtttcactctggaaccaataatttgaaatgttccttatctataaatagaaattagttgaattagacagaatggcctagtttcacttatgtgaaaattctcttgtatgatatgttcgatttggaagataatattctgctcattttgttatacagattaaggaagtaaacagatcccctttactttgtaccctgttaaaaataatttcataaaatgaagtttcactcattggggacattttttatcctgaaatttttgatgaaatattcaagttttaccttgtataatgacaataaaattctttttgagatctgtagcattcagtgccttgattcaatagtaccagcaatgaaagttgaagcaatgtctaattcagtccctttatcttaaagagctagaaatatttatagatttgattttattttgaatacatttaaataaatgaggtaggtaattattagtgtgcatacgggtgcatccccaaatactgtaaatcaccaaaagttttcagcagtataagcctcctcatttttattatactattgatctcagtatcttatgtaaaagtagttacatttcttggaatattttgtcacctctccacattatttcacaatgggacacatatcagaagtagtttaatttaataaacaacatacatttatcaagcacttagcatgtatcgagcatggctgttaatgctgggggttgaaagaaacagccgtttctcccttcactgaagttacattctgtctgggtagaaaatttaaaaataataaaaatgccatgttaagagtaattaataagactgtatataaattgcaatggtcaaacaagcggttgataaaggagaagtgtgcccagtaaagcaagggcattgcttgaaatgagttatggaagtataccacaaccattttagtatgatttagagttaaaactttagttcccatttgattattgcacttgattcatttactatatcagttcacatttattccatattaataaatgatgattcatgatgcaaagataaaaattaagttgtcaaattgatttttaaaataaaatatatattatcagatacataaatatgataaatatatttcattatttctttagagacaattatttatgtgtagaactagctgatatagaatatgtagaaattatttcagtgtttacaagtctacaaacagtgttacaagtttacaaatatatatatatatatataatatatatataactaaccactttactaaaagttaactatagtaactacttaactacaaggtgtagctactacttactacttaactactatactaactatatatgtatatagttatatatgaggaagaggtaacgggagagagggaaagattatgaaaatttgccatatgactatggaggtagagaattcccaccagtttaccatctataagctataaaaccaagaaagctcatggtgaaattcaaagtttgaaggcttgagaaccagacgaggcaatgttgtaactccaagcctgagtgtgaaggcacaagaaccatgagctctgatgcctaataccaggagaaatgatagaatttgcccttcttctgccttttttttttcttttcagaccctcaactgattggatgatgcccacccacattggtgagggcagatctttaccccatctactgattcctatattaatctcttccagaaacattctcacaggcacacctacaagtaatgttttaccagctatctgggcattgcttggcccaatcaggttgacatgtaaaattaaccatcacaagtccatcactgggtacccataggtatttccttgaaccatacttaataaccaaataaagacaataacaagatcataattctgcttaacattatacaactatcctgcctgcaaccaaaatggaactaattctttcctctgaagtggaggtaaaatcctggagtaatttttactcttgatatctcgtaacttagaaactaggatgtgaaattaacaataactaagtagagatgctcttcgactggtgatcttatgtctctgtaaactcttcataagttataaatattattaagtcagaagttcacatttgacttaatacgttcaacttacaaagggtttatcagacataactccatcataagttgaggagcatattgaatgcatatcactttcacaccattgtacatttgaaaaatcataagttgaaccatcataagctggggactgtatgtaatgttatgaggtcaatatctattacatttcataatataggagaggggaaaaacaatagatttgcttaatatatgtatatatgcataccaacatatttataacaaaataaggaggaaatattcatgatactggcagttctcattactttagcaagtcattcggttatagctggtatttataacgaccttcttctactacccatttcatattccctttgccttcaacaatcacttccactggtcatggttctttatttggtagggtgacccagatcttcatatctgaatagcctggactattgttagtcctgcttagtttgggttgttgtagttttcaatcaccttaatcacagggcgtgatattactaagagaagttctaagatatcttctgtattccagacatattcattcgtatctacattgagaaatattagtccaatttccctttggtaataaggattaatcaccctagccagtgcaataattcccttctttgcctgttgattcagatacatgagaagtacaaggtatctgagtggcagccttgactcccagttcagtggaattatcattgtgtctcttggtggaagcactcttctttctggaaatgagacctgtaggccagcagagtataaagttatagaaacagggagcacaaatgtagatagtgagtcactagaggtaatgctgagtggtaccactcccatttcttttgcttggttcctggacccataaatcctggctatcagagaaacagaaccacatatagtggatgctgattcagagcctatacagtcttctgtaggaccctgacccaaccccacaaggtattatcaccttgctggaattggaacttgagtcttaaaaaggtcatttcactgttctgtcaaggcagctgcctcaggatgatgggaaacatagttgtaccagtgaattccatgagcatagcccatgactgcatttatttgtctgtcaaagtggttcattgatcagaaacaatgctgtgtagaatatcataacagcaatcaaggaattctataagtgcatagatggtagttttggcagaaacattgtatgccggaaaggaaaacctgtatccagaataaatgtctattgcaataaagataaaacactgccccttccatgatggaaacagtccgatgcaatcaacttgccaccaggtagctggctgatcactctggggaatggtgccacatcagggactcagtgtgggtctctgctgctggcagattgcgtatacaacagtggtcatagcctggtcagccttgatgagtggaagtctgtgttgctcataccatgcctaacttccatccctgcctccgtggccactttgttcataaacctattggatgacgataggagtgcctggggaaagagactgactggtatctatataataggtcatactatccacttgattattaaaattctccactagctaggtcaccctttgataagtattcacatgggactcaaatattattatttttcattctgagaggtcagtccacatacttcctccccaaatttctttgtcaccaattttccaatcatgttccttccaagtcccagaatagccagccaaatcattggctacagcccatgaattgatatataatcacacatctggccatttctccttccaagcaaattcaaaacaggtgcactgcctgaagttctgcccattgagaggatttcctgttacaactgtcattcagctatgtcccagagtggggttgtagtactgcagctgtccactttcaggtcatgtctgcatattgtgcagaaccctctgtaaacaaggccaaagttttctttttctctgtcaactttcatagaacactccccatgaggctagaggtgcaggctgggaaaaagaaggcatgtgtcaggagtggggaccatggctgtttggaccacttcttcatgtacttacttgtgcattcagggcctcctcaggatcaatcacatacgtaccatttccatttgaagatgcagtgcatgcacaactttatggtgtggtgagtcagataacactcagtttattatgggcagaacaagatggattttcccctgcctttttgttctattcagattgtcaatgtattggatgatgcctgcccacactggtgagggcagatcttctttactcggtctactgattcatatgttaatctatccagaaactcccatatattcacagacagaaataatgttttaccagccacctgggcatcctgtagcctagtcaagttgacacataaaattaaccatcacagtctttacttaaaaatcaaatatagccaagcacgatggctcatatataaatattcccagaactttgggaggataagtcaggaggaatgctagaggccaggagtttgaggcttgcctgggcaccattttatgaccctgtctctacaaaaaaaaaaattaaaagttagccaggcatggtgacacatgcctgtagtctcagctacccaggaggctgaagcaagaggattgcttgagcctggaaagttgaggctgcagtgagctgtcattccctccaaactgagtgacagagtggaacactgtcttaaaaatatgtaattttggccgggcgcggtggctcactcctgtaatcccagcactttgggaggctgggggggttggggggtggatcacaagatcaggagttcaagaccagcctggccaagatggtgaaaaaaaaaatatatatatatatataaatatatataaatttataaatatatatataatatataaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctattaggatggttaacctctgtagcttagatatcctatgtcacaaacatacatgagaactaattttaaggaatagtaaaatacacttcatatgtggaaagaggatggctgacattcttaggggcagaattatccagaaagtttatatagtttgtgatattgctggaccattactccaaagggtaaatgctgtatgttttagtgatcttgggtggctataacaaaacaccacagactgtgtggcttaagcaacaatttatttttcacagttctgcagacccagaaatccaaggttaaggaaatggcagattcagtcttggtgagggcccacttcctgactctcctatcctcacatggcagaaagaacaagctctgatgtctcttcctcccttaagaaggcactaatctcatcacaggacttcattctcatgaggtcatttaaccaaattacctccccaaagccacaccttctaataccatcacactagcagtcaggatatcaacatggatttcaaggagatacaaagattcaatccataacactgcccatacactgaagatttcaaactcatgagtggcattataaaaatttgaagaaggtgacaagtagttatgtagaggagcagtttgagccaatttgagtcaataagagtttccttttctctgcatccttgccagtatctgttattgtttgtttatttaataatagctattctgacttgggtgaagtgatatttcattgtggttttgatttgcatttccctgatgattaacaatgttaagcatttttttcatatctctgttggctacctgtatgtcttctattgctatttgtgtcttttgcctattttcaaatggaattttaaaaaaaaattgttgaagtgtttgaactccttatattctggatgttagtcccttgtcagatgaataatttccaagtattttctcccattgaagatgttgtctcttcattctgttgattgtttcttttgctttgaagaagctttttagttgaatatgtctcattaaaattttgcctgtgcttttgaggtcttagccataaaatctttgcttagcctgatgtcctgaagagtgtttgtttttttacggtttcttatagtaattttataaatttaggttttattggaagtctttaacccatctttagttgacattgtaagtggtgagaaataggggtccagtctcattcttctgcatgtggttatgcagttttccaagcaccatttattgaagaaggtgttctttttccaatgtttgttcttggtgactttgtcaaagacgagttggcgtaaatatgtgggtttatttctgggttctctattctgtcccatttgtcaaactttataccaatatgttctgttttggttactatagccttgtcttatatttcgcagttaggtagtatgatgtcccagctgtgtcctttttactcagagttgctttggctatttgagccttttgtgttgttctatactaatttttggattgctttcttctttgtttttatgaaaaataacttttgtgttttgacaaggattggattggatctgcagattactttgagtaatgtggtcattttaattattttgatctgtgagcatgggttgtctttccatttctatgtgtcctttttaatttctttcactggtgttttatagttttccttgcagagatctttcacttctttggttaaattcatttctaagtattctttttttttgtagccactctaaatgggattgacttcttgattttttttcatctacttcattattgatggctagaaatattactgagtttgtatgtgattttgtatcctgtaagttaccaaatgtatcagttctaagtcttcagattttccccatataagatcatgtcatctacaaagagggataatttgactccctcttttccagtttggacaccaattattgtgttttcttttttctttttttctttcctgattgcactggctaagatttccagtaccaagtttaataatagtgttgaaaatagacatccttgtcttgttcaaggtatttgaggaaaggctttcaacttttccccattcagtattatgttagctgtgggtttctcatatatagtctttattattttgagatgtggtccttctatgccgagtttgttgaacattttatcttgcagagtagtagttctatttttatttttttgaggaacttccatactattttttataattgctgtactaactggtttgcctagcaagagtatacaagggtttccttatctgtacatcctcacactgactagcttttgtattttttattttttgataatggaaatttgtaacaaggtatgaggtgatatcttattatggctttaatttgtaattctctgatgataataaacatctctttttgatgtcattaccagatagtgtttgaaattgctgaaaagctgctatccattgttctccatatactttttgcaagtgtaaaggtctaactcacaaagttaacaacaatgctgagaacagtacattctagcaagttccttacctagccaccatgaaagaaaaattaaaaaaaaaaacacttttctaatcatttcacacagtaacaggccatgaaaagtttgtgaaattggtctgtataatggcacatggttaacaattacagaaatgtttcaaaatgtactaaaactttaaaatcatcacaatctaatcatagaaagtagttctaataccacatatgactctaaacctacaattgctctgtcaccctctatggaaggcaatttcctgtgagctctcccatgcaatgaaaattaataaatctcatgctgaatccctgagaaatgtgctgcttcttgagagaatattaacatgaggaattaacttgtgttttaaagaacattttttagcaattagagtaattttataagatgtgacgtaattaaggtaggaaaacagaccaaagttggtatatacaaatttttagaaaggtaaacattatgtcaaaatatgttctgaagcaaaggaatatagaggatgctaaaacagaagtgcccatattgcatttatttttttttctataaaccattggtttgtcagcttacagtatggaatttccaatcataaaataaatgtcaggaaattagctgcagtatcttaatacttttactgttgctttcaaatagtacaataagaaaaggctttcttttaattaagatatatattttggggaagaaagagtgattattcaggggcatttgaaaagttggtggtgaaagaaggctccagggcatcacttactacttttatcaatataccatcacataatctgtgtgaatcatttacttggattcttattgtacttatttgtgacttcatagtgtctgaactgtcactttactttctttattatttgtcagcctctacacttatatttattcttgttgtttcttaaattcaagctgaatttgatggtatgttttcctaattaatatttttcattatttttctgttacaccaaatatgcgtatactcgtgctatgaaattattcaagcagatagcgtcctagatcattttaatgttttacaaatatgtatttttggttcacatggaaccagcttaaattataccactggatatttatttatttttatttttaaaagtaaaacatttagaattaagcgtgtgtcatttcgatgccagagttaactttatcagtatctgaaagaggaaaaacaaaaagcaaaaaacaaaattaaaaaaacactaataaatgctctatttgttttcctcagtttagttatgcaggattagtttattttaattttgtttttattttttattgaaaaaatccttagacatttccctttcataatacagcctttgataatggagtttcccttgtcattcagaacattgtccttctattcagaatataattagttgaaatctgtatctcaatatctgtgcatgctgtggcaaattgaaataacatgtagatgtgtatctttgttcagacatgtgaaatacagtggtaggagaaagaagacacaatttctgtaaattttatctcccaatgactatggactttgctaatatattgtgattgtttatgatatcattgagttattagggtaattatttactgttctccacttttttacatgaaatggagcttcagcccttataagtaagaaatattaaaacaattaaatatactttactatggtaaaaaatgttgtcaaatatatttataaggcatatcatgaccttatgggaatataataaatgatccattcaaagtagatttactcattatttcaaacagtttagatacggtactccttattccagttacactggtagctgaatagtgatgaattattctaatttctctattaaatacttctattaaaatatttcatctcattaaaatgtgaatccacagtatatataacttcagaaagaaatgttcagagaaagtgagtgtgtctactgagcaaacagtgaagcaagaaaaaaggattgcacagggaattagattagccacgctggtaaaggcatagctgaagccccattaggtctggcccagacagcatttgtgtttggaagagctaagcaaatcacattaattaatgcttacaattttctttggtgaaaggtcctgatgtcagagagaagacagacattttcttttttatctgtacattatacaagcccacccaggtcactgggccattggaaaggaagcaaaaggaactgaagcaaaaataatcacgattttagcctcaaagcaaaaagaatgcttactcatttacaccattccttttattagaatgcttaattttgaactacaatgaatgtgtttgcatgtatgtgtgtgtgtgtgtatatatatatatatatatatatatacacacacacaatcacattcattgtatgtgtatatgtatcacatttattatatgtgtatatatatatttatgtacacacatacacacatttgcatgtagacatatatgtgtgtatgtgcatttcctttccagaaaattccaccagaaaggactctttgaccaaagagaaaattaaaggagtactgtagtgttattttctacactctagttgtttctacaggactttctgtgccccaatagattacaatgtcatgtagatgcagaaataaagatggttatattataaggaacacagagtgcaaataaaatactaaagttatgtataaaacaaaattatatcttctaaaaataaagtaatatagcatctaaatcatataaagccaaatgagtgttagcaccttcaaagccactatgctaaagtagttttcatttagttattgccatttacatgttttttacaaacaacactttacagtaatgcttagagcctgcatttaaaggagaggaattagagaagggaaagctgggtaaatacacaggaaatccagttgattgcttagacagagcctcatgtagtagcaattacatcactttggtggggaatcaacacaaactgatctctcacttttcagatctcgactttagaatgtttcagatagagcactcaaagataattttatttaagtgcactcacttcaagattgttgcatgaaatgatatataaacaaaaatcataatacagtattcttatgcatttaccataatatttttgttttctaagatgtactcttcctgatcaatactttagaaaacataatgaaaaaatagaaaatattttgggacaaggatgtggggggaaagtaagttatacaaaataatagtccactgagattgaagtgtgaaagaataaatccattcctgtgctacatccaatgctctctggtaccccacattttccagattcattaacactcctggaaaatgctttctgatactgttgaattctcaacctttacatttccatttttgtaagcagcatgtggaaagactagtttttctttagttagtacattctttcctcggataacgtgcaataaaatctgttagatagatgcacatcctttcttataaacaattctaacactgaacgttaacgttcactgtgtacctcttctgttttccgaaattttgtaacagcatattttcatgaaaattattttgttattttttcagatggtagagaatatccacgaaaatatcattcttcccccattcatactgaaaattctaagatgccttaatgtagaaatcatgcatgcaatattcatttttaatggctaatcatgcaagtatatgtggaagaggccagagttgggccaagatttcaaaagtgatgtgttttattcataaagatgtgctaggactcagtaattacccattattataggaagatacaaagaataagaacagatttttcaagctgctatccctaatgtatttgtcttttattacttatgagtcttttagctgggtcagattataaaaggctggttccagtttacaaactgtccaaaacgatgactaagagaaggttcaagtttgctcttgcttggatttacataaacaggacaaaaagtgcaaagaaatgatacatgagtaaatgaacacagcttttccatgtttccttagttccttaccaagcgattagcaaaattcggtagtgtattacttagaagagtcttacgttttatacttctagaacagagaaggaaccatatgcacaatcaagagtttaccagctactttaaaaggtaattccttacttgctcatagacacctactccttcattccatttttttcttcaactttatatcacctcatacttatatataaatacattcatttcccttgcatatacccaataaaacctctttgccttcctatgaaaactgtgatttcttctattgaactagatttaaattaaaatatatgttgcataaaacaagggatgatttcattgtagcatttgtgccaagaaaaataatttgaatattttgttcattaagataaacctatgccttcaagttagtcattttatgattagaaataatagctattatcggaccattttggctaacctttttggaggctactaattattttcatttataacttctgagataaaaatatttctatttccactattgtaggactttgtcaagtggataaatctttaaaataaccgtgggcagagtgtatcattatcagctaacatgacagtatggaggcgttattcgcattgctaacaacacaagcagaaagggagaatggagaatttttttaaaaccattcttttaattttcttcatgatgaagttagaacatttaaaaactaataaagaggtgttctaagaaaattctgaaatgtgacaaaagttatatctaattataattatgacaaataacattaaaaagtcaccctgtttaaaagtatcaaaaaatctaacatctaatgtaagatttcattttcctaaatttaaaaatccttacatttatgagggcctaaatattttgtggccaatacattaaaaaatatctttaaatgaaacagctttaccataagttttagtgtggaatgattcctattaatgtcattcttggttgggtttcggggtgagaatgagctatgtgcctcatttcttaatgaacatttattgatgcaaatgaaaattatataaatattctgaaatgggaaaaggaatatttgttaaattcccaaatatatatttgctccttcaatttacaaatcatacctgattgattacccaactttggaatattttaaatttaatatcagccatttaaattttattgttattgataactagataatttttctgttgtcttaatgatgatgtatatgtttaatttctcaactgaaataatgtgggaaattacacaataaattgtgtcaattaaaaagagggaaatactggtaagtgtaagcattttaaatagagttatctttggctaatgtccaagggtaaatgcatatttctaattctttatagctttagtcaatgagcttaattttgaataactaaaaatgctagttactatggcatcatatttctttatatagtatctattttcatacaaagaaaagaaaaaagtttcaggttactttaagctgaggatgcccacagtttatgtcttagttgataatggatatgaattttcatattttattctgccacgtaaatctcaatgaagccctaagcccttctcatcctcacacaggtttcctttctgtgtatgaaaaagtaaatcattattaagtaatgcaatagatagccaaatcagacaggaactattacaaccaattttgttgttacatattttcaaaggaaacttctacaaggggtaaaaattgaatcttatacattgctattaacgggcctctaagtagaaggaagcatatatttactgcgtcataattttattatggtggcgctccaaaaatgaccaaaaggattcttaggataattgtagctatcaaatactgagctatgttatcttgtaacttgaggctgaagacaataagaaaaattcaggaaatgtatttttaacatatacatgcataaaattgttcaataaaaatggatatatgatgaatcatatccaagcaaaaaagttactttgaatcattgtctctactatatagtattcctaacttctccagacactactttgcaaaccagggataaagaataaaaaaaaaaggtaaactttgaagtgaattattgggatattattgtgaatcgtttttgctgcaggcagcatggcatgaaacagagcatacaaactgggaaaagtagaggagagatgaatttatggattatctggaacatatattccaaatcaattgttttctaagttatttcctgacatggttttgtaaatgcatttaaatcaatgaacaatattggagttttctggagtccttatatcaggtttctgattataaaagaatgtatactatattatttaataaaaagtatgtaattcatcaatatatttaaatacagaaattttaaactgtcctctaattgtgaagtcaaaactaagaagttacttgctattttaagtttgctagagaatgatactgtgcttttgagctcattaaaaataattaatatatatttatcagtcaaacacactgagattgattatcatcatgcaattcatatgctagaggctggagcctgtgtcttcaggccactacacatataaaaagccaaactgctcagccttgatacaagtgaagtgacttgatactctaaaaagaaacaccagcctcttgatggacaaaaatatgaaatgacaagagtaatttcaagtagctccaagtaaattaaccataatatttactaatagtatcatctttgctaataaggattagggcattaataaacactggaaaaataaaatgggcttcaaagttcacttgtgtaaattgatgaaggtcacaagaaatcaaaaaaggttagagataatattgttttaaaagcttaatatactagtcaggaagtaactgggaaattcattgaacatcttttggtttttagggtcattctttctgtaggaatatgcatatactataagtgaattatcacaattactaaaattagttgtctagtatacagacaaagttgttgcctaatattgtgtcattttttggaagcatcaatttcacaaacatatcttttttgtttgcttattttgtggtttacctttttttccaattcttattttggtaagtacaaatggtataaaatttgccatcttatctatttttaagtgtacagttcagtggtcttaaacacattaatgttgtgcatccatcaccaccatctgtctgcagaactcttttcatcttggaaaactgaaactctatcccattaaactaaatctctatcctcctgtccctgcagcacctggcaactggcattctcctttctgacattataattttggctacgctgagtacctcatataagtggaatcatgcatgatttgtcctgttgtgatctgtgtatttcacttcacttaatgtcatcaagattcgtccatgttgtagcatatgtcagaatatttcctctatttaagatggaatcgtatcctccattttacttatctttgctctaacgtttattatttccttccttcttctacctctgggttttgtctgtttgtcttgttacaggtccataagttgtatggagagactatcgatttgagatctttttttcttttaaattctaagtaaatgaaaatgaaatttcatttcagttattatacttcccagctccagattttccttttgattattttaaaatgtatctcaaaattttcttcttagcactgttttgctgcatcccataggttttggtttgttgcatttttgttttcttttgattctattttctagtttcccttatttctctttcgatcaattggttgtgtaagactatgtttttaaatttccattaatttgttcactttctagcttttcttctattatcgatttctaaattcatcctgttgtggttggagaagattttcttttatgacttccatttaaaaatatatatatattgggacttaggtctcatgtgcagttaagaagaatgggtattctattgttgttgggtatcatgttctttatatgtctgttagacctagttagcttattgtgtttcttctctttccttacttatcttctgtctggttgttctcttcattattaagaatgagatatcagtctctaactacttttatagaactgtctatcccttaaatactgttaatttttgcttcatgtatttgatgtctgttattaggtacatgaatgtttacatatcttcatgcagtgttgattctgttattaatacataatgtccttctttgtcacttgtaacctttttaaatttaatgtccatattttctgattttagtatagttactcctgatctcttttggttactatttgtatggaatatcttttttaaatctgtcattttcaacctatttctgtctttggatccaaagtgaatctttagtaaacagcatattgttggttgattttaaaagtccactctgccattcttttttttttttttaatttcagagcttaatctacttatgtttaaagtaattactgataaggaaaatcttctgtcattttgccatttttttctgcaagcattataaattttttgtcctgattttttgcattactgtcttctgtgtttaattgatttcttttgtagaaaaatatttgaattcccttcatatttccttttctgtgtatcctagagcttttttgtgtggttaccatggtaattacatttaacatcctcaagtcataacactctagtttgaatttaagccattttaacttcaataacaaaaaaaaaaaaaacctctgctccttggcagcttagtttccaccctgttcagtagttcagctgttgatgtaacaaaaacacattttatgtattatgtgtccaaaaatgtaaagtaataatttttcctaaagcattagtaccttaaattatgtggaaacaatatgtatagttataaaccaaagttacaataatgctaacattaaatttttcatgtatttatttttactgcagtctttattttttcatatacctttgagctaccatctagcatccttcattttaaactgcaagagtgttttttagcatttctttcagggccaatctagtggttataaactcagcttttgcttattttagaatttttttatttttctctaacttttgaaagataattttaccacatataggattcttggttgacatgttttttttttctagtagttatttaaatataatagtccattgccttctagactgcagtttctgatgagaaatctactgatagtctcattgaggttgcatattataaattacttttctatttatgatttccagattatttatttgcctttggcttcccacagtttgattaaaatgtgtctcagtgtgtgtatctttgagttcacaatatcgaattcattaaagttcttgaatgtttatattcctgtctttcctcaaattttggaaattttcagaaactatttaaatattttctctgcctctttcattttcttctccttcggagactactataatgtgtatattggtcttcatgattgtgttttatacctttagttttcactttcttcagtcattttttatttccatccctcagattcaataaattccattgtcctatatccaaatgcactgattctttttctgcctattcaaaactacctttcaaacagtataatgcatttttcatttcagttattatacttccctgttccagaccttccttttagttatttttaaaatactctatttatattttcattttgttcatacatatatatttcttacttcccctgtgccttccttcagttctttgagcatcttgaagacagttgttttaaagtcattttctagtagatctactatcaggactttctcaaggacaatttctgttggtttattaccttccactgaatggaacatactttactgtttcttcgtatgccttgtgatttttgtgttgaaaactgtatattttaatccaataatatggcaaatttggaactcatatttcactccttcacctggatatgctgcttttattttgatttggtttgttttgtttggaatgctgtaggctatctctatgccaaggattaggctgatgtgtaaacttaagggttgttttttttttttttttttttcagatcttttctgagcctgcatttctccctgggcattcctgaaaactttctaattttcccgtattttcaggtgctgtgaatgttttagtctttaatctctggttcacaaaaatgagaaaaagaaaaaattaagattaaaaaaaacctcacttgagctttatatactctggaagtcacttcagccaaagaaaatgctacttggaacaataagggggagatgtagcaagagtgggtgcctgcctttgtgtttgtccctccttgatcaaatacagcaattaatgatcagaacacacagccccaatgttagagaacagtgtccttactgcccaccctgcctcccatgagttgtatgaaaactgctctagtaacatgtgtacaactacctgccatagagtttgttagtgtgaaaggtggctgctgtcgagttaagaagtgatactaaccaaaatcttcttcagtttaccactaaagccttcccctagaagatacaagcctttatagcattctaaataagttacatgggaaagatttttgcttgtgtaattattgtctgagtgagaaaacttattattggtgcttcctactccactgtcttcccagaattctcttattttgagtttttaataatatttgaatttcaaagacttcctaataattccaaaggatataacactgggtaaaagtagaagtgggtcagcagactttttattgtaattatactttcatgagtcccataatataaaatttagacggtttaatccctcctctgaaatatatgtttcacttattattagaagatacacattatttttaatttaaagataatgactacatttactattttctgttcatttacaatccaagaacaaataaatatccatagcaacatagactctagaaaggtcctccatatgcgctactcaatgcatacttcttacttatttttgcctagactatatatattcataaagttttgttagctggacagtcacccaaacatatgagaattcatttaagacaaatctagaaaattaaaaaaaataccccctagagtgaaaaattgtatacagtgttggaataaaaatttttaattccttattaaagtaaatctcattctcttgcttggattgacatttgatcaattgatgttcaaattaaataagttgtttgcgtttctaaaacagacaacaagatatagttaaaatatatttagttccagttcctgcacttcaagaattaatgtagccctcttcaaagattatgaccttttctaaatgtactccttgtatcaccagaaattgagagctttcagcatgtggtactaccggtatcatcaaactgaaaaagcagaaatgctgtccttatcctttcctgatcattaaatgtcatcagtgataaagcttaagtgaagcagtttgttaagatggaggctgttggtactgctctgtagaatacaggaggtcagattccacagtgtcaaggaaaatcaagctaatggagcaatttaattaaaattaattgagtataattctgtctcttaagaatgagattgatgtagggttatttccagcttttttggcttaaggtgaaatgaatgtccatactttttaatgttatcttcctcaatcttttcctataatcatagttttaacaaataataatggtttatagaagttagaaatgtaaaagacctatgaggttatttaagctactatacactgtgattggatttttttattctctttatgtacctctcatacccatactgagtttagttcataatatagactctaagctgagaagtaatatatattgaggcatctattaatgcttcatttaaaacccatacccttaccttaaattttagtggaatcctgctgacaaacttgtgtgagccaactaggtagattttagttgagcaatctagattcctgcttctatcacaaaacagtttatacaagtcagcagaattggcatatatctgattaaatgtagtagagacagatgtagtacacctttagcatgacttacccatctgtcattgggatatgctgttctcttcataaaatcacttttactactccagaaagttaaatagctcacatttttgcttcctccactctgcttacttatgcataaatattatagtccccttgccaagtagtcagtatttataattaacatatttactagattgacaacattaagtataaacagatagacatggtggtgaccaaaagaggaatatattgggccttgttacttgggaaaagattttagcatggtagtatagcttgatagtatttggtcatcattaagagattaaaaatttctttcatgactttgtttcttcactcttgcgatgtcatttattgcatatattgatacggttttaaaaaattaaaatttacctctcctaaacattttctgcctttgaaaaagtcattgaaaaaatgttttgaatatatacaagaatgaaattaaagggcaaaaaaataagagttaaagttctattcatttttatattattagtctaggagagtggtacatttaattaaacatagaaacttaaagacattgaatacgacttctctgttgctactctatgccttataatactcactgccagacagggtaggtatgtaactactaacaaccctaaaatataacaaatacatcaactggaaagctttgtatattataaaattctgtcagcgtggtagggtacctgagcagcgatcctatggagagctgaaacagagtaactgcaggcagaagatatctttttaaaggaacttgctgataaaaagcttcaacagcatgacatatctctgacttgctgggaaacagcagctgacagagcaaaccaacatgtaacagttggtttcaggggtgaatatataggaccataaagcaaatgaaacttgtgaacagccgccagagttgcaaatcaaaagccattatacacctattccatgtggggccaactgttgaaactaatagcgccctttcctttagattttcttgaataaaggcagctatcaactagtgatcagaccataaggaatataattttacttatgatagagaaattatataccatttggaaattttatttaatctattatccctttcaattttgtattcaaaatcttatcgtaagccaagccaccttccaataacaattattaaatatctgagcttcaattgactatcatgatttcttgcattctaatcaactaaagagaacttccagatatattctgtactgtaggtaattgagctattcctcattatgccggccttgatttgcaaaggtgatgaaatatcttcacagttgatgaggaggctggttgcaccaaaacttgcaaaagtgttttcttcattctcgctactgtaaaataatgtgaataacataaaggactttactaggctgtatactgaaagaacaataaatcattagcaccacaggagagagttgtagtagcctttgattaatctataatctaccactattgcaatattctttgttaatggaattttcaattagaatattatttgaaacacaattcattttacatttattaaacgttccgcatactattatgttgtcattaggtagcatttagcaaactgatcattaaagcagcaaatttggaccacagatttgttatcatttttgggagcttgcagtggctttgggaacttttttttaaactgatttaatgataagattccatcatcttctttcacagttatttcatctcattattcctatttgtggatgaacacttggtaaggtatttactattttgagttcatttttatgcttatgaacattaggtaaacattggcttcatgatactacttactttataaggttttatgtaaattattaatacatatagagtaagatttcaattaacctcagctattttattattgctaacaataaatgtaaaatttcagtaaatgttaaaactactaatttaatatgtaacatatgtagagctacaaggtggcaggaaaagttctaaatgctttgcatatcttaattgtttgacttgcataatataagcattctttgaagtaggtagtattgttatttctacattacaaatgagaaaaccggggcttagagaggataagtagttggtccaaggtcagcttgaggtttggacctgagactgttcaacttcaaaatctgtcctgtcaattactgtactttaaaactctctgccagcagtattgaacaaaataggatattataaaatactcatttgtgacactgatgtttggaacccaaaatgtatatatcaaatataaaaaatgcatactaactgtattagtctgttctcacattgctataaagaactacctgaggctgcataatttatgaagaaaagagatttaattgactcatagttccacagactgtacaggaagcatggcttggaggcctcaggaaacttaaaatcatggtcgaaggtgaaagggaagcaaacatgtcttaccatggcagacaggagagaaagagctaagggggaagtgctatccacttaaacaatcagatctcatgaaaacttactcactatcatgagaacaacaagggggaaatcccatgatccaaacacctcccaccaagccccaccgccaacacttgggatcacaattcaacatgagattttggtggggacagagagccaaaccatatctctagccaatacccactctagattcaagccttgttagattcatattgtatcaaacatcatattatatgggaaactacattcaggcttccattttcagccttcattttttaaatcatgttactgaactggcagttgaaatagtgaccatctccaaatcctaccaagttccaaacagacagtttttcctcctttggcctttgacagaggattcaggagtcaagtataagaaataaggaatagatttttgtcagctgtggacccagaggagttaattgttggaagtgttgcgtaaaagtagtctagggaggcaaatgtacaatgtactggatagtgagaagcaaggagggttttgagagagaaaaagtgtccaaataggaagataatatattctttttccctttacctttgatctttataatgtagctctcctcccatgagtcatatcagttctcagatatttgaaaaataacttttgctaacaactgtaatatctttccagaacctttccttgaatgtatcaaatgctgtcagaccatatggtttcaggatactcttacatactgattgcttgaaactggttgttaaattgaggcttagaattagattaactattaaaaaatagcttaaccaacagtttgaaatacagtgagatttttattatttaaactttttaatattatatcataaaagattgaattcagttttttattgattttgtttttatcataggaaatttcaaacatattcaaatgagagagaatcgtatagtatatttccatgtgtccatcacccaccttcaaaaattatcattacatgtctgatcttgtttcacctatatccttattcatttctcacctgttcctttcttctgctcaagattattttgaagtaaactccagacatcttgttttcaacaaatatttaacatgtgtctctgacagtcatgaactttaaattttcagctctaataccattactacatctgaatttacaatcattccttaatatgaatacccaatgttaaaatacatgtaatagtctagtaatattttatgattaatatttttacagctttctccagtcttttactttcaacttatttgtacttctacatttaaagtgaatttctggtgtatagctaataatggggtcttgtcttttactcagtccaacagtttctaacttaataagagtgtttgctcagtccatttatatttaatgtacttattggcatggatgtatttagtctaacatattgccatttgttttccattttcccatctattcttcattacattttttcttcatttatttattcatacataatacatgtaaatatttagggggcacatgtttataatatgatacattgatataatcaagtcagggtaattaggatatctatcaccttaaatatttattgtttctttgtggcaggaatatttaattgttctctttgaactattttgaaatgtacaatgaaataatattaactatagtcatcctaccaatctatcaagcaccagttctcagttcttctactaagtgtgtatttaagcccattaaccacactttatcccccaattccccttactcttccaagtttctggaaccaccagtttactctcttatcttcgtaagatttacattttagctcccacaaataagtgagaacgtgcaatatgtgtctttgtgggattggcttatttaaattaatcaagtcttcttttttatttcttactgttttactatttgatttttaatgacatctagatagatgtgtgtatctttattttatatatatatatttgatggttactctagtgtttacaaaatttatctttcacttactatattcaatcttttggataaatataccacatcatctatgctataagactactgtagcagtgtattcccatttatgtctgtatgcactgttgtgcaattgtggacatccacttcatttctacatacgctattttttaaatacattgtgtgttttaaatattgagttgttgtttagataaatgaggaaacaacacttttaaaatttaataaaatatttaacatatcaaccatgctccttcatgaagatctgtgtttcttttaagttatttccctctacgcttaaggagtttttaaaatatttcttgtactgcatgtccgctaaggaaatattctgtttttttaggtgaaaccacttttattttcactgatttttttaaagatattttccctgcatatgaaattctaagacagatttactttatttctgtgttctttcagcatcttaaaattttgatctattgaattctggctggcattgttcctgataagaagacagttgacttttctgtccttgtgaaagtttgggaattgaacaatgagaacacttggacacagggtggggaacatcacacaccagggcctgtcatggggtggggaggaaggggggagggatagcattaggagatatacctaatgtgaatgacgagttaacgggtgcagcacaccaacatggcacatgtatacatttgtaacaaacctgcacattgtgcacatgtaccctagaacttaaagtataataaaaataaaaaataaataaaaaaagaaggcagttgacattccttttatttttcttctgtatataatacactgtttattacaagctactttatatttgatttttagtaatcttattgtgttgaattgagtgctttttcattggatttatcctgtttaaaatgaattgagtttcttaggccttcagttgatatttttcatcaaattaagtaaaaacaaaaatttagcattaactcttcaaatgtttttgaaccttattttctctctccttcctctaggacttcattacgagcatgtatgactgctttattgttccatggatctcaaagtctctgtttatttatgtatttatttttttcctttctatacttcagttcaatagattggtctgtcttcaagttcactcattctttattctctagtattcaatagctgttaagtccaccctatagctttcttaatttcagataatttatttttacagtttcaacttatatggtttttattttatctgatgaaattttcatctctttacccatttgtttatttattattactattttttattttagatggagtcttgctctgttgcccaggctggagtacagtggcacgatctcagctcactgcaacctccgcctcccaggttcaagcaattctctgcctcagcctcccaagtagctgggattacaggcacctaccaccatgcccagctaattttttgtatttttagtagagatggggtttcaccatcttggccaggctggtcttgaactcttgacctcgtgatccacccgcttcggcctcccaaagtccaaaagtgctaggattacaggcatgagccactgctcccggcctgtgtttattttttattgtaaattctcaaacatacatgtaatagctgttttattgatttttttcctattactttcaaaacctctggtcccctctgtatctgtttgtattgactattttctttttcttatggtcatatttttgcttcttcatatgtctagtatattttctttataatttatatcacacattgttggggccatgttggtgagcagccagacttatttcctccttttaaaatggttggattttgttctgacaagtagttaacttactggtccaacaacttgatcttttgaggcttggcttttactttgttagagcactattactatataactctgcttctaagtgtggcacttctagggtctgaatgcctggggtattcatcaaagattcctgactcaggttaatcagaactccactgttcctcagcactttggcttttggaatagctgtttggctcacagcctccagtagctcttgtctgtcatgcctatggtttctgactgaaattggccaacaattcaaaattcaaaaataatcactatccaaaaatttctcttcagaattttggagctttttctgtgactggttccctcctctctaatactctgtacattaaatttcagctgccacaggccacagggactccaaactccaatcactattcttcactattctctttgcccactaagaaacaccagtctctgtttgggctacaatttttttttttttttttgagacagagtcctgctctgtcacccaggctggagtgcagaggcacgatcttggctcactgcaagctccgcctcccagggtcatgcaattctcctgcttcagcctcccaagtagctgggactacaggggtccgccacgacgcctggctaattttgtttttgtatttttagtaaagacagggtttcaccatgttagctaggatggtttcgatctcctgaactcgtgatccacccgcctcagcctcccaaagtgctgggattacaggcgtgagctaccacgcctggcctgagctaccatttttttagtggtggtttggaagcgtccccaggtagaaagccaagctgaagtggaggtcacctaatatgtttaccttattgaaaaagaaaatacagccctacgctatatgttatttaatgcctgagaagagttttattttattgattatccattttcctaattattcatggaagaggggcgagttcgatactcaatattttgtcataaatataactagcactttttaaaatagttttttgtttgaatcagtatttaaatcagttcatatgttatgatgcattgtcgtgtcaagccccccccccccccttttttttttgtggttgtttttgttgttgagacagagtctcgctctgtcgcccaggctggagtgcagtggcgctatctcggctcactgcaagtccgcctcccgggttcatgcccttctcctgcctcagcctcccgagtagctgggactacaggtgcccaccacaacgcccggctaatttgttgtattttttagtaaagacggggtttcactgtgttagccaggatggtctcgatcttctgacctcatgatctgcctgcctcagcctcccaaagtgctgggattacaggcatgagccaccacgcccggctgagcctcttttaacctgtaaattctgtacgtttcttggcttttttatttgttggttttatttgtttctttgtatgtccttgaagttcactgttgattcatatggagcatggacttaatttaagctccaagacattgccatgtcctctgtaagataagatccccatattccctacatatttttcacaaaattttcattatacatttatgtataatgagatgttacattttcttaatagtaaagcaattcctcaaaaaaaaagtaccatgtgattcagcaatttcacttctggctatacagccaaaataagtgaaatcatggcctcaaatagatgcttatacacctgtgttcagagcagcactattctcaataaccaaaaggtggaagcaaccccagtgtcaatcagcagatgactggacaagcaaaatgtgctatatgcatataatgcaatattatccagcttaaaaagtgaggaaattctgacacatgctaaaatacgaattaatcttgaagacattatgctaaataaaaaaaaatcacagaaagacaaatattatatgtttctacttatatgaggtacctaaagtgtacaaattcatagagacaaaacagattggtggctgccaggggttgggaagagaggaggttggggaaataatgtttaatgtgtacagtttcagtaggggaagatggaacagttctgaagatggatggtggtgatgattacacacagtgtgaatgtacttaattccacaatgttgcacacttagaaatggattaaagagcaaattttaagttatatgtattttaccacataaaaaagagattaaaaaataatatagttcagtaggttcttggctagtaagttagacaaaagatcagaggaataagacaacttggcaggaaccttatgaaaaggattctgctactgaaatggttaaatttaataactcttaggtggtaagaaaatgaccctgtgtctatgtattaattcttattactggtatatccactggcctctttctcatttctccttgcatgtgaaaaaagtttttctaattcatgccccaaattgaactcttgatctcctttataaaacaccacaaaaagctgctcttgctgcattacattccgtctcagtgggtgacaactccatcattctgattgatcatgccaaaatgttggaggcattttccctttctctctcatgatatatccagtcgtacaagaaaatttacaggttctattttctattatccaggattagatcacttctaccctgttccaaagtgacttcctttctaggtggcaagcttttgtttgtttgtttaatagctttctacctgatttcattattttcttccttggtgaaaggctattttccctacatcatccagggaagttatgttacgtaaatcagatcatgctccttcactactgaaaattcatttgattccctttctacttttaatgaaatccagtcattccttagtcactccacccatgccacattgacctcattttattcaaataaaccaagtaccttaccaccttaggggctttgcactcattatgtcctgtcctataactgtttgccctcaaatatgagtttcatgactaatttgcttactttctactctctttagatctttattcaaattttacctttttaattaggtcttcactgaatattttttattgcgatttcctccccctgcgtatctatcagccttctctgctgtacttttcttagtaatatttatcagcatctcacatactatgttacttctgtgttttatttattggtattcccatattcaattataaattcgataagggcaggattttttctctgtttgatgtctaaaacaattcatagcatgtagtaaaccacccaacattttttaagttaaatgaataataacatacctttactttatgactaaggagtatgttaaaggcctaatgggtaaaattactatcgtagaagcaagaaatctcactcaaagtctgaagtaattcaatacgttagtcactggtgtctgctacttgggtatggaaagaagattagtgtgggtcatgtagcaccgtctattgcatttggaattagctctgcaagatcccatgtagttggtgttactttttttaaaataaattgatgagcaccttaaaaaaaaaaaccttagattcagggactaatactgataatgtatgctttgatgacagtattaaaaataaatgagttatcagagagtgtaagcatttatgaaacgtttgctatgtatcggatactctcctgggccctttagatatcattttcacatgctattttattcagttctaatcaatgcactacaaagtgtgtatttctattggcatattttcaaaagtgaaacttgaggattatagaataagaatcatttgtcaaatcccataaaatgagtaacttgtagagttggcataccttgtgacatctctccgactgcaaatagcttttttttttttttttaatcctcccagtatcttatagtagagaacatgtgtcccttggaaattaattaaatattagcagaaataaatgtgatcagttttaaatgtagcttcaattcctaaacatctattttcagaactcttctctgttaaaccatggaaggatctatttccttcttttcataagtctttggtcaagccttgaaaattaaaatcgttgtactgattcaaccagtatggtctttttaagttttattggatttttgtttgtctttagttcttttattttttgcagttttaatctgtgcacagagaacatctttctagcttgtaaatacacatcagacacaccctgctgtttcctagaagtctattccttgttgctgttaatagcagagcagcatttttttcttagtcaccatttcttcctgcatacagaaccattaccctctgtctacttctatcaccctgaaatcttccatcttacttttcagatgtttttcactatacctatttcaagaaatcaggtactaaaaataaataattattctctgatattcaacctatttttaacacctcaactatttatttttaatacctgatttcttgaaaaagcatattgttaaggaagtaaggtatcttcattaatatacatctttcacaactgaacaggttcatttttataaactagcacttgtttttcattttatactcaaatttatttagatctgttaattgcgtctgaatagtatgtgaaaactgtcatcattcagcttgggaaaaatattctcataatgaagttatttacagctatgtctgtcattagtgtcattagtaccactaatagaaaataagaaaattggaatggcaaaatttagacatataattgatttctttcttctgatacgtaattgcaagtgctaaaacttcctagatgttaaattgactgaaaaaaaaaaacatatcaaagaagcagatgtatgttgcagggatggagggttcactgtatttgatatttatatagctctgtgagtgactcaattcaactttcctggcttaggggaaaagggttaatgtttggcctgaccggtgagtcccaatgataagaggtcaggaagaactctttactggagttttagaaggtaatagaataatgaaggatgcagctatgagtctagcaaattgtgaatgtaaacagagggcattttagggaaatcatttagtgtaagtttttttaccatggtggatgcgatatgaaagaatagacacaagacaaattcgaatccaaaatttaccttaaatatatagctataacttacattaaagaacctaacaacttaattttaccattcacacatttaataagtgtacattcagaaatgtactcttcagtgaactgtaggaatacaaatgtgaatcaaattagtcaaggattaggccctgaaaattaaattgtgatcacatgttaagtgtgcacaaatatttaaacacaaagtagaaaatgatatatttttaaaagaggtctcccccaaaaacaagcagtaaaagaaagggggtaattttcatcagctgcggaagctttagggagaagtagcaactaaactgaatcttgaacagtttgataaaggcaactaagtagatgaacagcataaagaataatgaaaacaacagattcgttgttattttagaacaataatcacagggtcagagctgtagtcatggaagaatacatgacaagggagaacccttaggtaaagtcactaatgaaaatgcacagtttaatcccagacatgaggaatggcaagtgtacaaggcatatgcatttgcagcacaaagagaatcacaaaagaaaaatgagatttctgtcccagagatacttaggtggcaatttctgtgccagaattacttaggtgattggaaatgtaaagcatgaactcaaatctgaaggtaactgtccaagggtcaagagttactgattttgctaagaaaacaatatagaaagaaaaagaagattaaagtaattttcttaagaaatacctatatttaaagaataaaagaaatttgagaatgaagagaaattggaaacaatccaggagagaatagcaccacagaaacctttaaaaagaatttcaaataaaaggattattgatactgtacattaagattggttgcagcttacaaaagctacatattctatatatggatttatatgaggctatagaaaagataaaactacagggacagggaacacatcagtgattgccagcgactgtgggtgagggtaattgttgaagacaaagggaaagcataaggtgatttttgaattgatgaaactgttctttatcaatattgtgggtgtggatcatgaacctatgcactgttcaaaacccatagaactcattgttcaattcccacctatgagtgagaacatgtggtgtttggttttttgtccttgcgatagtttgctgagaatgatggtttctagcttcttccacgtccctacaaagggcatgaactcatcattttttatggctgcacaggaaggggaacattacacactggggcctattgtggggtggggagaagggggagggatagcattaagagatatacctaatgttaaatgatgagttaatgggtgcagcacaccaacatggcacatgtatacatatgtaacaaacctgcacattgtgcacatgtaccctagaacttaaagtataatttaaaaaaacccacggaattgtacacaagaaagagtgattttaccaattgtaaatttttctaaaaattaagtaacagaaaaagagaaaaacaatagagtcattggtttgttgatttaaaaatgtatattcagaatgtggaagatgaagggtatatggtaaagaaatggaagccatatgcattctgttttcaaaacgtttcccagttaagaagaaaaaaaaagaaggtagcttcaggacatacctcagttgattaaagaaaggttatttaaagagaggaaacttggagatgtcttttatagaggttaaaaaagaacatacatattcaaaggagagtaaataattaataaagaaaatctttgaggccattggaggtaacggaaagagagaaagagtctttttttttttaatatacttaaaagagggcaaaaggaatagagaatgaatatagatagaatcattttaagggatcatcacttcaacatgaatcttgttaaaagattgttcactggaatttgagatggaactatagcaaaatcttgtttagccaggtctaagacacctttcttattaatagagtccaaatattcaggtttcttaacctcccaaatgccctgccctcttatgagtcccaaagtgcaagtgttgattggtctaaaccaatggctctctgtatggtccgtagaccagcaacagcaccatcacctgggaatttggtaagcccagagatctgtgtttttaaaaagcctttgatgcgattttgatctacagtaagctttgagaactactggtctaagcctgaaagtatacttccatttcatatctttgtgattacacatgagtataccattcaaacccagccaaggaaaaaaactgggaagattgctgtttgttattggtgaacgatttctttctgagaagagacacccaggggcaatcagccttttctgcttttggattggtcatatgtggatgagatattaaaatcgcagggcacacacacacacacacacacacacacacacactcttcaccttggggaggaaacataaacataatagccgatatgttgcatatggtggaatgaaaacttggaaggcacctgggttattgaggacatccttatgtcactaaaatttagtaaacttaaaactgtctgtatctggtaaattactagtaagttaataaatgatctcattgattaggccactattaattgtggcatcttatgcttgtagccacaggcatcaaaactgatatgaaaaataacaaattggttctgttacattctccagcatcttccttcctttaaaaatattctagttaataggctaggtgcggtggctcacacctgtaatcccagcactttgggaggccaaggcgggcggatcacaaggtcaggggatcaagaccatcctggctaacacggtgaaaccttgcctctactaaaaataccaaaacttagctgggcgtggtggcgggcgcctgtagtcccagctactcgggaggctgaggcaggagaatctcgtgaatccagaaggcggagcttgcagtgagtggagatcgcgcccctgcactccagcctgggtgaaagagtgagactccatatcagaaaaaaaaaattgtagttaatagtataaattttgtatgcctttatcaataaatgttttaatcaacaaatatgagcatatcagcatcatctttgcctagacagaagtgcacaatctgaaaccagatatcaagatatttaccaagtcattattatcaagagaagtggtgtttttggcaaacttgagcagcctaattccacaaataccttaccattaggatttaatttgcctggaataaaaaagcaatataaaaagaaggaaaatgaggatgatgaagaaaatatacttacatttttataatccttgaataatgatgaatatgaatttcattatatagttatctttagtttttgtatatttaaattattttatattaaaaaaatacatcaaagcaaaacaaaaaagattaaaaataaaaggatagaaaaatacaaatgcatgaaaacaaatttagctattttattataagacaaatgtcatttaaagcaaaaataaattcagttacataataaaataatctttcttaatttttaaatatgtatacatatagaagcaatagttaaaacatatagaacaaatgttgatatgattataaggagaaatcaagaaatttgcatcactggaagatttttaacatatctctctttaaaaaatgatcaaaaacacaattaggctgtgattaacttagccaaaaatattacctcaaataaatagatttgtagagtataatgcaatcaatggataaaataaattcttttaaaataaatataaaaggtttagaaaatttgatgtactagcaagtaaataaagtagaataccattatgtaaattttaaaaatatgaaaaacaatcatatgtaatttatactatcatatataaaagtacaatattttgtgtgggaatgaaattttaatatctaatttcagaggtgggttatgtttgaagtgcttaaagtgcagagtgattatccttggttacacagggggccagtgggaaaaatagaggtaaaactcacatttgatttcttggatttttttttactattagttaaacataattttactataatggaaataaggttgtacagtgtaattttattacttcaatatacctacaattatttacagtaagtataaatttctgtaaatgagaatgtgacattctctttctcctctgcccctcatttcttgttctgtctttcctaacaagaacatcatgttaggattattttaaatttaatgggtctgtatttgtgaattacaatgatcaaattgtattacaaacaggcagatagtaattccaattatttgtatttagagaaaactttttcatgaacagagttaaaattatgagccaggatttaactactaatgtctgtgaacaagacatgtatattgccacacattacctgaaggtatttgtaaagcagttttatctactctaaagcaggtgacgtatataatgaagccaaggaaataaggataacataatgtttgtggttgtcagatgatttttagacttatgaaatatcccgaatcaagcattttatatttttaatacatatcagaagaaagttcttggatttatcttctgtgctaatttatattaagtcttgcagtattttatttagaatgatagtgtctgacatgaatgtcttcagctttctaattactactaatactctcaaagtgaatgtagttaaacccaattatatatctagttactgaaatatcaataataaaccatataatgcttacttatttcctttgttaactcgtaaatttattttactaaatcttactcgaggcagctattaaatagattaatgaataattgttaaaatttaatttttcaaatctaaatattttatcattatagaaatgttctacttacttttgtcatgtgtctactctgtgaaaacattgttctgaactgtatagtagctagagaggagagggattgagaaatcagttgtaaagatgcataagatagtcttgatgctcttaggaatttcccgtgcccaggtaagggagacaggtaaatacaagtgaaagatgctacaataaaaaatatagtagagaaatggggtttacttcctggaagaatcagggaaggatgaagtgacatttgtgctggaatcctgacagatgagtgagaactcatcaggaaaaagggaagtggcatattacagataagttaaaaaatagacaaaagttttagaaaacttaatctcatatgagttaacatgcctagaaatttaaatggatataatactttcatagtaatgaatttttaactatctgcacatattttcatagagttcactgattttattaaatgacagtacactcatatgatgtggataaatacaaatatatgaccatataattttaatatccaagatgttgccaaccctaaagaatgatgggagtgaggatgcagaattccctcagcttagaatctctcatctttatattctctacctgttctatcatcctgatttaggcagtccttggaactatagtctctattcaacacatttttgaaaatgctaatctattttcaaaacagtccaaccccttcagtaaagtgagtatgattttgtacaatatgccacaaaattttaagaaaatttgaatcacattttctttactctcagtttaacgttactttcagtgcttcttgctgcatcattggtatcttataattagaactaaataggtatgaaaaaaatcaatttacattctggagaaaaaagaagctgaatgactctctctgtaaagttttcctttcatcttgatgaagtcccttcattcattgcttaaagattaacagtaagattaacattgtaacccatttagttagctggagggaatttcattcctgcttaaattcaagcatttaaagcctcaaactacttaaaattaaattggccccatagagaaagcacatcaccatgagtattacttaaagatggtatcaaccttcaggaatatatcttaattggtaatgacaaaaaataaataataataaaattttaaatgctatttctgttatgtgggaattttctagttttttggatgttacaattaaatatccttgcttagtagacatttttatatatctccaatgttatcaaatgtcaggtctatcatgtatcaaaagcaatctcttgggttgtgttgccttgacaacaaatcttggtttcgttgttcttgttaagttgaattcttggattctgagaatttaataaaacgcttgctggattcaaatcagtgacctttctcagagctgtaaaaacaactgatcattcactaaaccattcatcaagttaagataaatatacctgttaatatttgtgttcctactcagtttggatacaagtcaaaataatttgataatattatttttattctttaaaattattttataagaattagtaatttatttaaaaaattagcaatgttatttctaagggatactaattgtgatatgaaagacaagtcctcttgtcaaagcattttgtattcagaaatgagtaaactactttaaattaaaaagtagatcacaggtttaatatctagagtttttcaaaaaatatgtgtttcagcaattttataaagtttgaacctgttaagctaggttttaaattatttgaatgttttttgaaatttccttctctgtcttgtcattataagttagattttgttccacttttatttatttcatgtaaggctgatatctcacaaacttcaaataagtcataaattaactacagcatcatttgcaaatcttccattttctggagttaccatgccttttgagatttaagcaaaattgaaccaaacattcattgatttttcacaagatacggatttttttgattttttttttttttcaggaaagaggcccgtgtacttgcaattgctcttctagtcatttcttgtgcaaacctgctctttttgaagcacaccaactcaatgaagatactgttgactataattcttaccagaaatatatatacacagataacctgtatatatatgtagatatatagattggaaatattgaagatttgattccataccaccacaataaagtaactattgcaataaagcaattcacacactgtttttagcttccaagtgaaaataacacttatgtttatgtgatactgtagtctattaagtgtgcactagcattgtgtccaaataaaatgtagatatattatttaaaaataccttattggggccgggcatggtggctcaagcctgtaatcccagcacttggggaggccgaggtgggcggatcatgaggtgaggagatcgagaccatcctggctaacacggtgaaaccccatctctactaaaaatacaaaaaattagctgggcgttgtggcccgcgcctataatcgcagctactcaggaggctgaggcagaagaatcacttgaacccaggaggcggagcttgcagtgagccaagattgcaccactgcactccagcctgggcgacaaagcaagactccctctcaaaaaaataaaacctttttgctaaaaaaaggctaatgatcatgtgaactttcagtaagtcagaatctttttgctgatggagggtcatgcctcgatgttgatggctgctgactgatcacagtggtggttgctgaaggttggggatgctgtggccatttttaaaaatgagatagccatgatgtttgccacattggttgacccttcttcttctttttttttttttttttttttttttttttgggatggagtttcgctctcgttgcccaggctggagcacagtggtgccatgttggctcactgcaacctccacctcctgggttcaagcgcttctcctgcctcagcctcctgagtagctgagatgacaggtgcctgccaccacgcccagctaattttgatttttttagtagtaacagggtttcactattttggccaggctggtctcgaactcccgacctcaggtgatctgccctcctcaacctcccaaagtgctgggattacaggtgtgagccaccacgcccggccaactcttctttcacaaaagatttctctgtagcgtataatgctgtctgatggaactttacccacagtaaacctttcaaaattacagtccttaaactctgcagctgctgtatcaactacatttatggaatattctaaattctttgttgtcatttaaacagtattcccaacatctttaccaaaaatagattccacatcaagaaaccattgtttcctttttttgtcactgaatgtagtggcaaaaatcacaattctgcaccaacctactcagtcacatctttagggttcacttctaattttacttctcttgctgtttccaccacatctgcagttacttcctacactgaagtcttaagcctcccaaagtcatccatgtggattggaataaacttcctccaaacttcttttaatgttgatattttgacctcttcccatgaactgttaacgttcttaatggtatctagaatggtgaaatctttctagaaggtttccagtgtattttgccaaggtctatcaaagaaatcaccatttatggcagttatagccttacaaagtgtatttattacataataagacttgaaagttgaaattactcttttgattcatgggctgcagaatgggtgttgtgttaaaaagtacacaaacaaggagatttacaaatcttgtacgtctctataagagttctagggtgatcaagaccagtatcaatgagcactaatattttgttgtatgagcactacatctcaacagtgggcctaaaatatttaataaaccattggtgaaaatagatgtgctgtcatccaggctttgttccatttataggcaaaatagatttagcataattcttaagagctaggattttcaaaatggtaaatgagctttgacaccaacttaaatttatgtttccccctaaaaaggaagtgagcctgtcctttgaagccaggcactgacttctcctctctagctatggaagtcctagatggcgtcttcttccaatataaggctgttttatctacatttagaatctgttatttaatgtagccaccttcatctatgatcttagctagctcttctaaatcaggggtccccaaccacggggccagttaggaactcgaccacacagcagaaggtgacttgcgagcaagcattaccatctgagcccagcctcctgtcacatcagcagcgtcattagattctcataaaagtttgaatcctgttgtgtgaactgcacatgcaaaggagctaggttaagcactccttatgagaatccaactaattcatgatgatcagaggtaaaacagtttcatttcgaaaccacccccacccccatctttagaaacattgtcttccaggaaaccagtccctggtgccaaaaatattgggggtggttgttctatacagataacttgctgcagcttctacaggagcatgtgctgtttcaccttgtaccttcattttatggagatagcttctttggctaaacttcatgaaccaacctctgttagcttccaacttttcttctgtagcttccttacctcactcagccttcacgtaattgaagagagttagggccttactctggattaggctttggcttaagggactgttgtaactggtttgatcttcagtgatgttccagatcactgaaactttctctacatcagccataaggcccttttactttcttactattcatatgtttactggagtcacccttaaaaaaatttttttaagcttttcctttgcattcacagcatgcttaatgggcacctgaggcctagttttggcctctctctgatttcaacatgacttcctttctaagctcaatcatttctagctttcaactgaaagtttaaaaaaaaaaaagaaaaaaagtatatgactcttcagttgaacacttagaggccgttgtaggcttatcaattggcctagtttccatactgttgtgtcctaagtgatagagaagtctgaggagagggagagagacatgggaacagttggtaagtggagctgtcaggacacaaacaacatttattgtctaagtttgctgtcttatatgagtgtcgtccaagttgccctaaaacaattacagtagtaacatcaagatcactgaacacagatcaccataacagatataaagcagtaaaaatttggaaatatctcaagagttaccaaaatgtgacacagtcatgaagtgatcacacactgttggaaaaatggtgccaatagatttgcttgacgcagggttgccaccacatttagtttgcaaaaaacaatatccgtggcatgcaataaagcaaagtgcaatcaaacaaattatacctgtatataaaaattcagtgatctatatcctgaaaactgaggcactttactgtattaagctatacaccccatgagaaattcaataaaaatgaatttatatttcttagtaccctcattttaacatgttcttaactggctttattcaattaaaaaaaaaaccaaccaaaaaccttagtttgttgatttagtcatattcttccaaatcatggagctaatacatagcttatttttatttttattgtgttttcagccttgtctggaaacaaaaatagttggaaggagagttagtttagaatgatgaaaagagagcaaaatacattccaaaaattttcaaataatttccaaatcattggactctaaattatcacctggccttattctcttctgcctgaaggaactagtcttcattatttcttcccattagggtggagataattagtgtcagcaaagtgaactatcaaccatatcccctccttattcttctaaggtctgattaattggtactgagaagaaatgatattttacttaaagtttttacaggatatttttattttatattttatatcgtatccaaaaattatggtactttgctgaaccttttcatacatttctttatatgtaactttgcaggcttttgctactttattatgaagagactccagaggaaacaaataacacaagcagataatcaatgagaattgaatgaagggactgtttacacattagtgggcaaggggaaccttagggccagcacagtgggagacttgactgtccctaaacttaaggagcaaaagccatgggatggaatctgaagggagcgatggcattggtcagatgtatgcaagcagagctaagtggttttgctcattgtgcggtatccagtaatcactgatactctctttgccctgtatcaatatatttcaaagaggatacactgacatattaaagtaaatgtaatatttcaaaatctctgggctggggcccaaaatcttactttaataatccacataaatgtgttttgcagaacaagaccatgtttggaaaacggcagtcatcctgggaaactttttattctaagctgtttttggttcccatcatcacacataccaatgccagagtcattattgctataaaagtatcactttccaaggttcctgagtttaccaccctcatgtacttatagggtttttataaccattatattttgaggcaaatagtatttgttcctcaacaaacacatttattatatagaattttatggaaatactgattctctgttttaatagtttaaaatcttttgtgagatgggaaaagaactgttgcttcattttattataatgaaaataacttagagacaaaaagccacccaaaatttcttttaacttgtaaatactggttactattccaattttaatatattagagccccctaccaacatttttgaagcaaaattaagctattgaaattaagattcctgtttctcccagtgaagttaaaaactaacaacatgtaagaaacaaattagacaaatgagtttcaaggatttgagtgtaaggaatgacttctgtttaagttctattttgttgggctttggaatatttctgctacaagtactacactgtagcaccttgtcattttaatatatgtcttactttgttatcaaaaaattaggcattataaaatatattttatcttttatatagtccatttcacagaatagccataatgttctttcaagtaaggattatgggaaattaaatgctcttatgtttaaaatagatatttatatcctctgtatcatttattaacttatcagaatcactttgcactttaagatccatctaagtatacttaataatatagctttttccatgcttttttaaagccttagtcaaaatatagtaacttagattttttaatatgttactacagttttaaaccagtattgggaatgctttgatattgtaatgtttacagtatatttggggtaaagtggtgagagaaattggaagatggaattttggtattttagaactagactgtgtggccaagcatatagaaatgcagaatgttgccagacacagtggctcacacctgtaatcccagcactttgggaggcagaggtgggtgaatcacttgaggtcaggagttccagaccagcctggccaacatggcgaaaccccatctctactaaaaatacaaaaattagccaggcatggtggtgcatgcctgtaatcctagctactcgggaggctggggcaagagaatatcttgagtcctgggggcagaggtggcagtgagctgagatcatgccattgtattccagcctgggcgatagagcgaaactgtctcaaaaaaaaaaaaagaaaagaaaagaaagaaatgcagaatgtggtgtagaaatatatacaatatattatatttaaaaatctatagtaatgcagttccttctttttctaaatttaaatctttccccctttatgcttatataatttttaatagacttcaaaatggaaacaacgttctagtaatctcaaatgtgaatgtagagaatttcatccagtgacctttcctgatttatatttctgtcgttcttgattttataaatcaacttgaaaataaaatttataaaatttcttaactgttaccccgaatcttagaactgtagtgatttctaaattaaaaatcctgtagacataaatattctcatgcactctatatatacatttcatttgtgcagttttgcatctgtttttccagttttccactttgttgggaaatggtttacatactaaaaataatgtttgaacaaaaatattttctcacgtaataacttgttactgctttgcagtttgtcacaaattttaccattcactcatttaatctttaacacagtactgtgagatgaacaggaaatgactatattcccatcttaagttagagaatactgagactcacagacatttagggactgaagttacaaattgagtggaattacatctaaaactcaggatttatagccgggccctgctggaccctaacagactcacaagaagagagaaaatggtgcttaacatatttttcaaatcaatttcatggaacttaaattatagttattaaatgcttactatgttaaaatactctgttaagtaaagcagttatataggatagattaaaatgtatgagaagataagaaaatatatgatattacacgttataaggacattgctaacctgtgtgaaaatatttttttaacagagagttgtgataataaccagaatttaggggttaagaaataagggagaggtaaggcctttgaagcagcagatgtggactatccttttgacagattgaggatttgtgtggggaggagatagtgaaggggatgaaagaatacaagcatacaaaacagcaacatacaaatgtgctatcttaaaactcgaaaagtgtaaaatgctaagctggacaaagctagactgaagaagaaaggccactttgcatttattatcggattgggaaaggagcaggaagcacctggttggaatccttgtgcttgtgaaaatggccttgttagaaaagggacatgacaagaggaaattaggaaagaaggtaaaggaacactgcagctcttccagggagctaattgaggtctcctgagcctgctccctaccaagctccaaaaggaagatgggagaaagccacctagagccacatccaccagaactatctggaagactaaagttttgtccttccatctgtgttcagcgctacagggctaaacaattagcagaactgagactggaccctggtgggctgcctctccagtctgtgtcctcaaccctataattttcatttctgttgagatcacatatattcagattataagtggagtattacttttgtaaattttttgaagggtggtttgataattagtttcattattttcaattttgctctgtgtatgtcttattaatctgactttttctcataaatgtaaacataagcacaagttgacatcttgctttggaactggtacagtcctgttcataaattcaaatagttaccaaaatatgtgaaacttgtgcatatcttattttaattggctactttcttaattcagaagtgaggttcctcagatgtatttcagtgatgctggaatttccagcaaagtctctcacgtctgtcaaacattcagtaaatcacctaatgtttataatttaccaaataatcagacctaatgcttaatatagctgactaaatgctttgatactctgcattctagtcattttatcagatttcattttgttttgttttttgggatggagtctcactctgtcacccaggctggagtgcagtggtgcaatctcggctcactgcaacccctacttcccggactcaagtgatcctcccaccttagccttcctagtagctgggaatacaggtgcacactaccacacctagctaatttttatatttttgtagagacagggtttcactatattgccccgtctggtctcgaactcctgggcttaagcgacacacctgcctcagcctcccaaagtgcttggattacaggtgtaagccaccgtgcctggccagatattttaaattttaaaatttaaaaataagatttagagaactcatttaattttagttttttttatatctcctctttttattcttcttattctttcttattgcagtaaaatagaaacacaacaaaaggaatacaatgataccgtaaaccgtaagaaaactattcattccttaccagaatgaaaatgaaagaaattcatattttatctgaataatttttacaatgcttgcaaatttaccagaacaactgtaaagagttccaaaatttaacttaactcaatgaactagttatgggagatttagtgtgtgataatgtgaaaaaaaaataaaagataaagtagcatctgaggaacaaatgctaatatcttagatttggatagcatactgccattgtctatactgtatctattactttttgttttgtaatctcctcttttcctatgttcattggaaatgaccagtgccactagcttacttttctttcacgtaaaatattacattaggggaactggcttgctattatcctgccatttacccagaaggacagatgtctcaaatagttcgtgaattaaaaaaatacgaatcaaaaaaatctgaaatcataccctgtaagtttgataagccttacttttcagatgatttagtgtacgatatattaaacaatttattttttatttgaaatctatatcttgcacagataaaaattcagacatgatggggcaggtcctagcctaaatgaaatacatatgcttcactaaataatactgtttttgttattagttctaagacttgttagttaatttatagtatatgttcaggaaaaagtacataaaatttaacatagattttaaagtggatttctttccgtcttttaaagaaatcaattttccttttcttctcttgatataaaccccattacagtctaagataaggacaccagatactgccctagtttcaacttatttcagagccttggagcataatatggggaataataagacacagagcattatttgtgctttctaatctgttcagactattttaaataagcataaatcagatattcacatgttaatatgttgaagggtaaaacgcgaatatatatcattgcttaaataggcttaatgctgtatacataaattttcatcaaatcttgctcccaaatatttctattttaattttgacaggagttaattttccttttatttgttaactcccagataatttactgtaattacatataattgacttagtaaatatatagttgcctgagtttttgaagaaagacaaaaatcttttatcccaaccaaactatattcatgctaaagtcacccaaatttgagccagaatcgtatatccatattgctgtgaacaaccgcagaacactaattacaataaatctaatctacccatttgcaatgacactttagattagaaaggctgtagagaggggtatgatttaagagtgaaaaaatatttccaaaattaagtaagagtttagacctgtaattgaaagagacattaatgtgtgtgtcataatagatgataggatattctactactgtgaagctgagcctcttgttaccttgcagcagggtacaacaataaaaaatctttgattttatttgacattcttctaatagactccacacttctaaacatgaacaaggaatttcatatagctgattcagcagcacatggaatattcattttctctaaagccttgtacctttctctcaatgacccttgtgaaatgaattttagtgtttgtgtgcacttcctacatttgaacgcttacagtggcatgagccttaaatgagcaagcttttaaatatttgtttataacacatatatcctccttgccagtttattttcagctttgtcttccactgaactttacttttcctgtttctgatcctggctgcttatatcttggctaagagtaaatgtcttgttgtcttaatgaccatggaaggctttttggagtaggtggagtttgcaaaaccccttacataacagaggaaatgaagcggaggctgttcctgatgataccttcatacaagcaaaagtccaatgtacaaaagtacaaggggttaacactaaacacctaacacatttattcaagctaagggtttgagtagaaaattgagtagggttataacaagaattggttttgattcttaattgcaaaagactctgcacagcaaactatgtagtttgaattttaccctttaggggccagggaaaattaagaagagataactggcatgaccaaagcaacagggtccaaatactaactgggagtcttttgtagtaatatcagcctatgttgtggtagtgcccgtgagataaagggatatatgtgagcttttttgacagaaaagtcaatacaaatagccataggtaaggatagtcttacaatttggaaaggcaaaaaaatagaaaaaaagactaagtaaaataatgcgaattgtgagtataggtatctgggaaacagcacactcttaattgatatagagaagtcagagacaggttgggttgaaggatgatgaggtcaggttgcaccatttgaaacaaaaccatcaatggagtgtatcaggaagaaattaaaatataaactgagatagcatgagagaagtctaaggtgaaaaaatattggaaaaattaaaacagaggtaggtagttgagtctttttttgttgtttgccattttaatttttgataaggagttgtacaacatcaattaaatacatcaactcattctgaaaaaagttactgtgtaaagaaatgcatagtaacaaacctcagcttcctgaagttggagctattgtgcacgacagagataacaactgtgtgactttgcttagtttggttgtctttctgtctaaatgctgcctaagatccttggcttggcatatgtgacaagcagagtaacgagtgccataataaatgaaattaatgttctgatttcagcaatggtttaggttctgttcataatcacatattatcattttcacagaaatggtaaagaagtaaagtccactaaagcagctctcttgatctgaatggaaaacttatttgttgtaaaagtgtttataatctctctctctttctgtctgccctacctaaaatgggggtaatgatgttacctgtttcagtcactgacatgtcactattaataacccactagaaaataagaaaaaaattaataaaaatagtaaataaactactggattataatatagctggagggtcatattatgacttaactgtatataatatatgctctttatggatttctaatctaatttttatacttttagaaatgtccatcttattttagtatttctgatatagaagctgatcttgcctttaaaaaaaaaagaatggaaaagtagaaatacaaagaagcttctttgaaataattcataaatatattattttaaaaataagacaattgcctattttaaaatgtctctgaagtggcaagtgaaaatgtagaaattgctaaaatatgattaaaaagagaagtgtttcttatattcatcataagccatgtgtatctattaaaagacaaaaagtgaatattgtcccgacgcaaaattgcattaacaaaaactacgtacagaatatagaaaaacttaatatcataaaattgctcattcagtactgacaacacatattttgtggttcattcggaccctgatatttttttcttctcaaccagttgttttcttattttgcacaactgaaattcactatttttcttttctattactgttttattatagcctcaaagcactttataaataagaaaaaaaacagtaatttcatggttattagacattccaaaatgttctatctaaaaaatagttatcagctacattaatactgccaaactgttgaaaccaatttctgtgtattctttgctctaagttatttagcttgaaggatgttgggtgagttgctggatcagactggccagttggattcatttctcactgggaaaggaaataaactgataatgctataatgatattaattttaaatattccagtacatttccctagtgagtgcaaaagggcagttaaaagctcaattttgaggacagataggcctattagtcttgcatctgccatttaaatagctgaatgatgtttggcatgcctgttgtaacctctctaagtctctactgctcagatgtgattaaatgaggtacatttgaaaaataggacagagtaatgatcattaaatggcagatatttctcaaagggaggctttatcactgaccacaattttttactatagagttagatgctttcattagtaaacttctcttgttttgaaaataattttcgttgctgttgtatagctgaataacatgagcacaaaatcaagcacaatttttatctattttatctgtagaagcatgcatggctaagaaacctctactcatctttatatatgttttataagacaatgacttctgtcttcagtgttctctttcttctgtaagtcctggaagaccctcattattatattgccatattatcttctcagatttataaaattctgttatttttggattaataaaagcccttttagatctgatttacaaaaatctgtgttatatgaatacacacatgattttgttaagtatacttgtaaatataatcaaacacaatgtaaatgtatctattaaaatatagatgtctttaatgtgtactttaagataaagcaaaattacttaatttttcaacaagttttctgttggtaataagccaggacctgaggtttttggtgactatcaggtcttttagtgtaaaaaataatacatggaaaaaaatacttgaagcatccacaaatcgaaactcagctgggttaggagttttcctctcaacagacaagtcttgggaaagtggtctgtctcaggaaatattctggtctgttattttctcacaatttttatacactctcctttgataacgatatattgaagcaacccaatgtatgcattcataggtctctccttgtcatttggctaggtcataggttgagaaacattggtatcattgattgctcacaattctcatctttaaccatgctgaaacttctactaccagacacctaaaatatctcatatattctaagactatcctaggggtacaatggacacaagagatttgtcttgagaagattgcctaaatcatagggggaaatgtgcatagtaggcattttaaaacctaattctcctttcccttagtttttccgttaatttatttccacttgttcacttattcattaatttactcaaaatgagtaagcacctactaggtacaaatatggaagtctagaccagggaagacacgggtttaaggaatattttatggatgcggatgaggcatcatttgaatttcatagtatagttaacaaaaacatacatttcaggctgggcgcggtggctcacgcctgtaatcccagcactttgggagaccgaggtgggtgaatcacgaggtcaggagatggagaccatccttgttaacacagtgaaaccccgtctctgctacaaatacaaaaaattagccgggcgaggtggcaggcgcctgtagtcccagctacgcgggaggctgagaggcaggagaatggcgtgaacccgggaggtggagcttgcagtgagcagagactgtgccactgcactccagcctgggcgacagagcgagactccatctcaaaaaaaaaaaaaaaaagacacatacattacagatagaagggttgaacaaaataaaatcagtagtgagcaaccttactgtgtgtaaatgctttaacatttaccagatttaaccttggggaggtgaattaaccttccttatcgtagactttctcatctatgaaatgaagataatctcatagggttgttgtgagaattaaatgagataattcgtagtactttttagctttgtgtctaatgcataataaaaacctaatattttttagcccttaaatcgttcctagaactctactaacccttggtatgattatccaagcactttcactccaaagttttcaattttaatcactgcaaatatgttaacttgtattgtgtatacaagtgacatgtttaagcaaaatgatgctaatataataaaaattttaaaatgagacaaagtactcatagtgttaagctctccaatattgtgtttgtattggcaatggttagaaatgaattatagaccacaggaaaatctaggtaactcaaagcagttgaataattcaaatgtttagccacgatgataaggaagaacttttatttgttttaaaagtgttctatctacgatgtgtgatgttaacatttccaccgacaaatgaaacaagtttgtcaataaatatattaggaaataccatataaagaataaaaaaagccctctttaataaagccaggacatattttcttgcctcaattatatagcactatcaaatcaaaaattagacttttggcatatgatttctgacaattccatgtttcctcctaggtaacactgcaatattgttaatctacatggaaaccctgcattaaaatttttggttagggcgacctcggggcataatctaacctctgagcaacctatgctaagactaaaccagtttaagcaaattattatacatatactgacccaataatttgatcaacagaataagttaccctaggataacagcgcaatcctattctagagtccatattgacaatagggtttacaacctcgatgttggatcaggacatcctaatggtgtagctgctatcaagggtttgtttgttcaatgattaaagtcctacatgatctgagttcagaccggagcaatccaggtcagtttctatctattttatttttctcccagtatgaaaggacgagagaaacagggcccacttcataaagcgccctcgccctatagatgatattatcttaagctaacaaatcacctcatatcttacccaaaagtagggtttgttaaggtggcagaagcccggtaattgcataaaatgtaaaactttataatcagaggttcaatgaatcttcttaacaacatgcctataatcaacctcctactacttatatctactctggctgccgtaacattccctacactcattgaatgaaaaattctaggctacatacaactatgcaaaggatccaatattttaggcccctatggactatttcaaccatttgctgatgcaataaaacttttcactaaagagaccctaaaaccctcatcatctactgttaccctttacactattgctccaaccctagccctttctattgcccttttcttatgaaccccactgcctaaaccaaatcccttaattttaatttcagcctcctatttattcatagtatactatactattatatagtttagcattattatatattaatattattgtataatggtatacaataatattcacagtatactgtgaatttatttttttaatgtatcaccataatacctttttgggtattataggtaggtcactagcttgtaattcccaagtacttttttatgtgccttctacaaattggtaagaaggagtcttttctagtcatctaaaattcaagtactctcccataagtgcttatctataaaatagtaatggctgtgaaagttcatctcccagttctttagcactctcaggtggatggtttttcaactgacctacaaccattaagcttgcttaagtagtccccaactatttggtctctgtttgaattgccatggctgtgcattcaccagtttgaaaaaattaccatatatgaatagaattaagcttagcaaggaagactgccttgtagaacaatcaaggtggaaataactattttatatatgaaagttcaatgacaaatgatacatagaagaaaaacatggtaataaataaatgtaatctgaatacgagaaagacatatatctattttgtgcttaacagtgcctgtgacaatgacatggagcctgcccctgcaaatcaaggcccagatttaggaccactgttgaaagcaaggttttggaaattggaaagagttcaaagggaaagaacataaaatagttattatttaaaaatactgactttaaagaaacctaagatatatgaactattagggctttagagaaggttcagtttatgatgaaggaactgcctttaaagaacttttttaatgtccttgtgacctcctagaagagaatgggctttggagacagtgaacctctttaaaatagcacttctgcatttattagctgtgtgatcctgtgtatatttccaagtctctaagactcttcattaataaaatgaggaaaaacattatatatatatatatatatatatatataaaatcatgagactcctgtaaaattaatgtatgtaaattactttgtatattgcctagcacatgatgcattccattaattgatagctattggtattaaataacaataattgagagctatttctacagaatatattaactggttacattcttctaattgcatcaaacaaataatttactcaaactgggcttctagcacttttacttttgtatatatctattggtagagaaatggaaacaaaaataaaagacaatgatactctgaccattcaccattcaatgcctgaaaattgagagcccaactctcattaaatacttcgtagatgtttgcagaattaaaaataagagaattggccgggcgcagttgctcacgcctgtgaatcccagcacttttggaggccaaggcggatagatcacgaggtcaggagatcgacaccatcctggctaacacggtaaaaccccgtctctacttaaaaaatacaaaaaattagctgggcgtcgcggcgggcgcctgtagtcccagctactcaggaggttgaggcaggagaatggcatgaatccgggaggcggagcttgcagtgagccgagatcgcgccactgcactccagcctgggcgacagagcaagactccatctcaaaatgataataatagaattatatgacttgtatgatctgagatagatgaatttaaggaagaatttggtattgagagatttaattcattacttccctagttgttatgggttgttttgagttattaccccacattaatcatttgtcattttgttttgttaaaatgagaacacattttctgtacatgttgcatgaaaaaaggcaagggaaccacatatctccattgactgcatactcaagtctatccattattttacataacagatagatgaaaggaaacattttttaaatatttgtctttaaaattatcatagaatggataacagtgattgtatagatgatggagacctttctttacgtgtagaattgcttgggcacagcacagtccacactggaagatttcttttctccccaatcaatcaatcaatctctctctctctctctctctttctctctctctctctctctctccctccctctctccctctctgcccctccctccctccctccctctctggggccctccccttccctcttttctccctgccttctttctccccacctcttcaactgcattggtaacgtgataagagcagaaatgacaagtggctattagattcacttgtatataaattctaagtgtcacctatttctatatcttaattattctataaaatgctatccagtttttgtaagcatttcaaggtaataagtgcaaagtaccttggacataggggatagtctttaatatttcctcttttttctttactttggatgaatgttaccagacagtaataacattttaagttcttcaggaaaacagcaaggcctatgcagttatatgaaagataagagaatatacctgtaataagagtattttctaataacattaactttttatatttaatattgctctgaatttattattctaaaccaaaagaaaaaaatccatcaaataatcttgaaaagaagcagctaatataatctatttctgacacttattctattcatttttatcaatacttgcatatcaccagacttacaataaagaacattcatgtaattattctttcgacatttatttattgagaacatactacacgccaggcattgttgaaagtgcttaagaaatatgagtggacaaaggagacctgcactgaagaaacatattcaggcagaaaaagttaccttttgacactctggggcatactcccttaactagtgtttgttggcttccttttgaagtttaaagtatcagaattgtactctgtagaagcttgttgaatgttagaaataaaaagaaaaccggactggactaggaaaagtcaatgccacttttattgtcctacctacactctggttgctcaggggaatttaatttgcctatttcataatgcctctttcttgcaactgccttcagctattacattttcaatcagcttatttctacccagcagaagcagtctggaagaggttgcctcaaagttggtttttctattgtatgtattagaatgctgtcagtaacttattatagtatcttattggatggtctttgtcctgctgtatcaccttcccagcagaggtacagataatgaaaatctatatggctaggaccttggatttgggcagttcaattagttgttcaggaagtctatcaaaaatgtgactccaggtccctgaactccagcattctcattattagagtgaaacgttagtgacaaatgaggtatgatggtctagacacctcatcagcctgctggcttgcagcctgaagtaaaggcgcagttttaaaaacatcaaggtcttgatgggttctgaacatgtgattccagaccaaaacctaagaaaaacgggggagcatcatacgttttaagacaataataaactcataggcctctgaaattctacagtcaagagtcaaagctacgtatgcacttgaagatgtggaaagatgttacagttcaagatgagatttcttattggctatagttgtaaatatcagggttattctaaaaaaagattgtcaacggtttaatgatactagaaaagctcacctatttttaaagttttttatttaagcagtgattaataaatactgatgtttgttattttaataaatgtcatgtgtatggagaggtatcatcaagtaaagtttgtactaatctatatgaaatccatatggatatccatatccaaatgtatgagtcacacatatattatctacagatgtggataaccactcaaatagtggttatccatgggaatgatgctgtcctctaggggtgttttggttatatgtggggtaaattttggttatcacaatgtggagggtgctattagtgtttagtgggcagagatagtagaatacatgcaaaataaagaattgttctgcctccaggaaaaattcctgtttcagagctcaataggaaaacctgtttgattatcagaacctagacccaaattctatcttacatgtaaatataaacccagcatacatttggtgtggtttaaatacagattaaattcagattaaattctctataattacaactactgtctaaagtgaaataaaatgatgctttattttgtctgaaagtttgccaacagtgttgtaccattttaaagaactatattactaattccagtcatcatttttagtcaccaattcgacatactatatcatttttatagccatcacattcatggtgattatacatttacaaacataggaccacttaattttacacagaattaaaaatctaaatacttacgctagaattactttcctcttaattcttctgtaaatgttagatagggagttatattgattttttaaaaaatcagctaagttacatgtctataagctgaatctcaaatagtaaaaggaaaataaaaagtacattataaaaagaatctgagtcttctgaaatttgaaattattgatttacatatatgggaggtctggctttttgactatagagccaagcacaaatgctgtatccaaacggtgggcacatttctttggtagaaatatatagattctgaaaacactcttgacacattcagacctataaatggatagcaaaattttgacataaagatctgaaaataaattctaaagttggcataatagattctcttcaagcagttcaaatacaaatatattaaatgcctcattatgcaagacaccttgataaatgcttggatgacaaagacaaatatgaaataattcactcctctagagagttgatattctagtgggagagacagaaaaatatctaaagaatgctaatgcaatgttaacgtggaaagatttattttatacagttctataaaagaatgaaagaggcatttgagaggaagcctggtatgagatgtagcttttgagctatgctatggcgtatgttgtagagtgcctaaaatattgtgcgaaaataacattgcaaggaaagagacaaaaataaaataccattttaaacaagaaaataacagcaagaaaacttttctcagatggttctgtgtttgaaggaagttcgactgtgttgtaacagaaaacatttgatggtccctgatgggtttcttggaagaatagagtgatgaattctgtgagagaaagaaaaatcagaattattctgcagaattaaaaaaccaacgaacaaacttaatttggagttccaagggaattcctagagagaatgaatgagggaatgagaaccaatggaggaaggtaggtagatgtgatcttggttttggcaatggtgagagacagagaaggctatggaagtaaaacagaggaaagttaagagataatggaattgggaagaaaggtgcccatgaaaatgtagtattctaggagtccacatagtccagggaagcactggacttcccacagtttaagcgaagggaatgaaggcagttttacttaaattttaaaggaaagaataattccaaaggtggagaattaaaaatatccagcaagtcagaatagttattaccttgcaaactccaaaccaattcaagtttctcccatcaatcagtcacagactaatgctttctaaaaataaaaaatcatgtacctcagtgtcacagcaatgcaactgcttcaatttctgtcgttatttcctgggggatggtaatactgtatttacagaccagtactggttcatgagttaaggttttggtagcaccgctctggaattgggcagcatgggtttgtatcttagctcccacacattattgtggacctgggaaaaacacttaacctctctgtcacttatttatctcatctgcaataaaaattgtgtctaatttttttggaaatgtgacagattatcaccatattggtattggttcttcatttttatttagtaataaaatttctgattttcagttgaatacttggaataatccctacttttctcagacatgtttgtagcgaatgtcttttaagaggaccagccagactaacatggtgaaatcccgtttctactaaacgcaaaaaattagccaggcatggtggtgcatgcctgtaatcgcagctacttggtaggctgacacaggagtatccaggcggcggaggttgcagtgagctgagatcacaccattgcagtctagcctcggcaacaagagtgaaactccgtctctaaataaataaataaagggggaaatattttgtgtatctgaattgtgccctccaggatagaatgtgatgtttggtgcttcttgggccaggaaatagaactcacaggctgagagttggtggatcagcaaaatagaaggagcctgagtcctgtacatcatgggccattataccagccctggagtgtccacttttacgtttcttataagctagagaaaaaacaaattatcttattaacattcttttgaattttctctcacatacagattaagcaatgcccaacttatcaatgaataagttagaaaatatgtgtaaaccaatacttgactcatagaagacattcactaaaatttaatagtaattattaaataagtaggttgaaaaagtcatctatttgttaagtaaatatttaataacaacattctgcctgccactgtgctttatactggtgatacgaagatgattaagataaatcagctgcatataaaaagttcttgtctcaaaattacagtgtaatgatacgctattcgcagtttgttgcaatttttcaaatgatctacaaagtggagagttaagagaaaaactaggaacgtttgtgtctggcaagtaatgtccttactgaaatttgccattgtgaggttcctcaaaatagtgtagagaaaaaaaaaaaaaaaaaatatatatatatatatatatgtaatttgatcattctccatatatttgcttctgaattagaggggaagtggcaaaatataagagttaaattttatggaaattgtattaagtcttttccttaagacataagcttagcaagatgccattttgtctgactgtagagtgataacgaatcaggttagagtgaacctgatctaacgttacaaaggtcaaatatatttcctttctcagattcagagttggatcaagactacagatgtatctattagatttcttgatgcctattctcaaacatctgagcaaaatttaaggtctccaaaaagtactattattctaatagaattttcagtatatgtaacaggttgtctttttccaactgcagtttggaaaaatacaaatttgattatctaaaatttgaaagtaaattaattttaatttaaattgctctaatatttttatatgtttgacatacagtttatattacttgttttattagttttaaatgaacatcattacttttattaaaatttgcctttgataggaaaaaaaactgttcttttcttgatgccataccaattatcaagtgtttattgttttgatagatttccagccacttcaatgtgcaactgatatggacaaaactttttgtgtatgttatttaatattttatttgtaattgctaaaagagaagaaaatagtaagtactaaataaacaatttttagataaatgaaataattaaaaacttgaatcttattttgattatttatagtttgtgggtgcatttaaagataaccaaagtcttataattcatttagcagcttgagttataagcagtggctccatcaggtatattttccaatgtgctatgtatgtaatttttcttctatcagataaactaaaagcaaacgtaagaggaatgctctcaacttttgccaggccctctcttagcttttgtgccatgtcctggtgacgactacacttgaaatccctgggctactgtacttctgtgctatccttattgagagaatggctttcgtatgtttgaagccaatgttttattactctttatttccttgatacacccttgatatcttttgttcttctagactcacattccaaggttacctctaggttttcaatatgatattcatttgagaagacagaaagcatacagactgtaagtaaataagagtaaccttattatggacataatatttactctcacacccaaacacaataatttgtaaacttccataataaacttatattactattaataataaattgcttgcaacttaaataaccatgatgaaaaaactagcattcagattcagtgttttttttttaattattaatctaaagtattaaggataaagaataaaccttataggaccggttatttattatttataaatcttatctataaattttaattttccctggaggttaaaaaatcagaatactatttagtggtaatcccactattaaagtatttatttctaagttaatgtaacttatactttgtactatttttttaaaaaatgctatttggggttgattgcataggtacaaattattccaaaagtaaaattttaaaatgaagtatgtattcagaccctttagagacatgctaatggcaattcattccttactgcttattaaagtaagcctgctaagcagacctacttattagttgaatgtgttttaactgggtcctctccccagagtttcataggctgaaatcaacatctcatctcactgcagtccgacctgggggcttgactaagaaaatatttactttaggatattagcagaatccatttctttgtgaaagtagaactgaagtccccagtttttgttggttgtcaaccaagagctactgtctgcttctaaaggccactctcaggctttgccttgtggtcccatccatttctgcaatagagtaactgtttcctcaaatccttctcacacttcaaacatctgtattctgctaccagctggagaaaactatgcttttaaagagttcatgtaggcctgatggggtgactcacgcctgtaatccaagcactttgggaagtcaagacaggaggatcacttgagcccaggagtttgagaacagcctgggcaacatagtaaaactctgtctttacaaaaaatacaaaaattagccaggcctggtggcagacacctgtagtctcagctactcaggaagcttaggcaggaggatcacttgaacccagaaggttgaggctgcagtgagctatgatcctgccactgcattccagtttgggtaacagagagaaaccctgtctttgaaaaaataaaaatgaaataaagagttcatgtggttttgttaagtcaatccagatgatgtctttatcttaagttcaactgattcatagtccatctgcaaatactcttttcttataaggtaacatagttatagaagtaacattgagaggagagtgatcatgacggccgtattagaatttagtctaccatactaatctgatcaacacgaaaaattaattcataaagtatataagagtttctctgagtaaattgtattttacaaaattcctttcttttaaatatgctaaaaaaatgagttattcatattgctaattggtatatgtattttgtatttacaatcggttattttttatgttaatctttgaaggtatttcatttagctatgttctacattattatttttaatattaaggtatttatactttagtgaacaattttttaaaaaattagttttatttttccaataaattaaactgggatgctgtgttggtattattatttctaagagtttgcacttgtatcacattagcacttttaccagttgatgccatagcaacactccaagttgctatttattatgctgtatattaacaattatggtttctaattatagcgaaattccagtagatcagcattcccctacttccatatatagtatatagaatattaaatcttgaaatatacttatggctatattaggaagaatgggtgttttttatttaccaatacatctttcaaataatacattacagaatttgctaatattgctatagtttgcaggattctcttatttaatatgttaatatgttaaatgaaatatgcaaatgtcataatggattgaatttaggtaatcattaatatttctgtgttacacatttctttaggtaaatgtatacaaatagattatttagcttcacatgaattaccatcaataattcccttgaatattaaaaataaatgttaatatttgagatctagctactgtatgtaactcaggggtaactcagggatagaggaatgttgaaagttcaaacccagagtcaaattattgatgatattttggatttgcatttgacttgactttttcttttttcttttttttttttattatactttaagttttagggtacatgtgcacaacgtgcagattagttacatatgtatacatgtgccatgttggtgtgctgcacccactaactcatcatttaacattaggtatatctccaaatgctatccctccccgctccccccaccccacaacaggccccggtatgtgatgttcataggtgggaattgaacaatgacttgactttttctaacaagatttggtagtgttttcacatctttcttttgtgtactttttaacacataaaatgacaaaataagagctaaaatattctaacttaccggaatatagtaaacttatgttagtaataggaaaaaataagagaatggccaatatttcagtacttttttagacttgttctctctctgagtgggttatataaccaagaataaaatttaaaaaaattagttaacatagacagtttacatatatttacatatacatatacatatatatatatatatatatatatatatatatatatatatattaccaaaattaggtcttggatagtgttttcatgctggattagtctgttttcatgctgctgataaagacatacttgacactgggcaatttgcaaaagaaagaggtttaatggacctacagctccatgtggctggggaggcctcacaattatggcagaaggtgaaaggcacatttcatgtgatggcagacaagtgaagaaagtttgtgctaaaaattccccttttataaaaccatcagatctcatgagacttattcactatcatgaaattagcacaggaaagacctgcccccatgatacaattacctcccaccaggtccctcccataacacttaggaattatgggagttacaattcaagatgagatttgggtggggacacagccaaaccatatcattctaccccttgcccctcccaaatctcatgtcttcacatttcaaaaccaatcatgccttcccaacagtcccccaaagtcttaacacattataatattaactcaaaagtccacagtccaacatctcatctgagacaaagcaagtcccttccacctatcagcctgtaatatcaaaagtaaattagttacttcctagatacaatggaggtacaggcattgggtaaatagagccatttgaaatgggagaaatgggccaaaacaaaggggctagaggccccatgtacgtccaaaatccagtgaggcagtcaacttttaaagctccaaaattatctcctttgactccatgtctcacatccaggtcacgctgatgcaagaagtgggttcccacagtcttgggggctgccacctctgtgtcttcacatggtacagcctccctctcaggtgttttcacaggctggcgtttagtgactgcagcttttccaggcacattatgcaagctgtcagtggtctaccattctggggtctggagaatggtagccctcttctcacagctccactaggcagtgccccagtggggactctgtgtgggggcttcaaccccacatttcccttccccactgccctagtagaggttctctatgagagccttatgcctgccacaaacttctgcctagacatctaggcatttccatacatcctctgaaatctaggcaaaggttcccaaacctcagttcttgacttctatgcacccacaggctcaatgccacatggaggctgccaaggcttggggcttgcaccctctaaagccacaagccacagcttgagctggaccttggtcccttttaatcacagctggagtggctaggacacagggcaccaagtccctagagcacacagcagagggatcctgggcccagcccgtgaaaccatttttttctcctagctctccctgcctgtgatgggaggagctgctgcaaaggtctctgacatgccctggaggcattttccccattgtcttggcgattaacatttggctcctagttacttatgcacacttctgcagccaacttgaatttctcctcagaaaatgggattttcttttctatcatattgtcaggttgcgaattttccaaacttttatgctctctttcccttatgacattgaatgcctttaatagcacccaagtcgcctcttttgctgtgctgcttagaaatttcttccaccagataccctaaatcatctctctcaaagttccacacatttctaggacaggggcaaaatgccatcagtctgtctgcttaaaacataacaagagccaccttttctccattttccaacaagttcttcatgtctgtctgagaccaccttagcctggatttcattgtccatatcattatcagcattttggtcaaagccattcaacacgactttagggaattccaaacactcccacattttcctgccttcttctgagccctccaaacggttctaacttctgcctgtcacccagttccaaagtcgcttccacattttcaggtgtcttttcagcagcaccccacccctgctatcaatttactgtattattcctttttacactgctgataaagacatacccaagactgggcaatttacaaaaaaaaagaggtttaatggacttacagttccacatggctgaggaggccttacaatcatggtggaagaagatgaaaggtacatctcacgtggtggcagacgagtgaagagagcgagtgcagggaaactacccttttataaaaccatcagatctgagatttattcactatcacaagaatagcatggaaaaaaactggcccagtgattcacatacgtatcactaggtccctcccacaacacgtggaaattgtaggagtaagatgagatttgtatggggacacagccaaaccatatcagatagcctactaaaatatcagtaagttgaattttaactataatcaaacaattgacttttactgatatggagtggatattgagaaagaaatgcatttatgaagaaactgctatagaatgaaaaaatttaatggttttctacttgagatgttttctgtcattagacatctgagcagaatcaaatgactcctttataaaaatcttcatttattccctattaatgtggcaaacacatgtaaatgacatagtcattagcaaggatgagtaggtcataaatctgcattttcacattagtgggttgagtcacatttgaattcactaaatgaatacaacacattttctttcacgagtcaaaattccaataatagattttaagattgtttcatgaaagttagatccttccattgctttcttctatcttgccctttgactttctgcaaagactttcattttttagccaatttcctcagtgaaaagaacaaaacagaggaagttttgagctttgacatgctcatgatatcattagcaggaatactgtgcattaatgcaaagctgtctggccctgtagtggtcatgtcccctgccttaaaaggctttgagatgttgtaattatgaattaaggcatagaacagtaaatttggatagtacgttgtaaaggaaaactgaaggctttggtgatataagaccctcacttcccctaatctcttgttattcaatgaagaatgatcattttgatggtcttttattactacaatctaatataaatgaaggcttgttcagctgtctgtgttttatgtactgcttcccacagcactgggacccttccatattatttgacattacagcatcacatagggagttgccttagtggtttgctctcctgaggaaatcctattatacgctttgagtcagttcatccatgattgcctgggagaaaatcatttgtgttgttgaaatgtattcacttaaatgtttaaaatctgggagtcctggagatttttcattgaggaaaaataattttacatcttgtgttatattttgattttcgattctgacctgatatcagcaaagcaatctaaatatctccagagcaaaagtggaagtgaggagatgacaagaatcataaatattctactatttttgtggtaaatagctccatgacttagttcctaaattcaaaactcctcaaaggatgctgccccattgcagcattggtacccagcacaatgtctggagtgcaatgaccacttaatacgcagttgttgaatgcatggcaatgtgaatgaggggagggtaaagagaggcagaggcagaacaacaacctatctccattcttctttatggacacttgaaaatgccctgagaaaatcttacgtacttttctgacctgagactatcataaggcaatacttccaaggtatatgtaaagctagaaggaaaacagcctcttcatgctcccaagggccacttgtatttcaaaggcaagaataaaccttaatagccagaaattcttggcaacagtgccaaagaaatgttaagcaataatgacagaaaattagttatcttacattctacaggtaggtttgtagagtacaacaggctgacaggtgcctgtcaagaaaatgatgtttgacgagctataaagcatatttaatatgctaacccatttagttaaagcaccatatggaccttgatgatttgtttaactttgttcagttaatatatgttaaagtaaacacagtatgtctatacttaaatgaagcacacattttttgagtaatgtaataaatgtattttggatcaaatgtgttcacttaaagtcacagatgtaactgcattaaaaagaatatgcagttgtcattaaaacaaaatgtattttcttgttcaatgaattgaactacaagaaaatagtgttttattgaataaccactaatcaagcaaattgacttctaatatggcacaattcattcattcacatacttccagagtgttgctgccatgctccagaattacacttgttttccaaaaagcaaaatatcccaatgtttctatgtgacaaatgacatagataatttacaaaatattaaatacaatgaatgattgttttaacattaaatttttatagagaaatataaggatcccatttttcatacaaaattatagtatatttactaaatttatgtttgtctaaaaatatatattactcatttgtagaaaacctgtgagaaaatttgttacagtatgcatggcagtataaattgaaaagattttaatcacatgtgtaatcaaccttaaatgtgcccacaaatacaatctcataaggaaaaatttgagactattttgcaagaaaatattccccaaatcaggaaaaaattatatagtttagataactctataatagcaaatgtgaagaaacataggaaaaagctgagaaatgacctaaatatccaaaaatattggaaaatttgaagaaattatgaactgtgtacttgtttacatggtgttttgccagtaaaagggtaattatggaaatacagaaaactccttttgcttcagctgtaaattttaaaagatacaaaattttaaatatagtttatttatagatgcacacatttattatataaaagtatatatttttaaaaatttcaggccaggaatggtggctaatgcctataatcccaatttgggaggctgaggcaggacgattatttgaggccaggagctcaagaccagcttaggcaacatagagagaccccgtctctgcaatttttttttaaacagctagacatgatgttgcatgcctgtagccatagatgatcaggaggctcaggcaggaagattgcttgaacccaggtgattgaggctgcaatgagccatgatagcaccactgcccttcagcctaggcaacagagtaagaccctgtccaaaaaaaaaaaaaaaaaaaaaagccagaatactcttaagtgataagatagtggaaacaggaataatcttttactctctttattatttattatcttctgaacttaaagaatttttattaaagattaaaatctacaaaacaaacaatttattgcaatcttacttttttaaatctctttcacttaggataaattttgtgacccagtttcttgatgaaaatatcaaaagacagatttttttttttttaagatggagtctcgctctgtcacccaggttgcagtacagaggcacaatctcagctcacttcaacctctgccttcggggttcaaactattctcctgtctcagccacccaagtatctgggattgcaggtgcccaccaccatgcctagctaattttttgtattttagtagagacaggatttcatcatgttgggtaagttggtctcgaactcctgaactgagatgatccactcgcctcagtctcccaaagtgctgggattacaggcatgagtcactgtgcctggccaaaagacaggttcttaacaggactacttatgaagttataaaacacttttaacaaatgctataaccatatgtttatagaaagcatatttgtccatttatctctaatggttccttgtacggtgattttcttgtaaatattaaatgctacaatggtttaattaatgatcgttactctttcatcctcatctttatttgaaggtacattatgtttagaccaaaacattaaaaaacaacattgcttaatagcaactatttcaaaatttcaaaagaacagaaagttgacaaatgctactaaaaggtagagaaatgctactaaaaggtagaaaaatgtggttggatctatgaacttgcatgagccagaggagtaatgcagataaggtttctaaacaaagaggacgtcaaagatgttgatctagagaaatggtacaaatgagaactacaggggggagaatagggggaagaaaagatgacgaagtaaaataggacatgtaattcaagaagtgaaggctcttaatgtatgtttgtagagaactttcagtcttttgatcagagaatgagccaattcttgaagtagcatattttcctctaaggatgttctaagtcaaggatactagcaatagataggtgttctgcttcttctcctagtaagataatacggttttattatttaaggattttccaccttagaataattttcttagctataaaaaatggcaagtattatgatgaattaagtgataacataaatacatatattaagaattgattcttcagctttcaaattcatattactaaggttttgcatgtactgtctccagaacatttcataggatgttcatatttctttttaagtcaaattatattttactgtacattaattttcagcattttttttaagaacaaaagatgttctggacatctttccaagcatcctaataggataaaagaaaattacacaggtaaaattgagaaaaattatttgaattttcacttcactatgtgtgcaatttatccttagtctaaattgatgaggtggtctacagttttcttttaaaatatgtgattgttacagtaattctttaaaatacgtttggtagactatttaaaacattaagaaattcatactcagatgagttaaatggattcagaaattcagccaaatactacctttgggaataaagctcagggatttcagaatcctggtattgtacactaattaaaaaaagctctttgcgagactccatctcaaataaataaataaataaataataaaactcttgtcctataagcaaatatattgatttgtctataccatgtgattattaacaaagttgtgtatctttaaatatgcagaaacattacaatttaggatcaatataaaaggaactgaaaaaatatctctttataataacctaatatatatggaaaatatatgatatgtactacttttttcagaaccatcttctgagtacaagccatcactattcaaaaattgatgatggcaactaccctctgggtatatacccataaacattggcagcagggacttgaacagatatttgtacacttgtgttcatagcagcattatttacaatagacaaaacatgtaaatagcccaaatgttaattgacacaaaaatgaacaaacaaaatgtggtataaatataatggaatattcttgagccttaagaaggaagaccattctgacacatcatactgcagtataaatgaatcttacagttattatgctaagtgaaataagtcagtgacaaaaggacaaatattgtatgattctactatatgagacacctagactagtcaaatttatagagacacgaggtaaaatggtagttgccaagggttcagggtgggacaaatgggaagttagtgttcaatggacagagaatttcagtttggaaagatgaaggaataagctctggagaaagaggctgttataaaatgtgaatatgcttaatgtcactaagctgtacacctaaaagtggttaaaatgggaaattttatgtatattttattttaccacaataaaaagttggtgaaaacatcaatgtgattagtacatgaatccaaataaatcattggtggtattaactacatgaaatttcagttttctgaatttattctctaaatttgttgtaatttataaataaagcatagtgaaacaatagggaaaataatatattattctaaataagaaataactgaatgaaatttagcaaatactatctagaaagtatcataagatagcaagagaaaagtactaaaaagacagtacttttcaaaccatctaaatcaactatataaggagtagacagaattatagcattaaaaaatgccaataaaaggatcttatccaattgaaaattatagcatgtcctctgtaagaatacctttttctgtaaatattttgtggctgcctcttctttcctaaaataaactcttagaaattttcagaaggaacatctttgtggaagtagaaaagttaagctttaacatcaagagcagaaggctaaagaactggatgacatttatgccctaaactatatggtgaacacatttaatgccacaagtcatctttgttcctaaaatgaaataaacatatcattgaccagcaggatagagtcaagaatttgaaggtctaatacaaactgggttgaatccttgtatctctatcacctgcaggtcagaacctaagaaaattatttaaacctgagaggactcccagaatgaaaggtggtagcctgagtgatcaaaagattcatagagatactcagcaaccaaaatggtttctggacagtggactggcaatggctaaatcagatgcagtgtagtccgtgagagacatcagagggggactggtggatgagtagaagctggtagtgaatgaagaaggcatctctggatttgggaagaatgccactgaaagcatggatactgatggccagccatcatggagtgcatgctacaaacactttagaagagtatgaggcaaggagaaaagctcatactggaacgtgaggcagcaccaatcatttcagcagagcccagagaaaagcagagtgggagccttacctcatgttctttctctgaaccaagaaaaaaaataaaatgccctagaatttatcttactcctgagaatgaggaaaaggggaacgggtggggtggcaatccagaatataactgaacatttaaccaaaagaaactattgtgtactggaggtaattaaagaaacatgacaaggggaaagagaaaaagaagatattaactaagtgtggcccagttaacaagaaataaggaaagtttcaatttagtataccagagacttatgactgtttacatattaaatctgctatacccatctgggaaccactcctttagatgacgccaagtgactctattaatttggaaaaataacaccctagaatttagtgtctgctggggttagagaagtgggatgatttgctcaaagaaacataagattatttagagaaaagtccctagcttccagatccaataccctttcccaattgtaacataatgacctgttgatgattatgattagttcttattgaacatttataataataatagaaaaggatctcaaactttaggctgtatattcaaatcctaaatcttttgtgaattgttaaagtaactattaaaaacaatcattaaagacaaagatgtttgttgccccagtgagaaagactttcagaaataagtcaaacaacttgtagctctgcatgtgtacttttttttttgaggttgattttataatatgaataatggataaggccttagtgattgacccccaaatatcttcatttattaaaacatgaaacaaaaggaaagcttagtggacaaccacattgttgtaattattttagaaacatggcctttgaacaatcagagtatgacatgagtattgattaaattggaatttaagatgttgtcttaaagtagtgctgatttgaagtgcttttactttcagaaaaatttcaataaattactttgtatagcttgcaccagccacactttaagacgttggtaatgaacagttaaaatttgtccatctgtcaaactgtgtttgatgacagtatatgttgtaagagttgtgtaatgtatcagcatttgaacaagaataatgaacaaaaaaaggtagttttctttgaatcattacttaaatatctatcttgcctacagctcagaaacttgacagaaatatgtcttttttcatgaaacttaaaatcacctttcctgtctttaatatctaatcaatctgtactttgaggcattaggtagttacttctttattttaaaaagaagcattagcctttcagaattgctgtttcttgcagaattacagtctattatgataaaattgttcatataatgaagaatggccaggatgtagccactttccctggttctgctaatataagaaataggagagatggctcaaagccttctacagactttgatttaggactaatcccttaaaaatcattatggcctcatgcctctcacattacaacaaagtcggctacttctcttcctattacctcttgtttgtaaatatgattaaatgagcatattcaaaatagctattaaaatcataattattcaaaatgatttttttcgtattaaatgttcatagggactttttcttttttccactgtgaattagatatattattaattccaaactaagctcactgcattttagtcagatagcaaaaatctgtatcaatatacaggagggtttatcaattaaaattaatttgacaccctaatggtacatggtactataagacattctttttaaagtagtcttacaaatcatgagaagatggcctcaatgatattcaaaaaggcggtaccttctgctgccaacataagataaattcatgcagtcatacagtgtctatgtgttaagagcagcctggtctgagaataaaatatttccatgccacaaatctctttcaccaccactttcccatccttcagcgtccactccccactcaccaccatagttagaagcatcactgttacaactctgcagatcctgaatacgcctaggttagcatactgcagctctatcatgttcatctcactcttattctaggactgagtaacattttaaaactatttttaaaaaaagttgcacttggagtctgaaatcaaaatctatgctccttaaatgcacatggggactagatttatagcatccaccacgtgaactaaccaaatgtaaaattgtatgactattgtactttttctgtgcaggtatttctttgactatagtcatgtaatagacaaaagcacaaatgtggtgtctacttctaccactattaactgtaacaccttgaacaagttacttaacctcatgtgcctcaattttcttatttctaaaataagggtaataatgatacctgaaatcaaggaatgctgtgaagaatacataaactaatatgcacgaagtatttagagtaattaaaacaataagtaccatggaaatactagctctcattaagaattcatgattctagaatgaaattttaaaataagttatagaatttgaagaacaaagttttaaattccaatttgctttgttaaaattgcacataactctatatatcctaggtagacatgattgacagtagccaagagtgaaccacaactattaccaccgtttattaagaataaggagttagggggctgggcgcggtggttcatgtctgtaatcccagcattttaggaggccgagaggggtggatcacttgaggctgggagttcgagacaactctgggcaacatggcgaaaccccgtctctaccaaaaatatgaaaattagcccagtgtgttggcacatgcctgtaatcctagctacttgggaggctgagacacaagaatcacttgaactgggaggtggagggaggttgcagtgagctgagattgcgccactatactccagccttggtgacagagcaacactgtctcagaataagggaataaggagttagaagtctaagtaagttggataaattggagagtctaacatccttattatttcagttttcacaaaggggctatggagaatagttgcacataattctaaatttacaatggaacaagttggattaaactgtaaatattaactactatatctaggtatctacttgaagtctcattcagttaaaagcagaacatctgataatttttaccttactgaaaactctgcttttcagaaagttgagtaagggcttcattttagatcttattttgtcaaggaagcgtcagtttgtaaaatggaagtgacaggaatcttgggagatgttcgtatcgtctaaggtgccataaagccaaggaaataaatgctttgtagagtctaatatattccctagattttaagaaaatcttctgaacaaagtgagttcatgacaaagatagctgtgctcaaatgctgaaagctttaaaaaatgaaagttttattatagcctcacagatttcctaatgagaaagcaaacatacatctaataaattaatgcagttatatagagataaagctttctgttgggcttagcttttatagcagaacatataaaaagcggaagtaagcacaaaatgaagaataaattgtaagaaaactgagagaaactctaaaacatggaaaaaggcataggtgaaaatattgagtacaacataaattgtgctttatattatgcatgttctagaaaaacaaggcaaagttaagtttattgcttgaatcatagatgagagagaaaagagatctactcatcttgtattttacttccattttgcctgtttaccaggaactaagaaatggaataaatatggataagagttgaaattaaaatttaagataggagagggacaaatgggatttaaattaaacaacctttagtttcttctctcaaatatattctcttctacagattataaaatcctatgtgcaggcattaagtttattacaccagccttaccacaaacacataagtaatgcattgtactgtagtgttgccgcagctgcaacgtcactcagactataggaatttttcagcttcattataatcttttgggacttctgtcatatatatagtcttttgttaactgaaactttgttatgtggtgcaccactatacatgaaagtagctgcttttttaattggtataaaagaaatgcaaccttaaaaattcttttgttatgcattgtaatatacagaaagtagtgatgaaatatttgaaaattatcttaccataaaatatttcttattttgaagctgtagtgaaaaaatatatatgctggtttcagttaaacaaaattaatttttataatcacaaagcagtttgtgaaaacaagcagattgagtcagatagcccatcttttgataaagttactaaagcagttaatccatatcgattaagctgaaaggactcaggttaaaaatcaattctatgtaccagaacattggttcggctccagcgaaataatttggtgctcctgtctagaatcactgagtattgattcttcagaatcagactatgaagttgcaactttgattccccagagattttacaggaaaaaaaatggtcatcataaattagacttgagagttgttctgatgcattgagggaaaaaatgaaagaaattagcatcacctttggtaactaagggtttctttcctttctgtaggaaaacataggcttcaaatctcaaataacattctcagttatctagttatctaataacatatcttagttatcaaatatttatctgaatttctctccaattaaagcttattccctatgtatttgtatatacagacattcagtcaactaatgtttatcatgtacttactaaatgtgaagtcatagcccttttaaacaaaagtaaaaaaagttcgtatacaataaaaagacttaatttacaaaatggtgttttaaagtgtttctgggtttctttgctaacagaataaatctcaatataaatttataaatttatgcaaaaacattttctgttaagaaaacaaatcaaaccaaaagaattctctaggaatagaaaggctactactttatgcaagttgtaacactcacttcaagtcaaccaaattttgaccctcaaatcataagtatattactattttggttaagggcctgccaggattttcttcatcccagtttgctgatatcctttgggttggttatcctctagtaagtatgtgttatatacttatatgcacatcaataatgtatataccatatatttgtgttgtatatgttacagtagtgacacattaatgatattgtgatgtgtgtacttggcaattataacaatttatacaaattgctatgtgaacatagatgaaaacacaatatagattacaacttggactggagcaggtaattgatggaggagagaagagaagctatcatttataaaatgcaccaagcacagttctttgcattcattctcctgttgatttgacaaagcaatttatgattactagtatctccattttatggatgaaaaaaactgatactcactgatccatatgaacccagagctatatggttctaagtccccttccaatatacggctttgcaaatttggggtttagcgtttaaatttaattaagcttatgagcaaagcatgcagaagtagggaaatttagaacatgttcaagaaatagaattttcttggtttaatttgtgattaagagacaggggagggaatggagtggtgagaccaggaagacaagttggaacagatcatgtaaatccttagatggaaaactgagaaaggaatgtattttactggtagtgagagtcattgaatattttgcttgagggtataatgtgattgaacctcttataattttctacttccctacataactcatttccttctcttttactcttctgttgctagtaacaaattaccccaaatgttacagctgaaaacaacaaatatttattatatcacaattgctgtgggtcagaaacccagaaacaacttatctgggtaagtctgattcaaagtcttttaagaaggtgcagtcaagtggtttcatctgaaggtttcacagggcatgtgggaaattggagatctacttgtaagctcgctcaagtgattgttgacaatcctcagtccttcaccacgtgggtcttccatggggctgtctcagacccaggtagctgacttagtataaggaatataaaagagaatgagaccaagtcaaagagcacatgaagacaaaatccacagtctttcagtaaactactcttggaagtaacactccatctctttgctgtattctgtttgtaagaagtgaatcaataagtccagcccaaactcaagtggaaggcactgcacagacttgtgaacacccatagctgtatgattccaagtccaagaaaacaaagcaagcagagaaatagcctcttactctttggagcttatcataatgttgaaacagaaatatgaggaatgataatatgggttatcatttatgccacgtgaagatgagcatacaaagatatttgttagctctactgttgctaaactcaccttaagtcctttgagacaaaaaagaattacatagaactctagtttatatttcctattaaaggtttttatttttatttttgtttttattccatagtgcttaggataatatacacctcaactaggtattcattctataatgcaacaggcagtgattgttggggggttttcttaggggctgcctaccatgctacctctggccttgcttatattattcacctagagttattcaaattcagtaaaaatatttcagtgactacctttctcaatgatctatctctgacatgttaaactatatttttttgacctccagaaataaaagcaaaaagaaaaacaataaaccattggcttcaccatgcacttggacacatcattttgtttctttggtaagatctaggacatctactccacttgtgtcctcagaacactgagcaaagtgctaaatataatatatacccaatataactatattggcaatagaaaattaattgaaatcatttttggagtattacctgtgtatgttcaccacccttacttttagtttttatttttgattttgattgataattttttgaatactgcttgagtggctcaaataacatttcaaagtcacttctatgggataagaagcatgttttgctttgttttggcatttcctgaagcatttcttgtactgtttaatgcgctaaagcgtaaggattttagaagttcagaattttcagaaattctatgcaattttttgcatttttaaaactcatttgaccagcagaccctttgggaaaatgttagctgacttcatacatcatggggaaaaaatgtaagctagtttacctgctaatcagtatgagaccaaaacagtgattcaccttcaaatgtgatctgagttttttgtagccagagagtccttgaagtattgcaaaaatttaacaaaacagtaaaaaaaaatcctctttatagtagaatttcatgccattgttttgggtttcccatgtactaaaacctcaaaattggtaacaacaacaacaagaaaacaaagcaagcaaagagaaagcctcttactcttaagagcttatattgctgaaatgtagaaatataatgaggaattataatatgtgttatcatttatgccacatgaagatgaacataaaaagatatttcttagctcttgtattagttgctaaactctctttgagtcctttaagacaaaataattatatcacatagaactccagtttatatttcttattaaagatttttctttttatttatttttcctttctttccatagcacttgggataatatactcctcaacaatgtttgcattctataataccccatattgtctattgattataagcataaaccactacatagaaaaggtagaaagcaaaactgtcacagcaatggtgatctcagctatttttaaaggaagcttcgtttttttctctccacaggaaaagttgttttgacacccacccactgaacagtaaaataaagctgcattgattttgttttccccaccaggaatggcatgttactggattcatcttccacttagattaggcacacaaaaattaatgaattttaacagagctaaattcagcttcattttgtagccattttctttatgtatttacaatatgatctcaaacttgtataaatcatttgctttgaaatatatttaaagccatttttactcagtccatgctaagtgagtaaaggtttgcatctagaagagatgtcaggatattttagtgattagactaaaacaagcccaaagtaataataacatggcatctttcaccagaacagaagaaaatgttccccgattctttattgatgtttgtataatactgaggtgccaatagagataagccttggttttggctggtgcaagcgaataagcaatcagttaaatcagagcacaaagctgttaattcaaatctttgcagaagatagtaaattattcagaaatctaactcatctatctatcaaaaattgcactgagtaaaaaggtgggtttgaatactaatatattatacaaaaatagaattacagcatttaaatcattgaatgcagtgaaaattggatgagatgtggcatgcaagtaaataaaatactaatttccaactttaggaattataatttatgtggtggtttaagctttcaggtgatgtgtaattggatgtcttagctttactctgagaaaaagttccaattaaaaggaaaaccatctattgtttacatttaatacaactttgagggtttaaaagctcttcatcattatagaatttagagactaaataatgtacttagactctagctaattttagacaataagtgatttttttttttctttctttctttcttttcttttcaaaagcaagaccagcaactttgggaaaacctactgtcgggtaattgccatatggcaaaaaccatgattacttttgtaccaaggcaacctaataccaatacctaataccaattaccaattacttttgcaacaacctagtaaagtagcaggattctgactactctgaaccttggcaatctaagaaaattctgaaatacagtgtattcagaagaagcttataaatttgataaaaaagatgaacaatacctttattttaaagtatatttctacacaatgtatatttgcacttatcttcaaactgattttgtaatttgttatagtattgtttggtgttagcctaagtagtaatctatgatattttatctattaaatgtgaataattaaagagggtgaatttgggtaaactgatttactaatatttattaattaaattgagtaactttaggaaaactacattttcttatcacatttgttctcttgtaaaaagcatgtcaatacctaggagacaatagatgagtgctttcattcccaataaggcaatcattttcagaatgagctttataaagaaactaatagtcatatttcaacttgattatttgaccatcacaattttataaattgaaaggagtgtttgaaatcatagggcatgggtagtagtggaattgcattttttaaattacctataatttttttaaatgtcactgccttagaaattcttagggtatgtagtcttatcactgttaataagaaaagaaaaattatttaaaaatggggaagataaaagaagttgaaatgcttttttggaaggaccaacagaatccactttacagtgacatacatgaaatgagcaatgtttagtatattgtagtcaacaccccatcccattcatttaaattttgcaaataatttcatcaggagtaaatgtgaaaatggacctagagaattgtgagtataatttttttagtgttctgtcattgtgtgtatgtttgtatatatttaattttaaagaataattttaattgcatatatgaacagactttaaattgtatggttactgattcagtatcatctaaaatatatgtattcattaatttctctacaaatcttttactgagtgtatactatatgtgaacatagtatgtgctagagttaaaatgataatatatgacaagcacctgcattcaaagaactcccaggtaaatcagcacttgtcatgaaaacaaagtttcattacagagtgataaatgttaatagagtagggctctattgtcttagcttggacatgattagactccacttattgtggtaagtgactctagttcccttgtttattccagccattattacagagttacatatgactgctcagtctgcagccttttaaccaagatttcaaatggttgttatcattccttcttagaattaacatagacatagtgatactcctttcatctatctgtctatctttctatctatctacctatctaacagaaacaggagaacatacagctttttcatatatgtatgcttgtctttcccaaaattataagtttatagattaagcctttattttggagttgacgttgttttgtgtgcttttgcatttgtcgttgtacatttttctcccaattttgtggctgtaaggcctagtacagtgactgacatatatcaagagctaatttttaatgtgaaacactaagaaactttatgattaattatatgtatgagattggttttaaaacagaaacagatacccacaaagagacttgaaagatttgcttttaaatcaggaaacccacactctgctccctcttcatgtcttcctctctctctctctctccagtgtgtttattttagtaagataagtaagattcctgataggtgtaaagagacaagagaaaacattgctactgtatcacagcacattcattttaaattcaattaagttttctgatttctatccaaatggaaaaccctgcaaaccttcccattctgctaatctttgggccatactaactttctgattctaacctgtaactgattaactggacctttaaagctttttctgttacctttatacttggccttggtctagaagagtctcacagactctgtctctgcccaagctaattccaggaaatgctgtctattctattcagtgacctctcccgaggagtcagagctagttggtgttgatgacagggttggggaggtagtcaggggacaggactgaaaagaagtgtggagttaaataagtagatagccattttaggaagcctctgttttcctctggtttgcatggggattcatgcaaattagtgtaaactagacatctcactggcaaggctgcagggactcagctagaatctgtttggcatctgttcctcttgctcaacaatttctaagagaccaagaacaattccatagcacttatcaatcaaggggttgaaaatgacattgctatcactgagttaaatcaagtgtaagatcctgggggctgtgatcctggctctgtccctttaaaactggtgtgattactggtgtagctaccaccaagcctgagaatgccaaatctgaacgttgatggaggaacagcaaggatcctccaggcaaacagattgttctactccctcaaaaattcttcagaggagcagggagcccagagggggatcaaaatttctccaactcttcctcacttccaattatgtgtgaaagggaagatctatccaccacatccaaggagaagctccatcctaaacttgcagctcttatttctgagccagtcttgttgcagtgttgttttgatttttttcaaaggaacatgaaataaacagttgctttgtaatttatttttacatgtttctatcagcccttagaagttcaaagtattcaaaattttaaattatgttaattttacacttaaaaataaatgaactgaatttaaattacttaactttcttaagataatatttataaatttaaatgtgcatcactctatttttttctttttattttctttgctttactttactttttttttaagatagggtcttgctctatcacccaggctgaatgaagtgcagtgttgctcactgtggcctcaaactcctggattcaagtgatccttccacctcagcctcctgagaatctgagactacaggtgcatgccaccacacctcactattttattttccttttttataaagataggttcttgctatgttgcccaagttggtcttgaactcttggcctcaagtgaccctccagccacaggcttccaaagttctgggattacaggcatgaaccacctcgcccagccttacttttttttacttggtgaaatttctaaagaggaaacttgacattcatgaatactggaattaagaatatgagtaatatatgtgtgattaaatttagaacattttttctcttcatcttcatcttttacaatatatgtattttaactatgaattattgtacattgatggttatatttcttttttttagttttttttttcttttttttttttctggagacatgtcttgttctgtcactcagcctggagtgctgtgatgcaatcatggctcagtgcagccttgtcctcccaagggtcatgtgaccctctcaactcagcctccaagtagctgggagtacaggcatgtacgatcacatccaattaatttttgtattttttgtagaaaaggagttttgccatgttgcccaggctggtcttggactcttgggctcaagcaatccaccttccttggcctcccaaaatgctgggattacaggcatgactcattgcacctaacctgatggttatatttcatttacctatttagaatgttagtattgaacattttaacatataattatccaatttaatattaatcctttttgatattaatctcatattaatgttccatggaataatacagtggtcctttccttatatgccagaaatatgttctgagacctctagtggatgcctgaagctatggatgctaccgaatcctacatacattatatttttcttatacatagaagcctaagataaagtttaatttataaattaaacacagtaaaagataaccatacaactaataagatacaacaattataacaatatactgtaataaaaggtatgtgaatgtggtttctcaaagtatcttattgtcctgtaaccatctattttggaaccatggttgacagcaggtgactgaaactgtgaaaaacaaaactgcagatgggatggggactactgtgtttattgtcttacaaaaggaaataaaagtataatcttctttacgtaaagatttaagttttatttaggaactttaattaactacactctttgaacttaaaatttatattgtttccagctgatgtaagtgctactcagactctcttgaacttctttttcaattgtatgaatgtttcctagaaaattttatttgcatgaaactcactagcttcttttttttattttatatcataagatctctttcaggtggattgaatgtctgttccttaggtcacttgatagtacttgttctcaactaataatcaatgaagccatataagtttggatcttgaggtcacatgaaaacataacagtatttataaatttaaaaattagaaagaaatatttcttaaagaaaaagttctagcttaagaccagttccaaatgactgaagaaaggttcacgtggtagacagaaaaagcccccccaaagatacccactttctaatctctggaacctgcaaatatgttaacttacatgacaaaaggatttagcaaatataatcaaattaaggatatcaaaatggagagattgccccagattgtctgagagggctcattgtaatcacagggatctttataaggaaaatagaaaggtaagagcatcagaatcatagaaggaggtataacactgagaacagattttggagtgatttgattgttgatgttggaggtggaggaggcctgtggatgacagaagaagcatttaaaagttggaaaagacaagaaacaaatttgatctagaacctccagaagaaatacagccctaaagacatttgattttagccacatgaaatgaatttggaattctgatttgagatatagcataataaatttttatcgttttaagatgctaactttataaaatttgttatagcacagtagcagtaggaaaatcgtacagttctaaaaaagataaagagcagcaattcccaaaaggatatactcatgaattcttacctatttattcctttaacctatcgaatgtcctaaccaaatacaaaaatatgccattaccaaatacaacaacatgcctcattagcaacaaacacgtacttaggcttttgtccatttaggagttctaaatatttactcttctctccatcttagacaacaaatcctggggaatgtaattataatttactattaacctaaacactgccccagtttatgggccctaaacatttcaacgtttttcttctaacagtcccaagtgggccacctcttacaaagagagtaaagtgacaagtgttgaattatatatggtaaagtttatagaaggaagagatcactgtggacaggaatactcagaaagaattctaaaatacatcagccttagcaaaacaaggtatgtgctgagagatggttgcttggagagggacagagaggatgtggggagagaacattccagacagacatagaacaatatgtttggttgagatactcatatactcatatttttaattaaaaacatttttgtactaagaattatgcattttagttggcagaaagcaaacattcaggacatctagctcttcaataatgataaatgcagcttccacgtgactattggcatgtacagtttgccctatagaatcataaagctaaaagtaattttttgatacaaatcctcattgtaaaagggtctcaagattaaaataattcaatgtcttaggtaaaagctactttttaagtatgatcaggaatactgaagtgaatactaacatttttaaagtacatctcaatacaatcatagaagaaaggaatcttatgattatgtgtatgcgattttgtcagatagaagagtctgcccatttcaatttttttaagcggttcctaagctcagatcttaataccaaaacaagctactaagaatactcatttatagagtgaacaacaactaacaatttatttaagtacaattctgtgactttagctatatgtgtcatttagttctccttcataagtccttattcagctatggctaagctacgtctaataggaatactatggtttatatcaccttctatttaccaaccttcctctgttgcatattcaattagtcattgcaataacaggtaactattagagtaaaatgacaaatgttgaattatatatgccaaaatttatagaataaacagatacctcttacagatctataagatcttcaacaaaatagggtattctcaatattttgtttatgtaaaattcagagaaatgagtatttttcttcatttaatgcatttcaatatttttggggcttttgtttctaaactaatactatagaaatctattcagagctggaatgtaggaagtttcttctctttcagtgtattgcctccaaaataccagctacaactgttaatttcccggtaattgtttcctctctaatctctacaatgtttctctcattgtttcatttttactctgatgacatgatttgaggaaaggtttttgcacatttttggccaagttttttgcacatattgcacatttttcacattttaaaagttaattaaaagtttcctgactttttaatgatcgcccttctaactggtgtgagatggtatctcattgtggttttgatttgcatttttctgatggccagtgatggtgagaattttttcatgtcttttggctgcataaatgtcttcttttgagaaaagttaacttgtatatcataagctctctttcagatggattgaatgtctgttccttaggtcacttgatagtacttgttctatggagatgatagtacttgtttctgaggtgaataagctaacttttagcttattcgccccagaaaaagtcttagatattcagaaatcacaaaaatttaggctgtttccttggttgttgcagtccttccatttgttttaatatctcatctattatgtgttggctaggtaacgaatacatatttaatctaaaaatggatgtagtctgaatgtattttctaagttacattttaattttggaaaacaataaaaaattaatgtttttaaattttgatttcagtttacttgaacagactttttgcttataaaaagtagaacttgttgacattaccctctgattttccctttttattttttatttttagagacaggatctcactctgttgctcatgctggagtacagtatcatgatcatagctcactgcagcactgaactcctaggcttaagtgattctcctacctcagcctcctcagtagctaagactaatggcatgcaccaccatgtcagctaatttcttaaaaattaatttttaatatccctattattaattgttaacatctctatgttgcccaggttggtctagaaccctggctctaagcagttctcccatgttggcctcccaaagtgctgggattacaggcaggcgccgtaacacacagtatgattttctttaataattcaacatcatccattgctgaacagaagatgatattttgaagaaaaacaggaaaacagatattcgaagaacaaaagagtagcaaatactcactcctatctagctgtctctctccagactatttatagtcagtatcattttgttatctctgtcatagtacatttccaaattttttatctccactggccttgagaagtcaagttaccctagaacatgacaactttagatcattacagagtgtaatgggaatattagctcttttgtgtcatttaaataatttaacttaattaacaaacttaaattattctaaggattcttcaaattatgtcagacttttaaaaagttttccatgtttagccttttgacaaataaaattatacacaatgtgagttttatatcagcggcagtgatgtctttaaacacactttaaacatatgagtaacattttttttttctagtttgggcattttacagaccccttctttaaatctggctgtctttgaaaacttttaccattcattaacacctatattggaaagtggacaaaataaataaatgggtgtttgattctcaaaccagtccgtcctgtgatttcagtgaagtgttttggtggaagagcagttatacgagattcttataaaatctatgaatttcagtttaccatgatttccttttaccccactctaggtcaggaaaaggaagaaatagtttaatggtatgtgtaataacattgaaaataagataatcacaaaggagaaaagaagttataggagaagaggaagaaaggaaaaagtgtttctgattcttcctctcatgtaacatttcgacataattaagtcttattcattggtactgtatttataaatatttcaaacttaataagtatgctgaaactgatattaccagtataagaataatcaatccaattaagtataaaattaccttccataatattttttctgatcttgaaagggaatccataatctcattatagaaggatattactatccttatattcttttaaaagttgaaggaaatttcaatatagaataatatatcaaatccatcttctttcaactcagtttcaatagcattttcctaaaaggccttttcttcctttgagattttcttttctctgctttggatcgtgttttagtcaatgcccatttaaaggcaaaggagagatacctagtaaggccagctcaagtaaaaagaggtttctagaaaagacactggtcaactgtgtgtaactcaaggaaagcaaattgtcctgtgtgtcacaaggactgaagatgaaaaatagaaatgtgttaattacacagccatgcctttctgcatttttctttatgggtcaacatgagtgctaatctctgtttcttcatgcatgtcagtgttcatctctgtatcttcaagcacatcctacatttcaattccagggctgtcacatcactgaaatgtctgaatctctaaatcaaagcttcaaaacagagagggattatgccacttgagtaactgagtacaactcaatccatgtaagaatgaaattccttatccctccaatcactgtaaactggcttttactccagagtttccaatctcaagttgacaattttataattaatctcagatttctctttattttctactaaattttctcactcataatggtagcacatcatgtttattctgcatagatagatagatagatgatagatagatagatagatagatagatagatagatagatagatagatagatggatagatagatagacagatagatagatagagtttcactctgtcaccctggctagagtgcagtggagcgatcccggctcactgcaacctccgcctcctgggttcaagccattctcatgcctcagctttctgactacctgggactacaggtgcctgccaccatgcctgacttattcttgtagttttattagttttattagaaggggtttcaccatgttgggcaggctggtcttgaacttctgacctcaggtgatccacctcccaaaatactgggattataggcatgagtcaccatgcccagcctataattcttttcatatgtgatctgcaaattttcagtcttatacaggagttaaagatgaagattctggttaggacacctaagttcaaattacgtctcttactttggatatagtaaatatcctaagtcccatgaatttccggtgcctcagttcctttcactgtaaaatggggaaagtgattattcctatctcatagatggttgtgtggatttaatgaactagtatttataaggcacaagaaacactgtcagtcacattgcaccatataagattcagataatcgtaataatttccattctaactacaattgccataaatgtagtccccctaaactactgtaatcaattccttataggtccctattttagatcagttttcctaaatcactggtaggtcatataattttcacactatgaaattcttacttgtatatgaaatcctacatgccatccaaactaaacccatgtttgctccatcattgaaagtcttcctcaatctactctaatttatgttcccagattcatacttttatttcatccctttaaaatcactctgcttctcatgtgggatttcacctactttcatgtctgcaagcctttgctcagctgtctatgtcccccaactctagccttaaaagcacttcaactcttgtctgtccgttcaaatgttttcaaacaaaaacttttgaaatcttttttcccctcagaatagaaggtgttgagttacttggcttatttttgtttaaagattcattataagcaaagaacaggaacatttaattcagaattggtgtcttaagtaacttatttttctgccattttatccactaccagcccttacacttttataagcggttttacctattaaatgagaaaaatgctattttacaaataaaaaccaataacaactctggctcgaaatgtttgtgtgtacagataatatttcactgatgttactgtagggtgtttcataatttttatgaaagtaattcaagaaatgtcattcttttttaaataaataatgaattatactctgatataatataggaaaattgtctaaaatatttggtttaaaaatatcttttcaaaacattgaaaagctggcagtatttatttatagtgacttctttcttaatgtcagcagatagtacaatttctgtaagtgagaattttaaaattaattgaaaactctcctgttagtaaattaaagcatttataatatttcattattatcattcagtctgttgaaacccattaaaacattatattctacataatgctcatttctctggactatagttaacttattttttctttttcccccttttcccttctgtcctgcctctcctgtcatctgcacccctccagcctaccccaggatttttcttcttcatttctgtgttatatttttggaaatttcccttacccccttgacacattctcttaatctctatgcatttttctttaatctttcagaggtttcttggggcagagaaatgctgttctttaagttcaaggatgagcattttggtcctgcatacatctctgtctgtgtacagcagaaagtccattatgtttgatttttggtcttcactgaactgtgaataacctttgacttctttacaagaccaacacttcaaacagaaaaagggctcatctttgtttttggatataactgaatactcagccacctgaggaactttcatcctcacagcaacctttctttttcattaagaaaatattatgcaacagtactacaagcatcaggaacctctctctaggaaataaaataaaaagaagaaaataaaaggagaattaagaccctagttgtgtcacagagcaaagggctatgtgtagtgagatcttgttttatcttttattccactagttctttactgataattattccattacagactagtcttatatgtatttaataatctaaaaaataagggccaggagcagtggctcatgcctgtaattccaacagtttgggaggttgaggcaggaagatcacttgagtccaggagtttgagaccagcttggacaacatggtgaaaccctattcctacaaaacatacaaaaattaccctggtatgatagtgttttcatgtagtcccagctgttagggaatttcaggtaggaggatcgcttcagcccaggaggtcaaggctgcattgagctgtgatcctgccactgcactgcagcctgggcaacagaatgagaccctgtctcaacaaatcgtcatcatcatcatcatctaaaaaatagaatgatcatttctctgttgttataggccattatatttttgtgcttttttctttcatttctgttgtatatgagcagtcatatagatttctgatttgtagaaactctcactttgaataatgataactagaaaatagattctattaaatttagaaagacagagttgacagccaatgctatgtaagtacatgaggaagaggacaagaaatagcttttcttcactacatatttttatttatatttatttttattgttttgacttcattttatgtaaaattttgggggcatgttatagctgaatactaaagaaactgctcatcaaattattggatcttcctctctcaaagaaatggactggaataaatcagtgtccatgttgtacaaatggagggctgcattttacataaggttgtatgggcctctttgataattatatctgtttgatgattcaggggctacttgtatctcatctgctattctcctgctagttcactttgttactggaaattaaaccttctctttaaaaaagtctcaacgaaattgagtgtagacagaagatctgtaaatagaagttgaatttttatgtttgacatatatgttgtaaaacagaggaattcaggtttcttaagtctatttgaccgcttgatatgatgctccttagttctctattcaaattgtccttcacttattttttttctttgttttccttatctcatgcttgtttttatttttcctactcaacctaatatcacatttgttatgttataaaagagggaaatgtgattatcaatggtattttaaatgcatgtttaccctgtgtatttccagtctgcatgagaaagcagaacaaggagaaaagaaaatgaaaaggagataataaatgcttttaagatattcagaggggccaggcacggtggctgacatctgtaatccactttgggaggccaaggtgggcagatcatgaggtcaagagttcaagaccagcctggccaacatggtgaaaccccgtctctactaaaagtacaaaaattagccgggtgtggtggcacacgcctgtaatcctagctactcgggagactgaggcaggagaattccttgaacccgggaggcggaggttgcagtgagctgagatcacgctactgcactccagtctgggcgacagagcaatcctccatctcaaaaaaaaaaaaaaaaaaattttttttcagaggtttggtacatgaaaatgtgtgactccatcataaaccttactccaactcttttcaacctcctccactactttttacccacattatgtctttcccaatgaatctggtacacccactgccctagaaagtgccttgcacttttctagtgtttctcatcctttagtttttttccttaatttgaaaatctattacctgaggctcaaggcaaatgctccagttccatgaaaccttttctgaatacaaagcaaatatttacctactcattatgttctactgtataatgttttgtaaatcgttatttatctcttatgtaattatgctccatttccctaactggattatgaattctttaagatttctggcgttctgtctgggtacagtgctttgtagcaaagggaagggctaatttagcactgttgagaaatccatctttgggggtgaaatttatgtcaaaatcacagtttgaggtctgtaggatcaacagaaatttataaagtaaatgagaagattctagcactcagtcctcttgttcctttctctgaagtgtcacatgagagattaatctaaactccacagaggagaataaaacagaaacataacatgagtggaaacttgtagtgtccaaatgtcctagtctgacagcacagatatattaaattacttatgatcattgttttggtaaacatttccaagatcagaaatgacaaagttaagtgatacttcttatttctgcttttaaggtatgtctttaaaaaattacttacattgagaatatttaaaaaacataatatgctcatttgatttagagtatttccctttgttgaattgatcataaattataaagctatttagtgtctaatgtactatttttcattttcattctctcttctttgcctaggcatattgtatagacacacacacatacctataggtccatgtttatactgtttaacatgctacttactaaatattagggagcaggacagttgttctactcctgacagctttgataatgtctaaatatttaagaagagatattttaatactagatgagaattttaaatgtgaggtcattgtattcttgttatgaaacaactagatatttaaatttagtttaatttttttcagtagtggtacttgctattgagttctccaatatatttgagcatattctaagttgaatgagagcaataatttggtgtgtggtggtggtgaggtctcacttttgttctttggtttcagtttagatatattgggcttggaagtttataatatatttaaatacaaaaagaccatgtagcaaattcaatgctataaagtaaaaagaaaagcaaaaataagtgatataaaagaaaaagaagcatgatcagcatataaatttgtgaagtcataggatttggctgaaaatcatcgggtttctttctttctcacatgttttcatgatttgactgctgaacaaagcttcccaaagcgctgcattttctcagtttttccttacataaacatgagagaataaaatgcagtacgtctgcatccagccactttttaactcctgtagatctagtgtttaggtagtaacctacaatgatttcactttacttcaaaatatttgtgctgtctctgtatatcttcctaaaatatcatcaccttgcacatattttgcgctatggtacctgattaaatagtctgttgtatgctgtgaataaactcatgattgaataaactcaagggtaacttcaagtatctgaattgaaatttagggaatttatgtcacactacacatagcatataacttttaaaatatatttattgtgacagtttttatttttaaaatgcaaagatttagaaagaaaatttatatgtagttttatcctatgattagtggccaagaacaatattaaagccagaccatctagaggttcctttatagagatgtttagtggctattgtgtaggctttataggagtatgtattaaactgctgtcaatttaccagttattagatgtgtttacctgaaagcaacatgaccattttgttttgctctggaatgctaaattagtggagttatgggatagtttatctctgtttatcagctacaactcattttacttcatgtcatctctttacgtacttacagaatgtttcactggtatgcatgctgggattctgaagagtctttttttcttaccttctgtatttctagtctgtcactaacttgctgtgtcactttgagcaaattatttttttccactgagtcctaaatctttatactcccttaagatatacttttcttgaacactaagggcctgaaattacatgtcactctctctatagaaaggtaactttttcctttaacccatcgggcctatgcacacacttcttcccagaaatcttcaccaattaggtaagttatttgtagagcagatgcattatttctaacacgtcaatgttggaaagtgtactgccttttcattaagaatttactaaacatatagagaattgatggaataaaaatcccccaatccttgaaagtttatcatataggagttggataaatattaatttagtttattatgaaaagcttaagttatctaactatagataaatccaaacatagaattagaggtaaaataccctaaaatgatatctattgccgttttataatggcaaaacaataagacaggttacttttattgtaattatttataaaaaaagatatataaatttgagtaagttctgatctttaaaaaattctcatatctaattttttatatatgcttgaatgctttgtaagaatgaattgtggttcttttagaaattgtttttattcagggaatgttgaatatactagaaaaaataaattcccctaaaagctaaaagcttaaggcatttgccttaaatttcagaagtaaaagtaaaagatgcattattcagcgtatgtttcttaggactctcctacgctcaaggcagggtaaagtttctgttctgtaatgagtatgttatcagggagggagggggaaatgatatcctgctacaactcttatccatagctattgccattatcttctttctcatccaactatctttactttttcaattacactttctaaatatggtattcttttatattatacaagaaaagagactattacaagcttcctgacctttcctttttcctcaagaaatgccagcttaatcctaccctgatcctattaagaatcaaaagcatttactaataaacattcaataatatttattattaagccatacttccaggtaagaccttgatgttaagtcttcagatgcagctactttaacccttaactgttgtaatttccctctcctctgatcatacatggactcctgagacatagctgttttccaaacttcactgatgcaatttcttcttaatgaagtccctatactagaagtttctgacttaagaattactaggactgcattatttcctttctcagtaatgggtagtcttgtttctctgtttctttctaggactaagacaatgttatgtttttgcctgactcctttacttgctttcatcttttctggtcctgctcagcctgaggaatgggaccctgataccagtagtcaaatcttgatgacaactactagcctgcttagatttctgaatacattttttctatgtttcccatctcaatatttaaggcatgtattagaaaaatataacagctaaggtaatttgtttgggaagtgccaaaaaactcaacttaaactgactaacacaaataaatgaaaaaacaagcaaggaatgtgttgacttcaaaaaagaaaattcagattcaggtttgacatggaggaccagcgacaccaccatctctggtttctctagtttcccgctactttcccagggtgttgacttcatcctgaaaaactacatgatgatctccatcccaccagcaactctaccctcttcctatgtggtagtaaatgttttgcagccaaggagcattctagccctcatactttcacagtatattgtccaagagtagagaaaatctcctttggtaggctctgcacaagtcttgaggttcacctcctctctggtctcaatcgatttgtaccatttaattaaattgtattattattattattattattattattattattattattattatttgagatggagtttcactctgttgcccaggctggagtgcagtggtgtgatctcacctcactgtaacctccacctcctgggttcaaacgattctcctgcctcagcctcctgagtagctgggattacaggcacacaccaccaagccctgctaatttttttgtatttttactaaagaaggggttttgccatgttggccaggcaggtctcgaactcctgagctcaggtgatctgcctaccgcagcctcccacagtgagattacaggcatgaaccaccagccacctcacccagcagattctgatttgtaccatttctatttatttatttatttatttttggaggcggagtcttgctctgtcaccaggctggagtgcagtggcgcgatcttggctcactgcaacctccacctcccaggtgcaagcgattctcctgcctaagccgcctgagtagctgggactataggcgcgcaccaccatgcaccatcaggcctagctgatttttgtatttttagtagagacggggcttcaccatgttggccaggatggtctcgatctcttgacctcgtgatctgcccgcctcccaaagtactgggattacagcaggcatgagacgccgcgcccggccttgatttgtagcttttttttttttttttttttttgagacggagtctcgctctgtcgcccaggctggagtgcagtggcgcgatctcagctcactgcaacctccgcctcccgggctcaagcaattcttctgcctcagcctctcaagtagctgagactacaggcgccagccaccacacctggctaatttttatatttttagtagagaccgggtttcactatgttggccaagatggtctccatctcttgacctcgtgatccgcccgcctcggcctcccaagatttgtaccatttttaaatgattttttgtttccaagacagtagatgcgctggtattttaagccaattgaagttctctgctgaagctgagggtaagattagttccacataatggcaaggtttccttttaaggaaaaccagaggagagaagatggataatgctgaagaggggttgtttaatgggtacaaacatacaggtagatggaaggaatatattctttaggatcaacagtggagcagtgtgtattccttacagacatctccaggcacctcacattttattgattgattgattgattgattgattgagacaatttcgctcttgttgcccaggctggagtgcaatggtgagatctcggctgactgcaacctctgcctccctagttccagcaattctcctgcctcagcctcccgagtagctgggattacaggcatacgccaccaagcccagctaatttggtatttttagtagagacagggtttctccatattgctcagaccggtcttgaactcccgaccttagctgatctgcccacctcggcctaccaaagtgctgggattacagatatgagccaccgcacctggcccgggcgcctcacattctaacactttgcaccaaccaactatagaatgtgatgaagtcaccacttccccttgggaactctagcttatccgctgaacccagtatctgttactatctcattcagctagaaatacttcctccaaacaggtcctgccatagagggaaaatctttaccagctttttaccctcttttgcctcctgcctattctactttcgctaagcccttaggatcgataattaatatgaaaattcaacatttgtgaatgaaaatattagttcaattcaaaataacaaggttatctagttaaagaacatgtccatattcacatagaccaaagaaagaatttaagagaatgtgtgctagaatggtgctagaaatgatacacttgccctcaacaagtatttgtgattccagaccctggctgttgaggcgacactatggggaatagcacctgaacatttcttatgtcagtagcctccagcctgtataatacattttgaaaagttccatgcttgttctgtaaccttaatatcttctatgttacaaaaagtgtttgaaggagtgtctgccttatcaactattagttgattttgagtctcagtacttcaacagtgttgcagaagagcatgcttcatttttgaatagcagcaataatttacacagatattcaaatatatacttgaaaatatatacatacatatttattggtaacaataattttagagataagtaattttttaatttatcaagctgagcttcatattgtatcaatcaaatataaataatgagatgatttctaatgattgtgtgttcacaaaatattaattataagaaaatcgtatttcactagaaaaattggaatggtatttgttaattcttggcaaacacacctttttataagaatgggcaaagcaaacatagagaccatgggtacattttatttatacagatacccaattaagaaaaaagcgtaaataatcaaatgcagtagaaaatgtattaagataataaaatattgttgacattttatcaggttttaaaataagttaggtggtaacgatttttaaactaactttaagaaaatgcaaaaagatacgtagattaaaaataatatagttttaagcatttaaaatatgaaaatgcagctaagagaaaactagtaaataaataaaaaatagccatctttcaattatttgtcagctataaggcaataatcaaaacacatttaaaatgaaagtatttgtttacctattctaaatatacatcaaaataatttattgacttttaatacagttaaagaaattagtccaaaaaggctgtttgatttacaaaatataaaacttccaagttgagtaactgcaaagagatagttcttagaaatagacaagcttaaatcaatgttctcttttccacagagctttcttttcaatgttgttaaataaagtatatatgtgctataactcagttttgtggcttttttaacacttgttctgaccttcctttgccttcaatgtcagacaggatgggtaggcactaacagtttctagacttttaaatactaacttatactatactgtaatgatttttgacattcatagtcatttcaacattctagtaactaagcaatctaaagctagttggcaaaaaatatgcacaactctttgattagtaactatgttttgatgtttacatcaaggagtctaatctgaaatatccttcataataacctatgtagacaagggcaaagtaagacttcaatagccacctagacagtttggatgatggccagatgagccagtgttctaagggctgtcggtgaccttgtagtgaattttgcaaaagtgcgaatttctctgtctcaggcagttgtatgattaatgaaacacacccacgaagctacagtgcttggtaaacacatgttggctgtaaacaatattcgttctctgaaggattctgagagaagtggtgaatacagagccagatttacagagcagtattctgtacctcaaatgtaagcagtgctggagtggattcatgaaacttcaattcagtagtgagaaagtcaagccttatagctttccaatcctttgaagcaagatgtaattctttcacttttccatagtatttcttgtttcaaacaacattctctcttaatcatatagaaaaaaatacaagagatgaacacagtaaaccaatgaatttgttcatgtattcctctaagaagagcccacatttcttagtctgtgacaagaataacacctttgagtggaatactaaacaaaggtatgaatggattcttagcaaaataagagtgtacaaaagtcaaattatcagatagctatataataatttctgtagtgtttaaaatgttcatgggcgtagagagatatgaagggatattttaggatatctgtgaaaaagtaatacatttaatatattttgatttcagtggattttttatttagttcattttgatattcctctgataaatagtacagatcgtaatatgatacagactagactttttaaactgctagtagctaataggatacttgtgatttgaaaaacttttactgaaacatacaccaaatatatatattgtggcaagtgaatatgtaaatgacttattaatagaggtccagtaggtaaatgtctgtgtctgtaactttgtgtgtgtacatatattgttgcagaaattggaacaagtatgcttaaaaaggagagaaagcaaatttacgactttcaaaggcaacagtgtgtgtttcatttataccaattcttttttgaacaaatacattttaaaattgtattttaatctttatggtaatcaacataggagaaggtacatattaagtgaagagaggacaaatgaatgaatattcatagcactcagatttctatattttactgtttctgattgttatataaaactgatttattacaaatgtaagtaatacacacatttttagacaatgattagttaggtaactgctcaaagaataattgaaaccaataaatatcaccatctgtggacatatcaggtattgtcctttaaagataagtccttggcctggttttattagattatgttatcagaatatttttagtgatctatagaatgataccactttggatgagattgccaagatctggagagagaggtaggatttcttgtgactttgaaacactggaggaatgatgcgtaataaatgacattgtattcaaaggggatgagtgtaatagaaaatagctggctaggcaaaaaccaggttgtctgaaaccagttaatgtgcataagcaatgtgatcttactaaaagcatccttatgcatcctgttttcatagagtggcgtttgttcagttaaaaacaaagcataataacgaacaaaaacttgaatgtcctcagagcaggatggctgcaagtattagaaaacaattctcagtctgagtcagaacaagtgtgcagtttaatttctatacttcaaaactgatgggatgaacatgtgtaagacttggagatggcaactaaaatgagtaatgggctggaaaccaggacctctaaagaagggttcacggagttactgtcagtttgaggaaagaaggcaattcaagtacatgaaagactgtggtaaaaatgactccccaatgaacaaatgtgtgaaaaccaaaatatgtaagattaagtaaaaataagactataagaatttcatgatactatagtttttaaaaggagggtttttccattgttaaataattatcaaattagaattagaaagtctcttaactgtatagataccagtaatagctatatatgacaatatagaaactccttcagtatttgttctccatcatttccaaaacaacaacataaacacaaacacatcgtttacatatttgctaatgcataacctgtcactgataattgtaggaaagttaacgtgcaaaccatttaatgcattaacacagatcccttaattacttgccttaggaagggcatgtaatgggtgtctgaaaagactaatgtaaactacagtgcccagacatttcatagtcctgtgaatactgagggcttaggctgttgttgcactatctgtggaagaacagttcaggagtcagtatgcttatgagttggggaaagattaagatctttacatacaccaaaaagctcgtgaaatctgccccatgagaagcatgataccaagaaacagcatgatggtagtaggagatagacgatcccaggtaataggggctttccaagagagtgtgaggagcctataaactataggatcaaaactatctaggttcaaacccaaatctttcagtaacttacatgctttatgctttaatttcctcatttgtgaaatggcagtgatgatcatgataccgatctcaccgtggtgttgtggggattaaatgaattattataattaaaccccttaaatcagcgcctgacacagtacaaaacactgtatagggttagtattatttagaatgatttatatagctttgatgtgtttaaatacccttcttgaaccagtgtattttgaaatggtatttcaatatccagacttaaaatgaccatttgggaaagggtccaactttccggacaaattcagatgagcaaaattctttgaattggagattcaaaagagaaaagagaattttattggctatgattattttccaattgtcgctctttttactgctatgtatattttatatctcattttcatttacatctattgtaaaccaaataacagatttaatattcctgttagcatcacttctactatttccttttctgtgcgtgtgcatacatgtgtgatattctttacatgacctggtgtgtgcttcatattgcaactgcaattcccctacaaagagggaaacatgatgtgacaggaggctgtgtctaaagacagtccatgagctgcaggcagagctggtaccatttgtgctggccttttcccaggggtctacacgtcaaatatgggcatcagactggctttctggcttttgactgaactccagtagacataatatgaaaatgaatgttaaactttgtttctgccatttttgagatatttaatctatacctattgttattcttctaaaaaaataacttttttggcaggtactgctcttagcactggggatacagtgagaaatcagacagaggtttctgcttgtaagaagctatcattgtatagataagtaaataagcaattcatgaagataatttcctatcttcaagtactattaccaaagaataaaatagataagcagataaagcaatgcagagtaacaggatggagtgtcctattttaagtggagttgtaaggaaacatctctttgaataactgaattaggaacgcaaagtgagttaagcgagggagcccaccatgtaaagacctggatgatgagtgatgaacgttacaggcaatgttaagaaaatgtgcaaaaagcttgagtcaggaaagaatgtaatgtattaatgaaacaaaaaggaggcagtatggataaaacagagttgttaaagggaaaagcctttcaagatactatcatagaagtaagtaccctagagctatttgtataggaatcttgcatttaattttattctgagtgtatatcattgcaagaatttaagcagtgaaatgacattgttatatttacatgtttttattgatacataaaatttgttcatatctgtgggatacattttgttacatgcatgcactgtgtaatgatcaagtcagggtagctaagatggtcatcaccatgagcatttatcttttccgtctgctgagtacatttcaagtccacgcttctagctatttgaaatgtacagtacattgttattaactatagtcaccctactctatgatcaaacattagaacttattccttgttccttccaaactctcttcacacgcgtccccacccctgcatccttcccaggctctggtaactattattctcctctctacctccatgagatcaactttttagctcccatatatgagtgagcacatgggatatttgtctttctgtatctggcttatttcacttaacataataactcctatttccatcaatgttgctgtaaatggcataattttgttctttttttagctaaatagtatttcattgtgtatacataccacattttccttatcttttcatctcttgacggacacttagtttgatttcacatctttgctattgcgtagtgccgcaataaacataggggtgcatgtatgcctttgatacattgattctctgtttgattttaagataaatatgtagtagtgagattattcaatcaaatagtagttctaattttagttttttgagaaatatctatattgttttctataatggcttctactaacttgtattcccaccaacaatgtataacaattcccttttctctgcatctttgccagtattaatgtctttttgataaaagtcattctaagtggggtaagatgatattttattttggttttgatgagattttattttgggtctgattttcatttccctgactcttactgatgttgaacattttttcatatacctgttggtggtttgcatgccttcttttgagtagtgtgtatttagatcttttgcgcactttttaatgtttggggtttttttatgttgagttgtttaagttctttgtatattctgtgtattagtttcttgtcagataaagattttgcaaatacttcattcaacagtttgtctctttattatgttgattgtttccttgctgtgcagaaggtttttggtttaatatagtcccatttgtctgtcttcgttttgtttcctgtgattttgaattcttacccataaaatcttggcctagaccaatattctggagtgtttctcttatgctttcttctagtagttttatagtttcaggtcttatgtttatgtttttaagtcattttagtggattattgtatttgctgagggataagcatctagttttattcttctgtatatggacatccagttttcccaaaaccatttattatgttttcaaaattattaagattttgcatggagaatacattgtggaggccacttgttttcacacagatcaatgaacagaatctatgtactcagtggagattgtatacctagtccatagataattatggggtgaaaacgatgctatctgtgatgaggtaaaaagggattcaaaattttctttggaaatagacaccttgatggactggttgtgaatgttgacaaaaatatttattcacaaacatttattcacaacatctcagatgtcaggggctgcttttctccttgtcttatcaaagggaagttgacaagaaatcatatgtatgtacaaatttggagctcagggagattttatttctgagtatataaaaacagatgtcatccacatacagattatgtttcaagtcatgagaacagataagatcatctatgaaaagagtatgatagagaagaataaagggccataaattcagctcaagagccactaacatacagagttaatttgaggaggaagagtaaggaaatatcactagtgaggaacagccattgaagcagaatgaaaagcagatgttttctataggctaaaaagctgtgtttttggaagcagggagccgtctacataatactgccgagaagttacttaaaacgatgttaaaaaaaaaaaaggtttatacattggatttagtaagatacacgtcagtagtaatcttcctaagaaaggttttaaacagagtagtggggcaaattccaaaaaaggaggagatcaaaaagaacatgggggtgagatggggaggagtcaaatagaattcacaagtagtaacaattcctttggagatgtttttctgtgaaaggaagcagagaagaagtgcatgtggacacttactaatttcaataaggagaacagattaaacatttaaacatggaggtagattggtagatctggtattggaaaaaagagtctgttctcttttgcttgtttgcctttttttctttcaaagtggtatataagtcacaattatcagctgagaataggagaagtggtattggaggtttgaggaccaaaatgtgataaaattgtctcaaggaatgaaaatgaataataatgaattagtgagatgcaaaatttatcagtacattttgtttttctttcactcaggattttgttctatgactatttggaaaccaacaagaaccctttttttgttacgacaactatattttaagtcttgtttaatatatttttatgtgggtcctcatagtctagtgattagaagtatgaacttttgagtcaaataggcctgactacaacaggttaaattccttaattgtataagcctcaactttaagtactcaatggggataatatatttggggtaaacagcttgagtttgaacctgaactccgctgctgattagctgtgaggattcaggcaattcacttatcaggaaaattagaataaaaatacttctaacaataataatgttagcagtaattacaccactcagaatctggtgcttgataaatagcatcttcatggctatgggggtttgtttgtttgttttacattttaattaaagtatttcctcttatttcagtatcagttgagtccatgcaggacagacttaacctattctatatagatgtaaagattggtcctatacttagctaaagtataaagtttaggaaattatttcaaaattatgcatggagagcagcaaaggtttgggaaaattttgtaacttctttctgcaaacaaatatggaatatttaggctaaattactctcctaggagaatcaatttttaaaaagtttaacttttaaaacttagttcatttgaaaaacagtcagtcaagatgtccacaaataaaagtaaacattttgattgtctactctagggacgggattctagaaaaaccatggaatttttgggaaaggtcatttggctatactagtagagagaaggtcacatctcaaaatgtcattccttccatctattcataaacaaacaggtagtgatcttttggtagagatccataatatctccaataaagtctgggtttttaaatgtgcaccaacttctattttgacaatatcaacataaacttttaaaatataacctatatttctgtcaagttggccttgttgcttgggtcctattttatattgactcacatactttctaatttttttttactttatctccccatgttaaaatcccattcatatttaaggcctaattcaaatgaaaaggaacttccccccaatacttttcattcactgatgagcgctccactttgtaaatatcttgtgcttgacttttacctcttacatgtctctaaatatttgttaacttacagagtaatatcaaatatatgttatgtgtgtatatgtgtatcatctatgctctcagctcttttttattcttttcagatggagtttcgcttttgttgcccaggctggagtgcaatggcgtgatcttggctcactgcaacctccacctcccaggtacaaggattctcctgtctcagtttcccaagtagctcggattacagacatgcgccaccatgccgggcttttttttcttcttcttcttcttttttttttttgtatttagtagagacggggtttcaccatgttagtcaggctggtcatgaactcctgacctcaggtgatcacctgcctcagcctcccaaagtgctgggactgcaggtgtgcacgacagtgctcagcctgctctcaagctcttggaggaaggaattggtcatataagttttgaacgccttcgataatggtagtttatacggcacatagctgaggcgggtggatcacgaggtcaggagttcgagaccagcctgtccaatatggtgaaacctcatctctactaaaaacacaaaaattagccaggtgtggtggcatatgcctgtctactcagctactcaggaggtgaggcaggagaaccacttgaacctgggaggcagaggctgcagtgaccaagattgggccactgcactccagcctgggtgacatagcgagactctgtctcaaaaaaaaaaaaaaaaaaaaaaaagaaaagaaatatttgaagaagtcagttagtgtcagagatgctgtgctgttccacccagatctcctttcagtactaaaggattccttcctctggctgctgggaagattgtaagcagaaggctctcgatccttttggggaaatgctttggttgaagataccaacaccctttcactgagcaggtcacagccagtgcttgtgacatgggagtatgaaggcacaatgccctcaccatacccagaactactctccacagccaatccagcttcagggttgcttcagggttgcccaaggtcttactgtgactatatcacagcctaatctatagctctcccaattcctactccttcctctcacacactgccaaattggtgttgaccctgagacagcatgtcctgataaatctcctgcattcacatctctatacagagtctgtttcctgggagacctcaatccatggcattcaggaaaaaatgctgcaaactaaaaagcacatttttatgatatgctatttttcaagctttttgaatcacatctgctattggcaatggcatgttgggctttatttgttctttaaaaatatacagatagctatgaatacacttcatcttgaggctctaaatgatcacattttgttgtgactaatattcattaaaaagacaggttaccacagtaatatgatgtaatagcctttaagtactcaccctgctagtcaattattaactaatatctttattagttaaatccatatatggcaactacataaacctctatttcatgtgtttgatttactgcctattttaactacattgtatcctggatcaattgttttttatccaaactttgatcattgcaaaccttagtaagaaaaaggttttctgggattgactttctgtctgctttgcactagaacatatccatgcttaaaaaaaaaaatcacattattcaaattcctgcttttttctagttctatattatatattacatatatttctctagtttgttttagaagttgtgattaagtccttttgcataggttgttacaacagggaactattgattaaattagtataggaaagtaatgaccagctatttgtactctttcactgtgttaccaaatttcagttctgtgctctggtttctttacagctctatttagtcagatataagaaatagtaattgagattttcaaaagacaggattcatgatgatgttagacaattcatatgtggtttagcccatggcctcatgggttatttgaggtcaaaagtgaccaaatattttgtgtctaagtgccaccaaaatgcagacttcaaagaatctgtcatgctgcatatcctgaccctggttctgtgtcagtggtccttgggctgtgagggacactgcatgtgggcctgtgctctgatgacaactgcagggctcacaaggaaaggcttataaaatatgaatagacaacctccactccatccacctgtccctccctttcctctttctatcaataatgcacagctggtgaggagagatcaaatacaactcaaatcagccacttcctcagccaagggttctaagcaaaggtatgtcagaaatgaagaaaatgccaagttcctgacttcgatttgaaaatataaaatataatatttctatataatatgtgttaagttgttttttatttttgtttgtttgtttgttttgagagagtctcgctctgtctccaggctggagtgcagtggcacaatcttggctcactgcaacctccaactccctgattcaagtgattctcctgcctcagcctcctgagggcatgtaccaccacacccagctattttttgtatttttagtggagacagggtctcaccattttggccaggatggtctccatctcctgaactcatgatccacccccctcagcctcccaaagtgctgagattacaggcgtgagccaccgcgcccagcctatgctaggttttaactgtacttttatgatactgtccaggctgagattaagagcaatttcttactgattaaatatattaaaatatattaaaatcatataatagtgaatgtgtatgaatgtaatgcatttcttccaagtagactaagctttagtgtagagtcaaatgaatactcctttaaatgaaatagactcttttatctgtcactttatcctaattcaatttccttgctaaaattaaaaaaaaaaaacattttattgtatctttttatctgagaaattcagtttatcaaaatttacctcattaatattttacataaacctcttaacctagtcagagtatatatttctataactcagcttcagaaggaatgaaatatgataccataaaccctaggatgtagtgatgccccacttgttcgattttccctcaaaaagttgtatgcagagtctgtggtttttgttcgttgtacccctaatgccttaagctcaagtcatatttgttgagtgaataaagactttccaaaggaatagacaggaagaggatatttaaattgtggtgcatttagatctgcattactttttatcctgtgatgttgtggcatctttcccagccacactgacgtaggggattctttccagtctccaggatgctactcttctctgttttctcctttttctgacctatgctttactctgatgttttccatgtcttcttcagacacagtttcttccccatctaaccagtgttactgagtttactacatagttattgagggggttgtgttatataagtctggggattgggaagtggttaagtagcttttaaaaagagtatcagccgactttgggagtatacacactgccaagacttttttttaccctctcagctaggtaggctacagggaaacatcagcttttacttttgctattgtaacaatctataatgagctagagtgaacttaataaagatcttttatttctgtgttcaacaaatatttataaattaacttctaggctttagtcacttttatcctaagtgctgggtatacattgaaaaactatgcacaaagcccttatcctgatggagcttacaactgaatgataggacaagggaaaaatgcacatatatgtattttcccataaatatacataatatttatacagtctgtcctccatatccccaggttctgcatcccaggattcaaccaaatgtggctcaaacatatttttgaaaaacaataaaaaataatacaacaatttaaaacaatacacatttaaaaatatagtttggcaactattacacaacattaggtattgcaagtaatctaaagatgatttaaagtgaacagccatatgtgcataggttatatgcaaatactatgatattttgtacccatataagtgacttgagcactgctggacagagtaatatgtggagcgtaattttttgtaggatgatcatagaatgcactttatgctttaaatgagtggggatacgaattaagtgacagagttagctatagggttatttgaggttaatagtatttcaagagaacacagtgaaagagggagagagttagtagatgaggctaaatcacaaagggccttgaagggccagaagactttgtattttactctgagtgagactagaaatcatttaggggtctaaacaaagaacagatataatctcatttaaattttgaaagcatcactttggttgctgggtggagaatggaatataactgctaaagaaaaatttatttatgttaaaaaaaacgttaaaggcaggaagtccagcacaggaagagtagactcatcaggaaccagcctacttccatctggttccctctttattctccacctcatggtctaagatggttgtctgtgctctagcgattccatccataatctaaccttttctttgaagactttctggaatgtatgaccgttcagcagcacaccactggcgagaattcagttcagtgaccttgcatggttggagggaggctggcaaacacattctttaacctagccatttgtttgcctggtcaaaaagaaaaaaaaagtcaaagattttgaagcagtcctcttactgaacatttagggaagcatcccaaaatagtacaaggaaggaggcatgtaaattgaggaactctatttaaacaactgaagctcaagcccaaggacttacaattgggtcttttgagagtgagcatgtggacaacccattgctcagagtacccaatcctctcccctgccagctcacagttggctgcccaccctactcacccacacacattgtttttgtaaactttgtagcttcgtgcacttcttcacaggagccctctcaaatcacagattaaattatcccactccgtattaccctgtcattaacatctataccccttttttatagaacttaacacaatttgtaattcatgcatgtataattattttattaatgtttatctctcttctaaggctttaaaagacatgagcaggatccatgtcttcttttcccatcattgcattttcagtgctaacacaatgcctgatgcatagctgttgactggaaatatctattgagtaaataaacatcgaggaattcacttagtattgtatagtagaaagcaagacatggggttgaatgtaaaggtcttagtgctgaactctaggagactagaaatttcctggaaacattaaaataaacacatcaaatctattaaatatttttcataatatatgttgctcatgtatgtataatgaccaccataataactcattccctctttataacacttttaaaaaattcaagagtttggaaagctacaatttaaatatcaaaacatgatattatttttcaggcctaaatgatagtttttattctattgggaaatatatggaatgtcttttgaggaaaaacacctgctcacactttcaattttatactattttttggtattatgtttctcaataaacttagataaaaatggtataaatcattaatataacatttttaattctttagaaatttaaaaatctggatgaagaatgttacagaacacatggaactaatttcagaggaaggtcagaaacataaaagcaaattacttggacaaatctgagaactatttttcattaaaaatcgacgtccaaactcatcattatatgcattgttatacacatattttatgggtaaggataatggaaatgcatttggaagctgtcgttgatctccaggaaggactgttgctgctattcaatgaagcagagagtttgtctggcatgtgagacaagctattttttttttttgagtcctgtggaccatgcagatagttgatagcttctcacagccagactgacactttttaggtagaggtttactgtagcatacaagaaacagtgacctgtgatacagccaaatgactgctaaaatggtatgaaaagagatttcaactccctatggcactgctaatgtacctgaaatttttaaagtgcattttagtagttatgaaagtatccagacagagagcactaaagtctggtggtgccctcactttatccacctcaactcccagcacagagaggcatcccctgattgctggtatcacttgtagtggaaactcaaggcatgtgcaagattactttattctcaatttgctcttggccctctctgtttgacctttgcctctctgctgagatttaaagttagtggaattcaggagagagcttttattttgatatacacttctgtagagactgacctagaaatagactgacttattatatgtaagtgatccgatttgcatactgattctctctcactgaaagcttgagccatatttgactagtgagctctaggagatagatttcatagcctacagtcaatacagataatcttctgattttcaggggtacattcttctggcaaagctactataagttaaaatgacattagtcaaattttctgccagaagaagtcacaaaagaggattctttttgaagacctggtagtcagcctcttgtagataagaagacacttttagctgggtgcggtggctcatgcctataattccagcactttgggaggccgaggtgggaggatcatgaggtcaggagatccaggccatcctggctaacatggtgaaaccccgtctctaccaaaactacaacaattagccaggcatggtggtgggcgcctgtagtcccagctactcgggaggctgaggcaggagaatggcgtgaacccaggaggtggagcttgcggtgagccgagatagtgccactgcactacagcttgggcgacagagcaagactccttctcaaaaaaaaaaaaaaaaaaaaaggacactttcactaaggaatggtaatgtatgaatgaataagttgaatgaatgatatatttgtagaatataagactagactgtctaaaggtcatatacataaaagaataatgcattgctaatcatagaaaaatacatataatgtgattttgaacaaaattgttgcttactgaagatgcagtttcatattttgcaatgcttctgagaagctgctgaccttagagaaataactttatctctgtattcataagtatacatttatcagtggggttaatacctgtttcacagattgattttagatgtagaatatcagctaggagttaaataaggactggatttgtatctcagctctgtgaattagtagaagggaacccaggtgatttactaggactttttaagtctgaatgctaatagtccccaatattcattcccttttactcacttttggtaatcatccaccttcccttggagctatgcaaagtcatatgactaaattttggtcaatgggatatgaaaggaaatgatgtagcacgttctcaatctcacccttttaaagcacctctttaccctccactgctctcagatacttccagtgggcttgaatgtagacatagtcatggaaagctggtttcagccatacccttgaaagcaatatctggaggatgacagaaccaacagacagaaagtatctgggtccctgatgattgctcttgtgaaacaaaggtgccttgctaacttgcctgtaactttcagctgccatgtaatagagaaaattctatcttattgaagccactgtacttgtgtgtctgttatggtaacttggcctgtaaccagaaaaccatcactttgagcaaagcactagaccccagatttttactttgataatccataaacatgatgtataatagtaatgatactacttataatgttatttttaagacaaagcatttcatgggaggccaagacaggcagatcacttgaggtcaggagttcaagaccagcctggctaacatgctgaaacccaggctcaactaaaaatacaaaaactagctgggcatggtggtgggtatctgtaattccagctactccggagactgaggcaggagaatcgcttgaacctgggaggtggaatttgcagtgaaccgagaccacaccactgcactccagtctgggcgacagagactatgtataaaaaagaatttcaagccaggcacagtatgcgtgcctttagttccaactactgggagggttgtggcaggagaatcacttgaggccaggatttcaaggctgtagttggctaagattgtgcctgtgaatagccactgcactccaatctcaccaacatagtgagccatcatctcaaaaaaaaaaaaaaaatttaatagtgcctggtacatgatcagcacataagtgttacttatgcttattttgtattcttctaattattattatatctgttatttgtgtacttaaaaaatcataaaattaaatattttcatcctcaataagacatattgagcaatactaaaagaaagttgtgattgaaaataaaatctttatcaatgtcatgaaattattttcttttttaaccacaaaaccctttcaagaaaattactgaaatgagtttttgactttgatattgatgcagatttatgtttttctattgttatatgtgtgttcctgttacatatgagtgttttgcattgcaaattttcaaagaacatatactgtttataattattttttacctttgaaaaaaaattttttacttttcaaagttgccatccaatccgggctggtactttgatctgatctgtgaccttaatgccacatggttgttcttaaacagggtttggaacacctcatttaaaaaacaagtgtggatggcttcccctttactgaaatatgttgtgcaagttccttaacatagcatctgaaagactttttcaatctagcagcaaattagttatagcagtgggcattatcctggtgtattagtttattttcccattgctaataaagacatatcagagactgggtaatttacaaaataaagaggtttattggacttacagttccacatggctggggaggcctcacaatcatggcagaagttggaaagcaaggaggagcaactcacgtcttacaagaatggtggcaggcaaagagagagcttgtggagataaactcccatttttaaaccatcagatctcatgagattcattcactatcacaagaagagtacaggaaagacccgccccataattcaatcacctcccacttcgttcctcctacaacacatgggaattgtgggagttacaattcaagatgagatttgcgtggggacacatacaaaccatattattctgccctgactgctcccaaatctcatgtcctcacatttcaaaaccaattatgccttctgaacagtctcccaaagtcttatttcatcattaactcagaagtccacagtcaacatctcatctgagacaaggcaagccccttctgcctatgagcctgtgaaattcaaagcaagttagttactttctagatacaatggggggtacagacattgggtaaatgcagccattccaaatgggagaaattggccaaaacaaaggggctacaggccctgtgcagtccgaaacccagtggggcaatcctaaagtgccaaaattatctcttttgactccatgtctcacatccaggtcatgctgatgcaaaaaatggattcccatggtcttaggtagctttgcccctgtagctttgcagggcacagcctccctctcacctgctttcatgggccggcgttgagtgtctgtggcttttccaggcacatggtacaagctgttggtggagctaccattttggggtctggagtatggtagccctcttcttccagctgcactaggtggtgccccagtggggactctgtatgggggctccaacctcacatttcccttcctcactgccctagcagaggttctccatgagagcaccatccctgcagcaaacttttgcctggacatccaggcatttccatacatcctctgaaatctaggtggaggttctcaaacctcaagtcttgacttctgtgcacctgcaggctcaacaccacatggaggctgccaaggcttggggcttgcaccctctaaagccacagcccaaggtgtaccttggccccttttagtcacagctggagtgactgggatacagggcaccaagcccctagactgcacatagcacagggacccagggcccagtccacagaatcatttatttctcttaggccttcaggcctgtgatgggaagggctactgtgaaggcctctgacaggccctggagacattttctccattgtcttggagattaacatttggcttctcattacttatgcaaatttctgcagctggcttgaatttctcctcagaaaatgagatttaatttctattgcattgttaggctgcaaattttccaaacttttatcctctgctaatcttataaaactgaatgcttttaacagcactcaagtcacctcttgaatgcttcgttgcttagaaatttcttccacaagatagcctaaatcatctctctcaagttcaaagctccagaaatctctaaggcaggggcaaaatgccaccagtctctttgctaaaacataaagagaatcacctttgttccagttcccaaaaagttcctcatctctatctgagactacctcagcctggatcttattgttcatatcactatcagcatttttgtcaaagccattcaacaagtctctaggaagttccaaacattcccacattttcctttcttcttctgagccctccaaactgttccaacctctgcctgttacccaattccaaagttgcttccatacttttgggtatcttttcagcagtgtcgcactcccagcacaaatttactctagtcatctgttttcatgttgctgataaagacatacccgagactggacaattcataaaataaagaggtttattggacttaacagttccacgtggctggggaggcctcacaatcatggtggaaggtgaaaggcaaggaggggcaattcatgtcttacatgaatggtggcaggcaaagagagaacttgtgcggggaaactcccatttttaaaaccatcagatctcatgagactcattcactatcacgagaaaagcgcgggaaagacccaccaccataattcaatcacctccaaccgggttcctcccacgacacctcggaattgtgggagttacaactcaagataagatttgagtggggacacagacaaaccatatcccctggtctgatttttctcaatgcgttgcacatacaatcgccatttttttcattttcataagaatctttgttatctatgacacttattttaagaaggtgtttcttagaacagtacttctgacagatggctcatgagaactgaaatatatttataaaaaatcatgatgtattgtggattattctccttttttgccaatacctaaggtgtgttaagtattaaagtctctgagcagtccttgagaaacaaaacataatttgctttaacccagtatttccaaacatgttactgaaacacattctttattaatctcagacaactagttgtttggatcccattttgagaaaccttctccaaaatattgcagtcgttagtatcacaagaaatgccattgcccttctctcatcgtcacagacacaattattatactctccctttgatctgtgctgctgtatcactttaccactttattgtgcttgccttactctgttttgtactcatatttctttttcacatgtgactccctatatggttgtgagttcatttaaaatagtaatctgttttcttctttctgttatcctacattttctaatagagtatacggtggggaggtcggagattattttctgtatttcatccctcttttggttggagtgtgaatgtgtaagttttaaaaaataaagcatgttaagacttaatcaaatgagagttgcctttcaaatggtctaagatgttgtttgtctacataattcttcctttgattataagttttatgcaactttattggaatcttcatctagtttcagaggctagaattcccttaattagtttaaacagaaaaatattttctaagtattaaatcactgggtagggttgatgaaacagattccagattgagctgtcaagaacaagtcccaaaatcatatcactgagttaagtaagctacccaagggaggtaatgccttttctgtgatgaaaagccatcggcttgagaaccagttcatagagccaagatcaggatccattcactgtcaggaatcatgtatgctccaaaaaccacaaggatcaggaaaatacgtctactattgctagattcagaactgtattagacttaattcaatcagccatgtctagcccctactggcctccaaaaacgatgatggaacactggaaacctagctaatgctgcagaaaaaaatagaaaaagtattttcttcatggccaggttttcaaatagaaatgaaaacactgcctctgcctcactttagttttccaaatcatctttaattgtatctgattggttgaatttatcatctaaaaccttggcaccagtgagtttaggaaatgtatccttctttctagcctttactatgctgaaaggcacacagaaggaaagtgaaatggatattggagccagaccaaagtttatcagactaactacatatctcaatcttttattcatatgtaatgttctttttcatttacataccttcttacctttctgtgtccctctctacttgatttcctgtgccctactctctttcttcctgcagtttatggcgtttgagtcaatagtgagacttttaccttcccaccttaatgaattgtatacaataagggaggagcagtggcacattcatgaaaacatatgctctgtgttaatattctaatttattcataacgagcatatctaatttattcttctcaatatttccatattgtagatattatcccattttagtaatgacaaaactgagtcactatgaataattacatatcatagctcatgcatcctataaatttgcgaccccatgttctcttcatattactatgtagtcaaagattgcctgcaatttgaaacacactgaactccattttcccacattttgcctggaaaatgaaggttgagaatttatagcacactgtgcaaaaacccatgttactgtttgtcatgggacctgttgtatggtgaatagcacagttttacttatgcatacacatcaattcttacctcactgaaaggtgatgctatagtctctgaacctcagcatctacttcagcttccaattgctttagtctctgaggcttcatattgctggatattttacatgctctgtcaagtcattctagaaaaatcacctactcattagttcagcacaatggaaatttgtattatctgccataggatttcttcatatttttcacttgtattgtctttacttgttaaatatccattagatatgataaaaatctaattaaatggaaagcctgctaatgcagtctatgatattatgaatccattcctgggttcatagtatactaaacatcaatacaatggatataaaactgtggctatttagctacactttaattccctctgaaatgccactctggcatcagttgaaagaaaaatggaagaaatgtgttttgaagctttacattcattttaacagattaggttctagttccctaaaataccaagatttggaaatcatttaactcagttatgtcttttcacttcattgtattttacttacagattctgtgctcataatagagtaactgtaccagaaaagaagcaacaatgataaacagctctataaacaaacataaacttttagtgagatttacacatttgaagatacttctttgctaattaaatgtaaaatatactatgaaagtctttctaccttcttttaaagtccaagatttatatctaatttaatatatcacaaatattaaaatgtataatgttatcaaatattatataaaaaatagttaataccataaatttaactattcccatacagtttaatgaaaaaggtaaaataccttaataatttaatttttgttttatctatctattttaaagaggccacagtcacactatatcccttagcaatcatttgggaataaaagaaaaacaataaaatgtaaagtataatttagagctttttagtaattttgagacatatataatccacaaatgctgctaaagaaattatcctgtcatatttgcacatttagttgtacaagcatgcattaaaaatatatatatttaaaagcccttctacattccatatgcttttaagtgcaaaagacaaatagattgaccaagaaaactacgtttcattacctttttgaatttatacacaagtgatggggagatataataaaagttataaatataactaaataattttagttgcatagtgctataaagaggaaaaacaagacccatgaaaacatgtaagtgatctggatccagcccagccaaggcagaaggtggaagtaagagtataagacctcactttaagctcagagtgaaggataagcaggagttagacaggaaaagtagggacaggggtgaggcatgggataggccatggagggagagcattccaaggaaacaaaaaatctgatgctccacaaaatgtcaacaacccacggccatgggagaagagactggtagttctaaattatatgaaaccttgtaagatatactgaaacttttgaagaaatgcatcagtgtagcttttcttattctatgattgggcatgcattatttgtagagaactggggtatcattgatacagaatgctactgaggtactttacttataatgtttattgagaatgaaattatcccatacatttagattaaacaggaatgaaggaatgaatcaagatattctaatttcttccagaatttttctttcctttttttttttttttttttttttgagacagtgtctcactctgtcacccaggctgaagtgcagtgcagtggtgcagtggtgcaatcatggctcactattttctccacctcccagtctcaagtgatcctcctgcctcagcctcctaaatagctgggactacaggctcacaccaccatgcaaggctaatttgtgtattttttgtagaaatggggttttgtcatgttgcccaggctggtctcaaacctctgggctcaagcaatcctctcaccatggcctcccaccacatgtgatctcttccaaaatttttctaaatactttagtttgatttgatctattcttattttgttatttgaagttaccaagtaactcatttttctaatctgtccattatttagaggtaagtgataactgatttatgttcatcagagtttgtgtggagactgggcttgggaagatccattttgcctgtaagactataaaggattctctttctaaatccctccaagatctttacaatcccactccatttcacattttagtaaaccctgagttatcattagagttagtgttaccttcattttcttcttccaattactcagaatgcataggattcctagggtagcagttcttaaaatttaatgggaagtttgattcagtaccctgggatagagtttgagaaatctgtgttattaaaattacctttcgctcactgttttgcaagacattcgcagatctgcatgttgactgttgactactgtttccttgaaagtaaaacagctgacaaaaacaaaattatcgatgacagaaaaaccatcaagtgcaagtaacttgagtctcagatcagtcatctctaaataagacagtaaattttatgtatcaaccttccaagaggaagtctatgcctagagcagacttgctgatatagcaaactaaaaatgcaaatttcagagtatgctaaaaatttctatttttgttcctgttaatttttcaaaggaattcaagccttttctgtatacatacgggctcaggatactgccatgcaagtcttatttttgcatcccaacattagctggcatacagcttgcagaaaaatacctagactacctggcaagagtctaattttcactttcttgtaacttgcatctttgttactgttaaagtattgaaccagcaaataggtttagtttaattgtcagagtaattattggccttaacacatggcctcctctatcataactgtcatccttcacactgttcatttcttatgtcaaggcccagaaaatgattaatgctcacaacaaaaatgagattcattttttaaagttactaatgtcattgcacatacagttaatgcatacactatgtttaagaaatgagtaattctgcaggtagattgtcatacggaagataattttaaaaaattgacctctgacacactataggaaggccatatgattctgtaaaaattaacagatatgttttgataatctcagattaaaacttttattccttttattttgcctgagggaaaaataactggtatatgtatgagtgtgtgttaatctttcatcgctataaacttttgaaatatgttcagtgccatgtttgatataaatatactttgtaaaataaataacttttgtgaaatattgggtgcttttacaagataccagtatactgatacaggaaaattagtcacagtatgacacactccagggcaaatcttgggtcccatagatatatagtatatagtgagtcgtatttgctcactgctactcaaagaatcttcagtaattattttcctttgacacaaaaataaaataattagaatgggatatatacccagacacacatgacatccacacatacagctacccacacagaagggtcggtgtgagtgtgctccttgtgtagggggagggtatgtgtgtgagggtgtgtgtgctagaagaggattacattattgagttgcataataaaactgttacggtcaattagattattttttgactgttcgtttttaacttttataattaaagatctaccaagaaagtaaatgtgctggaaggaaacattagcatcttgtgttgaaatgttgcctcattcctctgtaaagattgttctctctacttctataggaatacaataaaatgaaggtctgctattttcattttaaagaagatagttaatatattaactaaaagaagttaatatattaagtgaatattgagtggaactcactctagagtatattaatgaaggtagtatatcagtatgcccctgataagaactaaagaaatgctttttctgatccctggagaatttaattatgaaagagagccagggaaaaaaatgatgtgaagtgatctgaaatatgtgaaataattttatcacataattaagaaaatgattgcaatgcatgaaagtttggctcaaacaataacttaaaaaattgaataaatttctcagtgtggaagtaagtcctccgctcatggaagtgcttatgtaaagactagataattcttcatccgagatactagagaagagattcccactttgcctgggagactggtaaaaattaccttgaaatctttttcagttttagagctctgtggttctaagcatgtataagtaggtttctcagtattgtgctgaattaatttctttaacttacctgtgtaaacagaaattttttaaaaatactatatactatgtaatttttctccccttttatgaccttgctgttatagttcagatagtcattatgttttgctttgtgtggtaataacagccccataccagtcaccgtgcctccacgtttttctcatccagtccaaatccacttaaaaattgtatttctccatatgttgctaagggaaataagaaatccttagcaaagtactcaaggatctgatactactacttttctttttagcctcacctcttgatgcatcgcttcttaaacgagatgatctggactgaattgtgttctccccaaaatttatattttgaagtgctaacctcaacgtgactatatttagagatagggccattaaagaagtaatgaaggttaaataaggtcatcgagccatgccctaattcattatgaccaatgtccttataagaagaggaagagatactaggaatgcatgtgcacagaaaaaaaaaaaaaaaagccatgtgaggacacagtgaaagtggccatctgcaagctgaggggaaaggccttgggagaaaccaaccctgccaacaccttgactttggactttcagattccagaactatatgagaaaatacatttctattgtttgagtcacccagtctgtggtattgggtattttgttatggcagccctaggggactaatacagggagtcctacgtttaacccccatgcaaatgtgtagagtaactaatcagtttccttaatggaagagataactaggcatttagggtgccactaggatcacaggtatagaagcccaggatgctgctgaacatcctacaaagcagaggactgccctacatgcttatttcatccacagtacctgcccctcttctcaacatgctcatcccactgaccttatgttcccatctcaatgagaactttttcaacacctcaaagagaaatacttgatcctcatttataccttctccattgtttttttttaaatcgacaattgctctttatgtaatgaattttgaatgatgtttgccttttaatttcttctactggcctgtaaactttttgaaagttttcatgaaatgttaaaccttacatccctcgtattcttcagagcaatttgtatgattttgcctagtatattcctaatgctcctgatctcaattttattttgccccattgataaaaatagagacaactagtaccctctcgtgtacattctgactgataggttcagggacctagaaatgcatatttttgacaacggttttacgacattgtgacaagctggtgggtttaagaagaattttattcaatcttaatatactaaacggtatatatctttggcatgtgtaacagattacttatataagtaaatgtagcatttcacaaattggcaataataattttatggcattatggaactttagagctataacatttcagctaacaggtatgaacattgagcgcagagttaaagtcttacagaactaagaattatggtcagaaaatatttacaggccatttcccatctagtgcttattagtggtatttatgtgaagttatcttcagtatatcatggaaatttaatgctggttcatgccttaaagataatctattataactctttattatataaaagagcttaatcctcagagaattttggtgaattgacaggttaccaagatcctaagaatgacaccctatcacccttatacttggctcctatttattcctaaaaaatcatttcagttcattcactggaaattttcattctatcatatgtatgaaatgtaaggcaatatcaaaaattaaaattatcacctaccctaaatatgcaattgttagagatgcttgagaagaactatagtagcatttctattgaagcaaacaagaattttttactataatttttaagtagtaagtaaatgtgtgtgtgtgtgtgtgtgtgtatgtgtgtgtgtattttaatctgtgtccttaacggaataaagtcaatgttggggattaggttacttttggatgcccctatcacacaatgcaaaccaagtttctggcagaatatattgctttcattactgttcattttcataaaatctttatgtaaataatattttgaatgaaaattgatgaatcttagattttctcattactttctttctaaactaggaagcattcagatgttaataacagcaatttaactaaaagagcttaaagacagatgagtttattctctcgcacaccaaataaagctagaagtgagcattcctaaatttacaaaagcatcaggaagcaggtttctcatattctgctctgatgtccttagttatggcttccatcctaaagatccaagatgaacctgcatgtccaactatggcatccttgttttgaacagaaaataaggaatgggagaagggcaaaaagaacatgtgcaagatatctccccttttataatgagttttccaataagcgccactaataacatatagttatatttcattagcaactaccatcatctggaataaagtcagggctttgttactatgaagaaaatacacattggattgttagccaacagttttctcaatgtatgctttgttattatttttgcttctctttagatgttttcacctttgtttaggggaatatgttcataaagtctagtttggaataattaagatgttttaatctttggtaactacagcatgtgatactaaaaacatttggcatttgcctcaagaaagttaatagagagaaatgaaaaaatatcaacttaattactgagaaaacaaaactaatagagaaggtgatacatagcagcatctttgtgcacaaatcacaacacataatgcataaacttctgttttcctacaggtaaaatcttagacacgcaatttagaaactaataatagagcaaatagtggataaagtcatcagtgtatgacttgtcctattggtcagattactttatttctggagttaacattaatcattatttttgttgttgttgagttgttttgtttttagcaacttaattcagactgttttaaataagaatgtattttagtaattaattcaacatcctgaaatattactttcaaatggacagtgaataattttgtcacatttaaagccagctaaagaaatcttaagattcattctcaaattatttgttttctcaaagttatcttgtctgatgtttagaagttttaacagtcttcatttttattacataacttttggtactataatgagtataatttaaatattttaaatcatttaaacaataaggaagggggatgaaagaggaagtgtttctaatgaggcaaggatccttttatgccttttgtagcacttagtccttaaggtttcaatccttatgaagaaagggtgaatatggacttccttcagataagtaaccctggcaaggtttctgtccatcctctggcctggtaagccctctcttcaaggtaatgagtattctgtgtgtatttctcttcctgcagttagactgttcatgcatgataataaaaagctaaagggattaaaacttgcttatatgccttctgatcttacattataatgtgtccacccatcaaactatttcattaaacattattattttcctaggacattggcaaatgactagtataattacttgtcagggtttttgatcgttttcttttgttttatttttgcttaaacaacaggtacaaaaaattttgccatgggtaatcccagcactttgggaggccaaggcaggtggactgtgaggtcaggagtttgagaccagcttaaccaaaatggtgaaactcggtctctactaaaaatacaaaaattagccgggcatggtggcacgtgccttttagtcccagctacttgggaggctgaggcagaagaatcgcttgaacctgggaggcagaggtttcagtgagctgagatcacaccactgcactccagcctgggtgacagagcaagactccctctcaaaaaaacaaaaacaaaaacataacaaaacaacaacaaaaaaacaaacattgccatggctattaagcaaaacttacctaggctttaattactatgtaatttttactttttcaaatgtgtggatacaaatcattaattgaagttttcaaacttacctatttggaatcagtaactaagataagtttatacacttatttcccatgcaatataaacttaattattttacatttcaaagagattgaaatcttcaaagtgataaaatacgcattaatcttttcaacacattattattaaaatgatagagatggttggaaattccgtgttatgattttttaaatgccaaattagttttctaccttcataattttttgcagtatataagctaactatgtatatatgttatactatttattactgggattttgtttttcaaacttctacttttatcagtaatagaaaggagctattgagggattctaatattctatatattgatcatagtgctgtttacctatatttttacgcgttacaatttcacatatgctacaaggtcattaatcaaaattaatggagctgtacattcgagatatgtacattttacagtatgtgtgttatagctcaataaaattttaaaatatgtattggacatcaatttacagtttattataaaacaaatgatacactgtattgatattgtctgcttatttttctttttatgaatagggactttattgtttttactttcggtatccttaatgcttagtacagtatctggattttaatggaggcttcataagagttttctgactgaaataatgaaaagtacattgaaacagaaaagtcaagtttttcaataccatcaatttacaaatgtatatacgaaaatgcatcatatttagatatggctgttgtcctcaaagggctgacagtaatactgttatttatataaaacaatttttccttatcagtaaaatttcttcaggaatttggggtttattggtactttgagagctctcctaatttgtgctaaaattgtatcattaatataatacttttgctaatgcttatttattatcttagcgttttcagacttttattattgtcaccataattttaaacctacaaaggctttactttgaaggtccattttacaaaatcaagatgattgaaaacacttacctatccatgtgtttctttatattatatacatatgttttcacttaagctgcctgtaaaattcttatctgagaattaaaaataggcttaaccaagtcctttattcatgctatgtatgttagcattaggggaaaccctaaaaattttactcaaagactatactgttcaatcataatttggaagactttaattactaggctttcaaacctgtgattagagagcatgatcctgaggtagatatggaaatgtattaccagtgatgaaaagacatgattgcaaactagagagaagagtgtgcgtaatacatgatgagtgggaaaagataaagatgagaaagttggtgtcctggagggtcgaaggtgagattgctcagggctagggaagtggtttggaggagatttaggtcttcatcttccaacagaagttggattagtactaaaagaggtgacagagggtgaggctacttaaggaaattttatagggaaacttaacaggagaacagaaaatgatacctgttttccaaccttgttagagataaaataactttttctaaggtactttgaaagcaagtttatataaatatttacttttattactcttagtattatcaatgtgttggtaaaatgtccaattgagttaatacattattattaaaattattcatatatcatgattttatgtataaatagcttgagatatgttatgcttataaaattatattcatagctaattctgatcacttaactgaactttcaaatagttctgaagcaagggctatgaagacacaatttggaatagctatgttgtgggttttcaaatgcttcttttatagaattagggttggcttagaaagtattgttttcacccgcaaaaatggcagttttacatgattcagtattacagttagaagtgtagatttgtcaaagtattccaaaatgctagcaaataaaatcagagaatgttgtattgtttccttactagatattgccttttaaaactctgaacataatgacgtaatagaggtcattaaaatccaattagtaaaagtgtctgaattttttatgtgaattaattcaaatattaagaatatcaaatcattgttttctttagatgttttgctctcattttaagtattcacttacttaattttatgtcattagctctaaaacaaatacacaaaaggccagagttggtggcttatacctctaattccagagttttggaggcccaggcaggaggattgcctgaggccaggagttcaggaccagcctaggcaacaaagtgacacccagtctttacaaaaaacaaacaaaaaattagccgagtgccgtactgtgcccttgtagtcctagctactatggaggctgagaagggagggttgctttagcccaggaattttgaggttacagtgagttatgatcatgctactgcactctagcctgggtgacagagtgaaacactctctctaattaaaaaaaaagtctataacttcaactttgcttcctcctattttaaaacttcttaagacgttttggtaattgggaaaaatttttatttttgcttgccactaaatcaatgtttttcctttcatatgttcttaatattaacaaacttatctgaattttacccttgggaatgatttttatctggtgtgcttttgtttttatgatgatatcaaatttatacattaatatcacctataaacaagctgattttaattatgtagatttggataagagcatgtttcaaagatactgctctttttatcatctttacttctatatcatgtaaatatatagtctcaaaaaatttaaaacatatttccaacctcatatgaaatttcaacgtggcaaaacattttttaatgcatgtccatttttattattttaacaaagactggagcttttgaaacattcccttaacaaaaacttcactgagaatgattgttaaaattatgtcaatgactacctgttcatccacataattttataaattatacaatttgtgaaagttataatttaatatattttatctaatatgcattgtatttcatccagtcaggcaagtgaaattcatgagtatatacttttactcttaaagattctggtaaaattaaatattatataaaattctgaggttaaaaattaaatttttgaagtgatatctgtatcatatttatcagaaaatatgaaatgataaaatgtgaaatgtttgaaatataagaaagtcaatactttagtgtttgctgacagtcttatagtacttagaaaataagtttttatatatttgggcatttttaggttatgtctatatttcttttcaagctatcattgatccaaatacagtgaaaaatagcaaaccaggtgccaaatatgatccatgtgaaagtaattttctcatggagaagtatttttctgtcttcaagcgtggcagtaaagattttgatccagtggtctgagctgtgtcatcttttctttaggtagtttaaagtcatttgctttgttatgggtatgaattatgtggtattaagtactgcagtagcactattaaacattatatcataaatccttttagaatgtggaaaagttagtgtctgaaaggccatttaaaattttccactttaattccaagctaggggcagttttgtgttccttttttttttttttttttaacaactgacataatccactaaaaatgataagtctcttagtaccactcatgcatttccagacaaaatccaaacattatatagattgttttaaaatacagattgagattgttttaaatttgtagacaaacggatgaagctatttctataaaactgaagtagcaatattaattaccatcaacagccacaatattaaaatattctgcaattccttgaatctataagtggcagaaatacttcattatgaagtagtttgtttacattaattcttcagctctctagcttttaattttttaaataaatatatattaaatattgttttctttcattaaaactgcaacttagttttttccaagatacgtttttgagaaatgaggagaaaaaaaatataagaaattaacttttttaagttctaagtcagtattctaaccaaaaatacaattttctactttgagtgctatctttaaaaacaggctatatttaaaggcaaccctggaagaattaatcttgattgttcctgtatttctttgattagttaaagaaactaagtcacaaaagagatattcctagtgttttgtcattttcagtatgtgtgtagttaagctttttaaattcctattttacttttgatataatcctcttagtgaattttttctgggaaaacatgctgtcaaacacacaaagtaaaagaaagacaagaaacagtagttaacaaagatttttgaatacttttgtgtattttagctttaaaaaaaactttttttaaaactataaattgtaaattgacatttcaatacctgatcatggaagcgtttcttgttttgaaaatgacagggttggaacatatgatttaagtttaacattagagatgtcagagctagcaatgcattaacacaatttctaagatctttagctaaacaaaggcacaagtgttcatggaaatgagttaggtacctctagaatctaaaaagttaaaaagaaaacaactgtatgtatgtcacatgaatctgttgtcctgaactttattcctgtgtcttgaattcatgcttttcttttaaccttgcctaaaacttcttgtattttatctaagtatctgttggcttcctgtctctaacatgccttccctctgtaatccagttattaaggaaatgttggacatggaccctagtttaaatataaataaaaataaattttacagttcctttttggggtttgataactttagtcaagaagaatttactgaccaatatttatcgtgatatctgctttgaaaatgagagagtttgaataatatttcattctaatagttttacatgtttattttacatcactatcttaaggcttttttaaactctatattttaactctatattctttttagcccctagatatgtgctgtcaccattacaaggactcagggacacataaatgattgggaagaaagaaagaaagaatattcaattcaaacactgaggacccttcccccttgcaaatgggcaagatgcaatgataatagggcatcaaaatataaatgtgaatataaaggtagattttagggtgctggcaatgttaaaatacattatttaggggttttaattggcaaaacaaaaagaaaagctgtcatttgatgatgctgtattcattattacttactctgaagaggcagaatattctcatgtatttttagacttaaaacagaccacagttgaacaatcctggtgaggggagagggaggaagttcccatctttcataccaaatttaaccgaaagctcaattaaatagattttaatcagacagctaattaaaagattacaaatgcagacctttgaaaataaggacagaagtgtcattgaaatgaatagcaacatgtgacaagatgaaatacctacagaagagttggtgcttctgagcagcacctttcctaaaagtcaatatatgtttgggtgatttctggtgttttgcttttacaaacacaactgctattatcaatactgcatctgaataacggtttctctagagaacataccaaatagtgtagtccatttatttatttagaatacatgtgttgagcccttactctgtggatagtgttctaagttactttgataaacataaaagacaaagatcccagacacatcaagtatatattctaactgatagaatcagatgacccaaaacaaacataaaaaggtgtaattacattttacaagactataaatgttatgggattttaaaataatagtgagcaggtgtaaggagtcctaggggttccaggaatgaaaaagaggtgaggaattttaaatgaggaggctcgtgtaggcttcatggagatggttacattttagaaaaaagaggaggtagggaattatccatataaatatttgaaggaagacaagttcaggaggggacagctggtgaaaagccctaaggcaggagcatgactggtgtgtgaaaacagcaaagactgcagcagagtgatatgatgtggaggtaaccttaaatgatggcatcacttaaggttttatagttaactgtaagtgttttagatttttctctgagtgaaatgggaagccattacaggatgttgcccagagaggtacataattattacattctagaagagtccttctggctatttcatagaacaaatgaagaaagcaaagttaaaagttaagaaaatgattgagaggtgttaccattatcctgataagagatggtgctgcctcctacggtgatagaagaccgatgacatgtggttggattctgactatcttttgaagtgagtgtcatcaggattgtctgaccgcttgatatgcagtgtgttagagagaagagtgaaggataacctcgtggcttttaggctgtataaatggaacatacatggggagggttgcaaggatatgtttccaaagcaatgtaagagttaaatatatataattaaacattccaagagggtgatctaggcctaatataattgtggatatatagatggaatttcaaaccatgagcttggataagattatcaagagtgtgaacattgatggagaagaggggagaggcgaggacatttctctggggtattctagcattaagtctggggaaataggaagatgtagcaaaggaggctgaaaagaagtaaccaatgagttactgggaaaactaaacctctcagactaaaggttgagagtcaacaatcagaatcagaaatgaggaaattattgttgaccttagcaagagcaggtgttatagagtaatgaagacaaagtcccaactgaagtggttttgatagagaattgaaagaaatgggaaaggggaatatagctaactcttctttcaaggagctttgctgctaaagaaagtaaggagtgaaatggttgaattataagatgcacatgtgttcatccttaaaagagaacatgcaagaattttttattcaaatgtttttcagtggttcacattctttttagaaatatgaaagcattctcatggatccacatcctcatcaatacttagtattatttatcttctaaattctaatcttgggtgtaacaattatataaaattatgatcttaatttttattttcctgactacaaatcagattgaacactttttcatatgtttattggacattattatctatcttaagatattgattttaaatatgtatatctatcttgaaatatctattttgaaatgtagcaggttttttctcttgagatgtatttttatctgatatttttagtattttttgtatgttttataataaactttttgacaattatatgttgcaagtaactttccaggttattggattctctttgatttattcttggatgaggaacagaattcttcttcctataacacattctttgaccattcttaatttaaagcatattttaataaatagtcacagtttttcttttaatttaaaaatatttgtattatttacttaaaagataattttgtcagatatacaattctggatttgtggttattttctattagcatttagaagatattatttcagtgtctttcagtttctgttgcttgagaaaccttgagaaacctagttttagactaattgtatgtcttttgtaagtgatctgtctgtcacaccctttccctcacacttgctcttcaaatctacactttatctttgctgttttgtagctgcactataatgtggctgagaattgttgatttttattcatgttgatttacatacataaggctttgatatcactgttttcaggactccattagttgtgggaattgctaagtgattatctagtcaaatataacctgacttttattctttccctttgggatttcagttggacacacgttagattatcttactctgtttgccatgtcttttatcctctctcacaaatttcattgacttgcctgtctcttatgcctttgaccaatcttccaattaactctctcctctttcggatctattgtactgtttacagtacaatatccattaacatttctgtgtttgttatttctaaaatgtgtatttgacttttagtatgttatctgttatttataatttcttgctatatatctttgatactttaaaatttcaatctatttaaacgtatttattttattttctgctatggataagtacaatatttgatgtccttacagttttaaatatttagttgttggtatttctctgctggttatcacacacgtccactgatttctttatatattttcagttttatactgtgtgctcatatttgttagaagtcaatatgagggaatgccaacagtctaattaggaattgttttgttcaaagatatgtgtttccttctgctggaagccagggaaagctgccagtctgagacaattacagagttcctgttcagtgcaaaagactcagatgggactcctcaatttctggtgggacccaggcataatctccagattttctatgttatttttagcatctgcactagagtaacctagctttagtacttgcttaatgtatgtatatatgtatgtgcgtatgcgtgtatacatatataagtatatatagttatacatataagtatatacacatctaaatatgtatgtgtacatagatacttatttatacaaatatatgtatatatttttttacaaacctatctgtctacttagatttggattccatcacctctaaatataagctctgtaaccttaggtcattttttaaaactttttcctaacctttctttcttttacaaatctcatatttctcaataaatggcaactaacattgttaatatacttatgttccttcaacattagaaaaaaatgtgtctttatttattatcatattttttggacaaggtcttattctgttgcccagtctggaaagcagtggtggattcacagctcactgcaggctgaatttcctgggttcaagtgattctctcacctcacctgtccaagtagttgggactacagacatgcaccaccacgcccagctaattttgtttattttttgtagagatagcagtctcactatattgcccaggctggtctcaaactcctagattcaagcgattctcccaactcagcctctcaaaatgttgggataacatgcatgagctactgtgcccagctttttaagaaaaaaaaaaaaaaaaagtgtttttaaaataacctttctcctcctaaatcctatgtggccagtaaatgtatctttcataaatattttaagttgggaatttgtcactttttgttgtgttttgttttcttcttggaagcattagagtgaaggggcaagcaccggggcacaggagccagactgctgagttttaatcccatttccactacgtaagccttatgttaccttcggcaagtttattttaatctctatgcttttgtttatttgtacaacagaagaaataatagtttctcctttatgtgcttcttgtgagaatgaatatttgttactatattgaaattgcttagtttaatgctgattctcggtaaatatttactatgattatcagaacaaaaaaaaattatatcccaaattgccagaaattgttccagcttactaatgaaataccaaaaatgagaaagagaatgacttttttttccttcttaattagtggtaagtttatggactgtggagtctgtctcaagaggtttagattcagccttattacttcccgccagtatcacattaacaaacaactcaagttgtcaaatcctcagatttcctacctacagaataaggaaagtaggaataccttcctcttagggctgatgtgataacttaaaaaaatcactaatgtaaaacatctgagtacacaatctgcacataaaaataaatgtcagatataatttttatgattagttttacttaagaattgtcatctaaatttcacatgctatcaaattatatgctttaaataaagaattatacagtgctaacttccatgtgtgctttcctaacctgttaggaagctgtagaaaacagaataatcagtttcaaaaaagcatgacagtaatatgaatgaaaatataataaggaaagttaatattaaactagtgctatggtgtctgttgtttcatgattataatgaaattgctaaaccatcactgaattgtgtgaggagtttccaggtgagatatgcaatcaataccctgagacagcagtaaccctttctttaggcagaactttataagcagtgttagttccatgattttacccaaacaagacatcacaatacaaactcgaattggaagaactctccttggccagatatctaaatttaacaggaatttaagaggttctttagtgtagggcctcatgcagcatgtgttgaaaatagtgctgaaaacaagaaatatgtaatatatggatatacttaaataaactccaggctgtcttgtttccataacattggttattttctgccaatagttttgtcctcagtgagccgtggccatgacatggaatctgtccaagacacttggtgaccaagagcctctttctagtaggagtctgagctgaaaatagcttcctgaattttttcagcatcatgcatttactgtgcagctttaagctcttccctgaacacattattgtttaattacttactgtccaatattatattatgccagttatgtaaggactccagtggacctcaagcatggtaataaaatcactcataaggtcacgtgaagttcagagttgttagggaggtacgttgcagttagcttttgcctcttcccacagtaatgttcattaatacctcgtgtgagacactgttttccttgtgtagttcagaatgctactttacttcctgacccctggaaaccaggaaatgattttattagcaggcaagagaacacacacacacacacacacacacacacacacacacacacacacacactgtcactctctctctccctttctctcttagcttttgtcccccaaagttgaataacataatttttgggaagaggaagaatccttggcactgaattgtagacccatatggttcttggagatatggtctaaaaatgtaattgtttgaaaactttagtgaaaacaaagtttgtgatactatagatttatagagcatagagaaatagaaattttccacatatttgctatgtctcccacttctgcataatgaggttgaaaaaagttactatattttaatttttttgagtgggagtactaaactaattgagtattcataatgccagtctacgatctgtaaagttaaaaaatatttttgaaatatttaattccaggaccagcgactcataatatccattttttttttttttttgtcattttgcactttcttaaagcttctggacataaataacttgttggtaaatctagtatcttggctttccctttgtcctcctacattaccttcttagatattccagaatcataacattttgcgtaaagagagtaattaagattttttatattttaaagaaaagaaatttgtttctgtgttcatttatgcaccagttccatataccaggtcagtggcagagctgagcagtaagacagttttctccgttttgaatcttggacgttttctgcctttgtatcctgtactacactgcttgtcactttcacatcctatggttgtgtcttgtttgattattttgcctagaatgttcatttttttgcctaatttttatgccaaaggaagtctcccttccttaaatattccaatggatttgctcaactggttaatatactcaatagcaaaaataggtacttcagtaacagttgaagtgtttgggactttctgagggtggagggtcggaacagggagaagatcaggaaaaataactaatgggtactaggcttaacacctgggagatgaaataatttgtaccacaaacccccatgacacaagtttacctatgtaacaaatctgcacttttacccctgaacataaaataaaaattaaaaaaaaaaagaaaatagttgaagtaggaatgaatgtctgtagggccaatcaggcttacttactttgaatatgttatgcatttaatttattttagaattattaatgaaaataagccttctgttagtagaatatgtgttttgggagtatttgagctgaaagttggctctctactttctcttgggcatgctctaccactttctcagacctttcatacttttcaatagtgaaaatctgctacatgaaaggacagaacacaaacaaaacccattagctcaagtcttcattaaaatgttgcagacaaggtaagaacagctttaaattgagtgttcttgaagacagcaaagaatttaaagcttttataaggcagaatggagcaggtacattgacattcaattggttactgcacaaatttttagaaggtagggaattagtcacacattagagtgtaggggcagcaagactggaatgccgattagtggccattgtttggaaaattgggatttagcaagaggagtaaaaagtaacataagagacaacattattgcaaataagtgtaaatcttttctttattttatttttttgagtcagagttcttactatcagccaggctacaatccagtggcacatgtaagctcactgtagcctccaactcctgggctcaagtgatcctcccaaactggtgagattacaggcatgagccaccacaaaaactttactttaaaatgaaacataggcaactcatattgcaattggccactggccactctcttctgcctgcaaatttataacaccctatcaccctgccatatatatatgtgtgtatatacatatatacatgtatatagtttatacattatctcttagttattaaaagaaaaattgtatggcaaaataccaaaacaagattctcttccatgtgtgactagcttgcagattcacacagaagccatggtttctcacttaaaatcatttcataaattgatatgtttatcctcattgataaatagtgaaactaattgactccaaaaactgccgaatatttgcaattgaaacattttatcctcaaagtaaacagacgtttgtcctagaagtaacctggtgagtgaaaaaagaaaagtaaaaagaaggaatagagatatccaaattctgatattctaatacagttgactcttgaacaacataaggtctaggggcactgacaccttgtgcagttgaaaatccatgtataaattttgactacacaaaaacttaactatcaaccggctactgttgaccagaagccttactgataacacagagtcatttaataaataattgttttatatatatatatatatatatatatatatatacacacacacacacacacacatatcctgtatacttacaataaagtaacctggagaaaagagaacattattaagaaaatcataaggaagagaaaatatattcactattaattaagtggtagtgaatcattattaaagtcttcattctcatcatcttcacattgaaaaggcagaagaggggcaagatcaggaggactttgtctggctgttttagggtggcagagcagaacaggtggaggaggtggaaggggaggcaggagagtgatatgatttgtctgcaaccccattcaaatctcaactcgaattatatctcccagaattcccatgtgctgtaggagggacccagtgggaggtaaattaatcaggtgggctggtctttcctgtgctattctagtgatattgaatacgtctcaagagatctgatgggtttatcaggggtttctgcttttgcttcttcctcattttctgttgccaccaccatgtaagaagtgcctttcacctccagccatgattctgaggcctccccagccatgtgaaactgtaaatccaattaaacctccttttcttcccagtctcacgtatgtctttatcagtagcctgaaaatggactaatggagagaggcaggcacattcagtgtaactttacagaaatatatcataatttttgcctgacttgttttgctttttcacttctctaaaaatgtgtctataccataccaatccttcttacaccatgtgctttactttcagtgtcctattcctagaagtatccatgtcacaaaataagtcaaaaatagtcttgaataattggaaccttctgtcagattgtctattgttaatttgatttctggcactgcttcttctgcatctttttcctcattgtctggaacgggttcaaaagcactcatctccatcaagttgttttctgttaatttatctgatgtggtgtctattagctcttcaattcctccaagatccctatgttgaaacccttcacctccctccttttttatttatatatttttgccacatccacagtttctttcatgatttccttgattggttctgttgtaaatcctgtgaagttatgcacaacatctggacagtttctttagtaggaatttactgttttagactggatggaattatggatttttttataatgatatcatccttaatactgtaatcattcccgacttccatgatgttctctctattaggattctcttccatagcactgacaatattttccgtagaatactgcatgcaatgagtcttaaaggtctttatgacccttgatctagaggctgaactagagatactgtgtctgggggcaagtagaccacttcaacaccttaagtattgaaatcttggggttctgggtggcctgggacattgtccaatatcaaaagaactttataaggcagtcccttactagaaaggtacttcctgattcagggacaatcaatggaaccagtatagaaaaagaattgtcattgtcccagccttcttgtacaaccgaaagactgacagctcgtgttcatctttgccttcaaggcttggggattagtagctttataggtagggcaatcctgatcataaacccaactttatttgtacataacagtagagttagcctattactggagcttgcttctcttccttactaataaatgttctttttcagaatatatatatatttttcagagtagggcacttttgtctgcattaaaaatatgttcaggcagatatcttttcttcttactgattttcctaatggcatctgggaacttgtttgctgcctcttggttggcagatgctgcttctcctgatatcattctgtacatcaaacctttataaaattatcaaaccatcctttgctgggattaaattctagaactttagacttttccccttcctcgtcagataatgacttcacttgttctcaaatcatgttagagtctataggtaggctcttttctagcaattctgcacccatgtaaaagctatatttttcatacaagataaaaagatatttttcaaaaagtggaaggtattttgcacttgcttgcacagttacagggacagcttcattaattttcatttctttttttacattgatccttaatgatagattcatttatcttgatatggaagacaaccacagctccaggcctccgtttatagtggatatcaagtagttcaactttttcttgtaatatcttgacttttatctgcttcttgggaacacttctagcatcactagtggcacttcatatgggtccccttgttttatccaaggtttatggtattgcattcaacataataaacaacatgcaagaaccatgagggatcacttttactatcatgcatattttactagagagatgaactgttcatgtagaaacaatgatcatcacatggcattttaagcacatgctcataagacttgagctcattgcaatagcaatgggagttgcctatgaaattgtgatactagcacattatgcagtatagtgaagattatacattgtggtttaatactagatctttacatttgtttacatttctttggactgcaaatagcaccatgtgctaaatgtatgcacatgttttgcatatatttttaagttaacgtaaaagttttaactctttcaatagatttgcatacacttttaagttaaaaattttaactttttcaatatatttttgtatattttatgatagtgaatgatgaaaaaaagtatctttatattttatgcatttatgacatatctaactttttctttttttgctatttctatgctacatggttcatctgcaaatttttttcaaattgtcacaaatctacaaaatatttttcaatgtatttattgaaaaaactctgtgcacagactggacctatgcaattgaaacccatgttgttcaagggccaactatacccaaatgtacaaatgcaaaactacactaatcacctacacttacattctaaagtaacaatcaaatgtaatacagcaatttaggttgaaagtacaatacttgataaagtttttactgccttaaaaattgttattttaatggagcagtcagcctgcttccttgaatttacttttttaaggtcctgaatcaaacaaagataacatagtttgaaaattttttaaatgtttctttaaaaaagggggggttaagtatcattgtttttaatattttcattcagtaaaacttatttgaaatgctattttctatattttaagaagcggatatttcaacccacctattttgatttcagacacgttaacatgtatatgtgaaaataagtcatattttgtaagaccttgcctaatatctaataactgtattttaattttatgcagcattcagcaacaattgtacctgatgagctattaaaagtgtgtaaatcaaataagcttatatcaagaatactaaaaaaagtgacaaggcaaacatgtcaacatagctaaatatggctctaggattgaatgctgttggtgttagtcagtcaggatttccccttgtgatgtctttctggtattaccattattgaatgtttacaaattaaagggaccactgctaaaaatatgggattgagttgcatatgcatgccccttaagagacccttagagatgatttacaagaatgacagaatctaactttggacatttggttagttttcacacctccttccctcttaaaacttgcattcattaggagtaactctctgaagaatctctgtcttaataaattcagatccatcaactactttatgcagtgttgcagtactcactgtttatttgttaataagtacctgaaattactttcccactcaatagatacaggactgcaaagtagatgttctcctcttttgtactttttttataattagggtacagagttaccaagtcagcaaggaaggggcactttgtatgctacttgcatggctacgaattaactgaaatagcagttaaaatgttcattttaaaaattatgtaagtgtattgggttcctaaggctactataacaaatgcacactggatagcttaaaccaatggtccccagcctttttgacaccagggatacgattggtggaagacaatttttccatgggggctgggtagatggtttcagtgtgattcaagtgcattacatttattgtgcactttatttccattattattacatactcaccataatgtagaatcactgggagcccagagcttgttttcctgaaaccagacagtcccagatgggctgtgatgggagacagtgacagatcacccggcattagattctcagattctcataatgaaggcgcaacctagatccttctcatgcacagtttgcaataaggtcggtgctcctgtgataacctaatgctgctgctgatctgatgggaagtggagcccaggcgataatactggccactcacctcctgctgtggggccctgttcctaacaggccacagactaataccagtccatgaccctggggacccctggcttaaacaatagaaatttatttctcgctgttttagtggctggaagtccaagatcaagatgtcagcactttgggattcttctgaggcctttctttttggcttgcaggtagcctccttgtcactgtgtcctcacatcatcttttttcttcgtgtgcacatccctagcatctcttttttatacatttcctcttcttagaagaacaccaatcagattgttttggggcctaccctaacagctgtcatccatttaaacttaatcacctctttaaaggggttacaaatacaaatacaaaacagatacagcataaagtcacattctaaagtactggaggttagggcttccacatgtgcattttaggggttcacaatcctgcccataacagtaagtatcgttttctcaaggaaaattatttttgatagactaggtcaagttattctctactcagcataattataattaaacaattttaagcttagctttttaatgcctagggatgcttaaacaatcatattcactctgttcctatttcctttcatatgcttgctcatagtaaggactcagtaaatatttgttgaatgagtaaattacaattcctataattaatataattctcatttgcactacgtcagttctttttcatatgctatattatttgctcttcaaacaagactctgattaggtaatctcattacccctttttatatattaataaagaaaaataatcagcaatttatttaacgtgagtcagttaaggatatcagtggaatactatattttttctaaaacaggacttcacccttctgaagttagactaactgggaagatggcatagcaaaggaaatgtcagtaacaaagacaacaacaaaaatcacataaaacagattaacaaaagagaaaggaaggaaggaaagaaaaaaaagaaataaactcagcaaagcaactcgaagaggtagccttgggataagaaataaaaatattgaactaagaattagttaagaaggaatcaaggttgtagattgacacaacatgctaacataatagagtaagcaaataggaaataaaatagcacatatatcaatatggaaggcatatcaattgaaggagaggtaaccacagtcacatatacatggttcagaataacaaaataatgtgtttacattactgctgtttacagccagttggaactggcatcatattcacttttgatacttgtgggcattcagaaacaaagtgtaaagcataataggacgatcttcaacttcagtatggtacaggggagaaaaaaaattctagagagtcatgaagcccgatcatctgattctggtattttaggctgtcaggactcaagacattatgcctaggccactcttggacagatttagacccaaaaatgttttccatataataagatgacagttgaaagtcccaggctaaaatcttaaaacacagaacagtgatttcaatctgaatactggtcccactttttattaacccctgtcttgctcagttacttaagctctcttaagcctccgttttttcatccggaaacataatgataaacacggtgattacattaaaggattgttgagttagttgaaatatgcaatgcatatataatgtgtcacatagcacctggctcattgagtattgttgcaatgcaatgataaaaacattaagcacttttcttagaatacattattacatgaaatgtgtctttaagaaattcttttagttctctgagaagagcccctgagaaaggcagacaacacactacgggctcttccagctgttagaagttcctcccaaggaatcatctctttgccaatcatttatcttgtggataacttctgtgtagtgtgtcttgtcttaaaagtttaacatatgttcacaatattatgctaagtttatggcatattaatcatatggatgaaattttgttattttttatgcaagtaatttatttctacaaaaacctctgagcaaaaaccctttacgcttctctcttcaattcttaaaattccacccccattaaggtaaacattgtaaacactgcagagtgtaccttttcttgctttaatagttgcatataagtattcaaaacctgtattatagcatatagatttctttgttttatttaataatacatattattctgttcttcaaattgattacttcacttaagctacataacttggtcatctttacatgcgaatacttatttataaaatatttttgtaatataagcatatatataagcaaaagtaatataagcatatggtaaatttagtgtaataatacatataggctaacacaaacagtgcaatgcttaaatagatgccaagtacttttctggtgccttacatttattaactcataatactcataacaaacccaaaagttggactttttcttatccttattttatagataaagaaactgaggagaaaggaagttaaatcgctattcctctgtcacacaggtagtatgtagcatagccaagattcatacctgggcaatccatctctggtggccatgaccacacaggtatacaatgaaataccacattgttttttttaaaaaaaacttcataatatactatcggatgatttttaaattttattaattcttatgctgttaattatgccaatgttttcattataattttggttttacttgtctatcctaagttgtactttttaaaatacatatacaatattttttagagaagttttaggctcatagcaacattgactagaaggcacagagattttccataaagcccccgtccctacatacactcacagccttctccattatcaacatcatacacaagaatggtgcatttgttaaaattgatgtacttacattgacacattattatcacacaattccatagtttacattagggttcactcatggttttatacattctagtggctttcacaaaggtatataatgacatatatccaccattatagtgttatacgaaattgtttcactgccctaaaaattctctgtgctttgtgtatttatcactgcctccacccagccctttgctagttgtactttttgcattaaaatctactctatctagtatatatcataatcattgttgctgcaagagaatccaatgatgttgttttcacacagccattgaaccaattccagttattatacaagtaattctgtttctactgcgttacaaagctaaagtttgcttttcatacaataaggtgccagtatatatttggatctatttgtgggctccctattgtgtttcccagctctctattattttattcttctgagcatgtcatactgtttggttatagcagctttatagtaagttttcaaatcaagtaggaagatgcctccacgatatgttgctgattgtgttattaccaggcctcttcattccaatgggaggaggttagggatagagccttagaataagtctgaaccactaggaatggtatcactgctgcatttttctattttattaatatgtagaaccatatgtgaatcccaaagaaagttcatatgagaaaacccaagattgccctcacagatctaagagataggatagaactatttattgctggcttcctgttttgaagacaatatttgttgtctaggtaatatcaggatattttttggagactttgtttttctctctcgagggatgttcacaatcttttggtgctaatttcctcttaatatagtgctatttttttccatacaaaatttgaagtagaagaaaaaaaataaagaattggtagccattaaccaaagctggcattctatttccattttcacagtgagactaccattttaaggaattcaatatccctttgtgatcacaaaagtaaggtgtaattcaggagttttcctggagtccccattagatattatacaatgcatattttgtttcaatatcatggagttttaacacaaatgtaaatagaagtttaattatttatatagattcaatgttaaatataacaaagacgggaaagaaaatatattattttgatgtcatttttgttttaacttttcctaactgtggatactcttcctaataataggtagcccatatgtcattataaaaaaatgtatttctagaaattcaggtaccccatcaaccaatctttgtatctcctcatataataactttttctgtgtgtttatagaattttaagttcagtgaaaagattttcagagcattttatttttgcttctatctggagcccactcacatgtgtttatcttcttgtttttaagggggaccccaggcatgaaagtaattgcttttattgcattgaatgctaaaaggtatacagccatacattctttttgtatttgtttcttagagctgctgtaacagagttccacaaactgggtggcttcaaatgacaatgagactttattctctctcagttctggaggcaagaagtctgaaatcaggatgtcagtagagtcatgctctctccaaaggctctagggatggattcttctgtgccatctaccttctggtagcccctagcatttcttggcttgtggcagcatcacttcagtctgggcttcacagaggcagagattggagtgatgctgccacaagccagacttccttctgtgtctgtgtcattacatcgtattctttttgtgtgtatctgcatccaaatttcattcttcatataaggacaccagtaacaacagattaaggcccaccctaacgactttaccttaacttgatgtcttccaagatcttctttgcaaataaggtcatatcattttttagtagacaaataatcttactatgttattaaagtaattaaatcatatggaaaaatattctatttaattattgtattttacaaaacatttcaaaggatggatataattcagagataaccattaatattttttgcataggcacaaaatagttctagttttaaggattacaattataatagatatgaatactggcaatttatgagctgaatgtcatttatatcatatgtcaggagaaaaattctgtagaagatattgtctagtttggttataagtaaaaaaaatggttaaattattaggtgagtttatgtacagatatatactcagtctaacaataacagcaaaacttagtatgtgcattttaataaactatttttcttttgagtaagaaattgttttcttgattagtattctcctgtaagactgctttaattctgtattctctagatataaatgagaattgggaaacagaactaaaaagtagcaagtatcgtataacttaattaattcaccaagattgctttgtgagtttgcaaatgcaactgcaagtgggaagtaaagtatttctagtttattcataagtgtcctagttgaagtctttttgtaaataggctggagcctaaatttaataacctaatttaataacaattttgtctttattgttactaggtcagcagttagcatttaagatgaaaaattgatgggaatgataacttacattatccaactttatgtggttatttgttattgcctaaactccattgctaatacttatactggctaatatttcttctgatttttattatgggccaaagctatcctaagctttgcaagtattaactaatttatgctcaaaacaagtctagcagataggtaactattattatctcattttctacatgatgaaactaagaaacagattaaatttgcttatgtttatccttctaataactactgcagtgcagctttttacaacgatatcgttatttctcttttaccaaatttctgtgtgatttttttgatacttttctctctctctctctgtgcttcaactacctcatttatacagttattttaataacataaataaaataaatggattaaattgggatttcttattgttcccaacaccaaaattctctttttggtgttaatagaaattactataaaaagagaattgtggtcaaatacatttgggaaatacaacatccttcttttgaggacacatcagcattgggtctgagaatttatgtagcaaaagcatttctttcatttgaggtactttttacaaatgtatatgatcagcgatttttatgaaagaaatgccaactaataaaatgtattttggagacatcgtttgggaaattctgaatttagatcctctaaagttctcttgatctctaaaaatcctattatacggtgtttaaaggaagatgatttgcttggtgcagtggctcacgcttgtaatcccagcactttgggaggcccaggcagcagaatcactttagccaagaagttgaaggcagtgagctatgacattgacattgcactctccagcctgagtgataaagtgaaactctctcttaaaagaaagaaaaaaaagtaatttcctctttttgacacttctcatagtttctctatatgttattttttttgagctctttttccaagagttcagattatctctttgatttccctttcaactctgcaaatcgtatttactgttttttctccctactatcaccttcctggcactacacaatcatattttgtattgatcttttctctcatcattatgttcaaatatatacaaattcccaaaattctaaattatctgaaacaatatttctctcaaacatcatttattcttggcccttttatatgtactgtgatttaagggttatattgcatctttgctataaactatgtcaaatctattagaaaataggctatcgacacacacacacacacacacacacacacacacacacacacacacacggatatctaaataaatcacattttcgttaccttaagagattccattcactccttaggataccgaaagaaggacttagaaaactatctcttacacaaagaatttttaaaaatacactggagacttgtggttatattgttcttgttatctatattaaaagattgtataaatgcaataggcttattttcatctgttgttccaaaactgacataggtgttcttcctccattataccttctgctgacccctttcctagtatgtatttttttaagaaaataagccttctttttatatttctgtctccactattacaatatatattttcttttataccaagtaatgtatcttatttgaaatttatgttctgtgctaagtatgataattaggacctaagatatataagagcctgacatatattgtacataccaaatataatctaagatattaataattattatttggacaacatttcatagtttgaaaaaataattttacttcagtagtatttctaatagtattttgatggaactttcaaaacttctgcaaataagttttagtattatttgtaatttgcagataagaaaacaaaagctttaaatgattaactcaaagaaagttatcattacaattgaaattgaaggttatataatatttagataggcagagggcagaggtgaagtcatttcagagaccaaaaaaaagcaaaagtccggggatgaaagcagctatgacatatgttgtgggacataaaaacatgcattttggatagaatagggaatttaaaagaaatatgtcaattgttcacctattatctggaaaatcaatcatcttttattctcttgcaattgtaaaggctcagttttctacatattcatccaatattgttccaaatttcaggttatatgatcatgcctcaatatatgtatttgccttaaatgtttaagaacagattgctttcttgtcatttgatcatttcaacaatgtgagttcgacttaaattgagtatttaaattttggcctactgcaccattttttaaatataacctttttctggaatatctatatattgtgcatacagataaagtgtaccctttgcttattttcagaggactcataaaaaataaaactacctaggcaacatatatgttgattaaagtttgtaccttttttatatttttaatatattttctttctgtgtgcatattttaaatgtgatgtgcaaaaaaaatgtcaaagtaagtatcagtgactcagcaagaaaaggcaaaaaataagcagtgaatacaaggagttgtaattggaatatttctcaaatgaagaatatgtgaatattttatacacataataaaatctataatattaaaaaatacaaaagcactaccaaaagagatgaccatgacatgagacattggccaattaatttaccatatatgcagaaaagtcccctcaaattgtaagtgaaaggagacgttgataagatatgctgaagaaataataagacggaagagaatcagcaggggtaggatatcattataacaacttcacgttctcttttagacatagtttttctaacttctacatttacccacatgtttatgtgtgtgtgcatgtgtgcgtatgtgtctgtctatgtattattttgtggaaatcagcttaaatgaacattattaagtattgtggtaggcagaataatgtctccccaatatgcccatgttctaatccccaaaacctgtgaacatattacctacttgcaaaaaggactttacggatataattaaattgaggattttgaaatggggagattttcccagattatctgggtgattatattgtaatcataagggttcttgtaagagggagataaaagtgtcagagcaggagagagattttttggtgctgcaactgctggctttgaagatggaagaaaagggtgtaagctgaggtatgcgggtatcactagagactggaagaaaccctccttgaagcctccagaaggaacacacagcagagttgaaacatttatttaactccataagatccattttggttttctggcctctataattataagataatgtattcgtgttgaggtaagccactaagcttctggtaatttgttacagaatcaataggaaagtagtaaaaaagtcaaacattttatggtaccaataaggtgtaaatttaaatcagaatttgttactcagtcataagatcagcatatatgattaacactgcttacaaatatttcaccagaattattttagattagaaataaacatgtttaggggatgtaaaatttaagcaaaggaagtgatttaattagaaaaggtaacttccatttcggaagaaactttcaagtcaaagtgaactcattgtttctgctttatttttgtagagcttaagtttataaacaggaccagagaactgaacaactgaataaacatcagtgtactggaaataactgaagtattgggttcaatatcattatacacactattgttttgaggtcacagaacatgaaatctctgggtactttcacccagcaaaatgcacacgttaataaggcaaaagatcgtgaattttttttttttttactattttattcccatgttggctaacactgagaaacttatattctcagttggataaaacaaaatattttgggccaatatttatgctaggataagtgaagaaataagacagtcactcaaaggatatcctagatgagagcattttggtcaaacaaatttacaaatcaaatagggtataaaaatgaatttccttaattttagccatattttacaaatattttcacatagtataattgcggaaataggtccatgatttgagcaagaaaagatactctgccaaaatattaatataatatcttgctaaattgtctcttcaaaagcatcacattttattaatattttcttatccatgccctttagaacaaacattttaagagatagcatgtagtagtatttaaaactaaaaaatcttagttttcatggctaaaactttgagccactttgcaaataaaaataaattttaattgagccttaggagtatgaaaataatcagcagtaaattgaacctgcataaaaaattctgagggaactattgtcaaggaactatactaaaaatttactatcatggaatgtggaataaatatttattagaatcttctttgacccaaatgtcattttagtgcctactcatacagttagtgattgcagttatttgtgagatacagtagtgaatatacgtttaatattttggggaagttgattagctttcctgaatatttcaaatcctagattcttagatttgaaggagacctccaaaatggtcttctgttctaaattgcaacattccatttcgcaatactcctgataggtgaccatccagccccagtttgaaaaatagcatgaataatctccttcttgatctgacattggcaaaccaaacagaaataggataaaacaagatattattttaaaattacattatgctgttatttgtccactgtatcactatagttgcattagtctgcagttgaaggtattacctaccaaactcatgcatttttccactattttattctttattgcatctaaaaatgtatagtttatgttgtaaatatatcataatatttatatcaccaggtgtagtgaagtataaacttaataattcctgttaatgtctgacctgacaccttgtagatgttcaacaaacgttggtcctgttcacttttcatttttgaaaatatagtatttcatctgatagatactgagggttctattgataattcttcaactttaaacataatttcaattagatataagcataattttcatcagatttaatatgacttcaatgttgtgactacttagtataatttatatcatctaatatttgattgaacaatataaatttgaatgtcacttatgtctctgaaagaacttaaaattttttgaaaattcattcagttacagtttctaatttgatgaaattagagatttttaggatgcactttttttttttgcaaatttcacggaacctatccttaatttatgagttattttaaatttttttaaccacagttagatattttcatttttgggaattatagcacactttaagaatttttaaaaattggcatagtgtgtgctactcatgtgacagttgcactaaaatcctagactccaccattacacagttcgtctatttaactaaaaactacttgtacccctgaagctactgaaataatacaatttttaaaaaagaataaaaagaagtgtcaatgactttttatcatttttcacattggcactgttactggtagcccataaattataaaatttgtgaggcatttgtagatatacaaggttgtgtgtaaatctgattcatagacaatcttatgaattcttaccacagtaagaaaaatgaatggaagtgtaatagtaactttgaggatgaaagcttatataactacttttgtaaaatacatttctctttagcaggaatcaaggttttaattttttgcttgctgttttcttaaatttttatttcgtacttatttatttattttgtttttgagacagagtctcactctattgcccagactggagtgtggtggcacaatcttggctcactgcaacctccgcctcccgggttcaagtgattctcatgcctcagcctccagattatctgggactacaggtgcacaccacgcaatttttgtacttttagtagagatgaagtttcaccatgttggccaggttggtctcaaactcctggcctcaagcagtccacctgcctcggccttccaaagtgctggaactacaggcatgaactgctgtgcctggcctagaatcaagatttttagttcacctggtaccatatctaagataaatcttagagcatttaggtacttaatccaaaaatatctttttgcagtatgcaactgtccctgaaatccttgaaataaaaagtataattttctaactaaaaatgtagttttatactataatttttcttttaaataatagtaaaacatatccataccttttttactctgactccagtgtatatgcattggaaaaggaaaattccgtgttttagtatatttcatacccaaattttcttttacttaatattttcagtattatctgtaaaattgctttctttactgtttcttttgtattttgtctgttttgcatgcattaaaacaaaatgtgagggaggacattatttttgtaattgtctattcactgagataaactgaaatgtatatcaaatcagtcattaacccccaaatttacctaaatgattccaaatatcctagtatttctcaaaaacaaattgactcagttttgtgtttttcactagaggtccaggattgtattgatggctgaataatgagtcaggaaaattgacctatatgatttttttcttcaggaacttatgccagttaaagtaattgcattttataatataattttattgtgagtaaaatataaacagtcgacaattaaagtaaaatcatatgaaaatgggagacatatttaacaatgtgaatatcattgaacaaatgtctgttaacaatttaaaagtagcaaagaggtaatcaaataattcaaaatcgtgacgtacttctttatgcttagattcaattttaaagatgtacttatctgtaattagagactgtcacattcagtcatctgaaaggcagtaccagtaaggatcatctaccaaatttttaaatcttgagaataggcattttgcataagtaaactccatttgtttgctccctacaatattctatatattaaaaataacatgtgccaaaaaggcttcgccttagaaaatctgtacaacctttatgtgaacgtgaatgaacattgtttttagcaatagcttattaggaactctgattttcaaataaatatgtgaagatctttaatatatgaatatcagcattttcccaagaaaggtaagtggatgtttattatctgtgagtgagatatatgtcagtttagacatttaaaaataaatcactctgatttaatattgtaatatagattataaaaacattcttaagtggtgaaaatgatctgccaaatcggataaataaaaaagagtgaaacagatttaatcaaaacattctttccatgggaggagggtgtttttggtgataggaactctcttccctgagaaaatggaaatgtatttggatttaaaaattacaatcaacacatggatgaaaccatacatcatataaatgcaaattttacatgtatattttcattacactattaccactgtgattttaaatgtagtatttaaataccaataattaatttagcataatacccctgttttaataaagcaactttatatggtgatttttgttttcttatccaagctgaattatatatagtgatgataagatcactagcatcagatgaatgaaaaactgatttatgctgtacaggtatacaactctttataaataatcttgcaacttgatacagaaagtgtctataattctggcatgtttgacattcccattcagtccaataactcgttgacagatacttaatttgctacttcttgaaggtgttgcttgaagtttccttctacttgacaggtgtctgacagttcagtctcactcagagcttaacaaaatgggaaaagaatgcattatctaaacccctaggtaatatccattttatgtcattttatgactttgatagtatccaggactcaattctgttcctctggatagtgaataatgtgcacttttacttgtggctttttaagatatgtgtatatacctttagatttccttcagactctatcttgaaatgtcaaatctttatgccctgcagttcttaaactataactgatgtttacaatatggactgtgaaggaaattatgataaaaatatatttcctggtcacccactgttttggtcaatttaggctgctatagcaaattaccatagactgggatgcttaaacaacagacatttatgtctaacaattctgaaggctagacatctgagatcagaacgtcagcatggccaggttctggttcaagccctcttccttgttgcaaacaaccaacttatatcctcacacagcagaaagagagcaagctatacaggcgcttaatttcattaataggttctacttaattatctcccaaagaccctaactccgtatgctgtggggatttgatttcacatataaaattttttggatatacaaacattcaattcataacacctaccaaaatcaaaatattcataatacaaataatgctcttagtatctggcatctctgacaaattatttcagctgttttgcttttgaatacatatttatatccattcagatttatcagaattcttcatttaacttcagtacagacacacgcacgcacacacacacacatatactcacacacactttttaagatgtaagcatatgatttcattttagaatcaggcagaaccatattataagtcagtgtccacagataaagtatctaatataaaactgagtttctaaaggaaacgtattttgaggtgaaaatctgtttagcttaccagtgtctatataatatgtgcaaaatccttaacatcgcattgaaagattctttggatctgatcttaccatatatttctagcctaattaatcttctacatttaccctgccagttctctgttcctactcattgattccctaacaatgtaagcagagttcctttgttaagtcattcacagaaagttttccctattcttctctatctgaaaaaaaatgtcctctatccttggagatctaacccaaagtccatgaagcattttactgatactttcattttctgttgcagcacttgctatttcttttatgccatggagtgggcacattttgtatttgtgtcttgtattattgtgacttgatccttggattggatcttattttacttttgatgtatgtggtagtcagaggcctaccaacagatagaacccacacagtaatttggagaaagttttacataaagaataagtagatataatacagtatttatgtaatggaagattagctagtaataactaaagaggagtctaaagaatatagtaataataattataaggagaaaccattgcctctgaagctgagaggtacccaaaaagaacctcttcatcccctgcaaggctgatatccaaactttatttgtgaggacatgcccgtggctcactggctggtggacaaattgctgaggtgctggaacagcaggacttgttggaaatgttttcctctgggattccaaataagtcacccatagggaggatcctaaccagcagcactcctcttcaaagccatctaaggggtgccatcttcgtagaggtgcctcattggcaacacttcactgctatgctatctgagagggtaatggaaaatgctatccacaaggagactgcacattgaaagttaatgcaaagcaacttaagggggtgtggaagatgccatccacaggaagtgctgggcttcggaactcactgaaaagccatcagacacagtgtctgggtgcttctagccaccatgttctataggagccaggtattaaagaagctgcatgctgagaggagcacactaggaccagaaagagaaacctttctccctctagtgtccccccaatgtcatgtactgacagagctcaaaatgtgcaagttcacaagggagaaatatttatcaaacccatctccattattgtagagcaggcagtggggggtggatttggatgtgataatcaatgtattcataattggcacaatatacttgtttattgactctttgaacaaatcagaatttcttacaagatagaaatacattcttaactttccttttgtgcccaggatttttaaaaaatctcaaataaatattactatatttctccatcatattcttattaatatgatataaactttgacattttatgtgcacaagatatatcctaagcattaaagataactgtgttacataagtgcacattattgtgcttagtaagtgtatgagcatgtgtgggcatatatgggtgtatataaagtcaatatttgatttatgattgaccaatttgaaaattaataaaatgggcttgctgaaagctagaaggtagctactttaaacatcagaaagacaaatgacaagtcttggtatcagctagttaaaaacataagtttctacctttgaaaggattatgccacacattgattttcctattaatttaaataaaggtaggtataggaaatttactttagtttccatctttgaatgttataaaatattgtactaacacatgttgatttctgaaatgttataatcttattatacttaaaggataacattggggctgggtgtagtggctcatacctgtaatctcaatactttgggaggctgaggcagggggattgcttgagcaaaggagttcaataccagcctgggcaacatgatgatacttcatctctacaaaataaataaataaataaaaactaactgggcattgtggtgtgtacctgtagtcccagctacttgggaggctgaggtggaaagatcacctgagtccaggaggctgcagtgagccgtgaccgtatcactgtactccagccaaggtgacagtgcatgaccctgtctcaaaaaaaaaaaaaaaaaaaaaaaaggaaagaaaaaaacaaaaagccaaaaaaaaaccaaccaaaaaaaaaacccctcacaaacaaaagagcaatattgtttttaaaagtacattttactggccaagcatggtggctcatgcctgtaatcccagcactttgggaggccaaggcaggtggatcacctgaggtccggagttcgagatcagcctaggcaacatggtgaaaccccatctctaccaaaaatacaaaattagccgggtgtggtggcacatgcgtgcaatcccagctactcgggaggctgaggcaggagaatcacttgaacctgggaggcggagtatgtggtgagctgaaatcgcaccattgcactccagtctgggcaacaagagtaaatctctgtctcaccaaaaaaaaaaaaaaaaaaaaaaagtacattttactaaagatgtaccttaacccatttatgccgaatgtactttaacccatttgtcttcaaatttattcacattaaaaccttattattgctcatacattaatgcatgtttccttgttttcaggtttatgtatactgattgtctgttatatagccaggcaaaataaatgtcagagtttggtaaaggtttccacaaggagaagggaggagtgtttgcaaatgaaggttaaatatgctaaaattacaaaaattacaaatatcttaagtattttctaagaaatgatgcgtaaatatttgctactaaaagagttctggcatttgattcatgtggtctagattcaaattctaccttttcattcactgtttaaagtttacataactcttctggaaaatggggattctaatagtactagtttatgaaagagtttttgtggatttagtaaaagattaaactcattaacaacttacaaagctctgctgtattgaaaattgaggagaaataactttacaataaataaaaactgttaaatttaaaaacagggatatagtgtgcatgtatctgcaattcttctctctcttctaaggtttactttgtacataactacctagctgcccttcatgtaacttagaacttcatctactatctttaaaatctagtcccatgttttaaccatcttggatggttaaaaccttcaatgaccttcacctagttacacaattcagggacccaggagtcaccattaaccctacactactcacattcacatccagctggccactaagtcatgttcaatctgtcttttaaaattcaatttagtatgtttccttcctcatattcacccttaaaattttctttaactgtaaataccagcaattctatatatttttttcttatttggcttaattcatttagtttttcactgcattttatccccgcttttatcagctacattgctgtgggtttaaaaaattataattggatcatattattcctctctacaaaacttttaataccattctctccatacaccttactcctattttcttcaggataaagtttgtacttatcctagatgacattactttatccataggatgaccttaccaaaacctttaagttctagtcttaacctacctgtctagccatatctctcataaggccatatctcctcataaatatctaatgcttaattttatgagaattgctgacaattccttgagattgtttttatgcttccttattttttcaaatcttatattttatctggaatgccattataataatgtttaattgatttgtatcaaaactactgggatttgttgatggcttcttgccttatgttgttagatatttggctttttttttttggagagatggtgtctcactatattgcccatgctagtctcaaactccttggcccaagtgatcctctcccttggcctctcaaagtgttgagattataggtgtgagcccttgcgtccagccttgccaatttttttacacatattatttaatgtaagttctatggcaatttagtgaggaaacagatacagaggagttttatttcatgtccaagtttacagaattataagtggtagagtcaggccaatgctatgtttgccgctaaaaactatgttatccaaaagatgctgcaaaactgacctcaatcatattcatgtgtgtgaaaccttttgtgacacatctacatatgagatattgatgatcatgttgtcttttatgttatcactatatccacaactgtttctgttatctcaggtgtcacattatctcaggtgtcacactaaacttcaactgtgaactttatgtctgttattcccacttaattataaactgataagcagaataacagtattttaaaaatcataacctcttgcccagtgtatatttctcaataaattacatttgaatgaatgaatgaataatacagattccttcttttttttgtattcaacttcacccatacaagagagactaaaagtgtcattagctattatctttgtattcaggaaacattaaaaaagaaaaatggcatttgagatgggtgttgaaagataatgatggagaattttgacaggtggaggtagaatgagaaaaggcattaccaacgaaggcccaacttaataagagctattttgcctatactaatggacagttaacagtctgatttggtgtattgcttggaaatgatcttgctcgcaaacttattagctgttcaatttagttttaagtaaatgggcaagtggcaaatatatgaggaagtcagaagaacctttcttatattaacttgatgagtcgctataccattgaaatctcttacctcacccagagcagcccctctggaagtgctctttcatacttcatgtctcttctgggtgtgtgaggcaaacatgaagtttatatcagacacatatgaatatactcaatgaatttctgcctatggacaactacccttttgcaatacttacttgaagcatgttttctacatgaataatatcttgaagcccaaattatataattgtatctgtaatttatctgcttgatatacccttcacaataattctatagcatataatttttctcatttttaaatatttatgaagaagcttatgttgcaagagcttcattctcactgtatatacctgaatgctgtgataggttagtaatgggcactgaatcagaactatttatttctgtcctacaccaaagcccttgttttataaactaggcaactttactcccagcatgagcatgagcatgagcaaatgttacggcaataggaaagcatagtatcattcaaagaattatctagaaagtggataattttggccaaatctgagattctcagtgctgtttatacatcacaatcacccatgggaggttttaaaacttaggctcagacatcatcacaaatctccaccacagacaaattcaaccccaattgctgagagaggggtcctggcatcagaagtttttaagctcctgagtgattccaatgtgcagccagtactgagaaccactggactaaaatgaagggcacatgtatgggggcggcatgaagagtgaatagggtttaaaaaggaatattagaatcacatgggcaggataaaacccaaacagcctcactcagtaactatgtgatcttgggctagttactaaacttcttgaaatctctattttcctgtaagatggggataaactaaagcatgtaaaatacttagtatttggagtcagtttaattaatggtcattcttactatttaaaaaaaataaatttgaaaaatgataataggactatgttgtggaaatatttgactaccaactgcaggaaaggatattactacgacagcataggtgacaaaaacaaattagagatatattttttgctcagatgcttaaaatattttttttcttttcatatcttgtttgcagttaagtaatctttggtattaagcagttttaattgcaataagcttataaattattagtactccataatgaagagaaatgataaaagtctgtcttgttttgataatatatgaataatagtgagaattataatgtgctttcttttactaagcatcagatatttttcagatgaatagaatttcgatgagttaactaccaattgcgtagtaccatttacaatctcatttttgaaagacactgtcttgaaacaatctagaactgacaaatgacaacataagatactctgctttgcatattaaagactttcacattcacttctcatttggttctgcccacagccctgagacatgggaattaatgagttttataaagtttattggtttttaggggagagggctatgacaagaatccttcccttctaactttgaatgtaatgcttcttttatgacacacatacttatttggaatatgttgaaagtctagaaactaagaattaatatgtaggcaaaaggaccagtgcaatgctgtgaactcgatgtgagtagatcttagggattctaaagggcactctaatgcctttagatttaagctgaaagtcagagaaacagttaagatagcagaaacctaaaaattctcaaaatatcaaacaggcagagttaactctaccaaagtcagaatgactcaaaacactgttagcagcaaatgaaaacaaagaaagaaaacagcactatgcaacctctggtttgcttatggtacttactagaagtgagtagtcttggctgcaatgaactttatagaaagtgtttagcttagagaatgtcagaatcctataaataccctggaaatagcgggtggcataatgtcttctgcagtctcgtttcagcagataaacttcttcagttctatttagaatgcattttttgtactacggttgatatttcaggcaacagtgatgtatatacaagtatcttcaacattctattaatttcaggttcaatttttactgaaatcaatatctattaaaattatcatgttataattaataatcttaaattgtacaaaattcctattctcttgtatctgtataatatcaaattagatgtctaaaaatctaatctgattttcaaattaacaaaataacctagaagcaatactataatcatcttctctaatatatatacttaagataaaacagctaattataaacaacttatacatggaagtatgcataaatattgtgatttttacttaacacagtgataaagaaattgatacatttaaataaccatatatatagccaatttgaaatttaggtatactccaaaagtagatattttgaattgatatgtttaactggcttaattcaacataatttaggccagatatttcataaaattgtgtttatttctaaagtaatgagtgcttcttgtaaataattccaatacaaaaatatgtggagcaaaatgcgacattaagaagcacaccaaaattaggatggtcagcgcctctggcaatgagggaatgggattagaagagagaacaaaatggttgacaaccttatctgtcatgcttaatttatttcatagataaagttaaaatgatgaaatgtttctattgataatcatggattctatgtaagaatttgttacagtatttttgtagctgtttgttttttttaagtttctcaaaagtgtttaagatttaaatttgaccatattactaggtaattgatcttgatttcagttaataccctggagttacataaacagaaatttaaaataatatttttgattctacaagcattccacattcattaatgtaatacaagaaaaccagatcattctactgtgatcaacttacaaattgtgttggaatctgcctgcatatagcccaccccctcaataaggcaccataaaagctattttaagtaatattctctcaatcataataaaacacacatagcaagaccaaaaggcagtgattcctttttccatttccaacttgtcctcaagctaagcagtccggcaactcaagcaaaaactgtgtttcataatatgaacagccacttaaatactttctccccatctctttatgtttcactgctggggaagttaataatgattaaagtaggaagattttttgttttaaatcagaaagtcagttgaaagaaacctaaagttctgccataaatatctagcaggtgctgatggccacctgccacacttgcaccagattgtctatgtagccagcagtctggccatcagcagaccagagaggtgcaatggggagtctctgccttgctgcagattccgataacttcttgcttaatttctatggtggtcttgccttctaagtcccagatcttgatgctgaggcctgtggtagcgcagaaccagtagcagttgaggctaaagcacagggcattgatgatattcccaccacatagcatatcaaggtgcttgcctttgttgagatcgcatggcatggcatggcatggccagcattgcctccagaagcacagagggatccatctggagagacagtcacagtgttcagatggactgtgtggccaaagtggttcatcttcagcttgcagttagccagattccgtaccttgaccagcttgtcccagctacagaggtgatagtgttgctgccgttaggtgagaagtggacataagacacctactctgagtggctctccacctggacagtgtatttgtatatactcagggttataaccataactagacggttttatctcaggatctagagacaatctacaggttgtcaatggagaaggccacactcaacacgtccttggtatggcctacagatcatctcatagtggtgccctttgtcagatcccagaagcacaggtttccatctcaggaggctgagaggaaaaagtggccacctgaagagatgattttgtcatagacaaagtggaaatgaccctccagggcatgctgtgggatgccatagttggtttcgtccctgttcaatgtccacatgatgatgattttgtctcaagaggtggactgtatcatgtccagggcagtagcgatctggttactcaggtattgtggccttcaagagtgtcacaaagggtcttctgctctgtcatggtggtggtgaggtcaggtgtcactgcagcaacgaggatgccactcagagagaccagagggacaaacaccacagccagtcctgccacagccctgccacaaaaaagtaagccaagcagggaaattttaatacatgaaaaatacaaaatataggcataggatggaatagtttcactaatttagagtctatgtgaagggcaatattggagaaggtaattatgtacaaaagtatcttggagctggttgaattgtttgccctttgccctttatgagtcacatatatatggagaaaagaagttgtctattgccaattggtacaaggattaaaattaggaactatgaacatttcatggcagaatttttgacaatatataagtaatgaaaaaagcagccttttatatttaaaatatacagagcttatctcttatttgctgccaatccctagcaccctgtacaagattgatctattgatatttgctaaatttgttaaaggacattaataacttattgaatccgtaataggtgacatgagagaaatcagctcagggaagcaaattatgctgtctatagtcacacagatagaaaggttggaacctggatggcaacacgggtctgtttgactagaaaactccaatccatcttcttgtcaactgaatagtatttatatttattagaaacaatcactgaaaagttctagattaaaaatgtatctagatcattgcacaataaaaaaaatcttacatcttccttaagttatgattaattttagtgtgtcagtaataagataaattagttgtttggtaaagaggtgctaatctgataaactctgaaattccttctaagcccttttgtttatttatcttaccatggatacaaaaatggccacaaaataaaagaaggatgtgactattttcctaggagtgtgcattgtccaccccagtgcctgacaggtcgaactgtttgtgatgactccagaatactctgaatcccatcagtaattccttccagtgttgacaatgaaatttagaatagggactggtggtagtaggaacagggatggtgtctatggggttgcctaataactaatattatggataatatctaatacaaagggaccttcaatctggctggtagttcaggggagataggatgaagtgaaacatctctgaaatgtctgagctagataatgaaggttaggccaggtgaacaggaatgttaggagtttgacctgtaggctaagaaagacgtagataaaggcatttttgcctgcttaggctgaggttctcttcctttataaatagaatccataaaatatcattaggttcttatatttgttggaggttattaaaatttatcattacttgtgtatttgaaaaatatatgatctttttattatctccaaatgtttaagtctctgctgtgtagtagctatgatttttttccccatttcttttgtttgtttgtttctagcagtttttgccagctattccctgctacctgtgacacccttttttgctaagaaaatacttctgtcttgggtgctagtttcatggctagggttttatattctcaaaagaataaattaattattaacatatgtttctgaaaataaacttttattatttatttcaaaatttaataacagttgaaagccattaattgctcttttaaaaaactaaagaaaattataattatcagacccacctcaaagctctgcctttgtctcttatcagtccattccccttgcatttatgtgtaacaagtttactcttttagtttatgttaattgctgatatgtctactcataaactactgtataaataatattaagaatttggattgactaagaaattaactttaaattgcctctataaacattaaactttacctttagatattgttttttaggaaaacccatgaagtgctcctttgtaattaataaaataatcaaaataggttgttagaaaaactattaaacacattgatgctatagcaataatgacatgataaccagataaatatatgaaagtttataatccacaatttatttttcatatccacaaatttcttaaaaaaaaggtattaacatgtatcccagaacttaaagtataattaaaaatacataaaattttttttaaaagtactaacatatatctgcccatttaagaaatatttccatgacagacacttagatactttgcaaacaatcgtccacctcttcttctgatttagttcatgtattatgcccagggatgaaaaaccagtagtaaaccagggtacaactagcctaaagagaacctttgcgcaaattacaataaaaaatcatcctatgaactcaaggatgatgaacagaaaaaaattcaccttccattggggctcgcagtctgttgagaagaatccagactgaacttcagcccctactaaaactcttggccaggtaccaagttacatgaacataagcagcagctctgcttatcagttgtgctatggcaccgaggagggttacaaacatgctgagacattgattcttcagctgtcatgacagcgaagtgagtcttaacatggccaaatgccataaacagaacacctccaggcttctgcagtcttgtctgtttgctctaacatctcatacctctatcattatttgctatgtgacatgacacatagcaaggctaaaaccagtcttggtcatactgttcccattcacatatgggtatttaaaggtggatattttagtaagctaggttgcatattattcccatataaatgagagccacctccgcccccaacagaaaccatgttgtcaaaatagcatgtaatgcaaggagccaaggcagcccatatgcaggcctgaaggaatgttcaatagacacctggacattgtgccatcagcaaaaaaggaaacagccttcatgttcttagcaacactggggaactacttaattcattttctggagcccatgttaggagaaatattaaatgtcctaactgcttaagccacttttggtttgatatattgctacttgtagctgaaagtatcctgagtgttccaacttggcactccttcagtgagtactcagtacagcagccagagtgatcctgttaaaacacaagtggcatcttgtcacccttctgctcaaaattctcagtagttttctctttcattcagagtaaatgccaaagtcctttttcagagctagaaatcctatgtaatctgcccttgctctgtctcctcctttcctcctaccttctctgaactcattcctacttatttctctttgtccattttatttaaacagacaaggtatgcatccaacttagggtctttgcacttgctatcctctgccttgaaaactcttccctgatagcttcatggattgattcctaagactcttttgctctttacattaatcttcctctctcattgaggcttttcctggatgcaccatctaatgacgttccaaccagcaatccctaacacaccatattttctatcttccttcctgctctatatttgtccatagtacttctgtataacatgtttcagtttttaattaattatctcatttgtggtctgttattcccactggagtgtaagttccaaaaagaagtgatttttgccagttttgttccatactgcatgtccagtatccataatagtacctaggactcagaaggctcttgatagatatttgtcaaatgcatgaatcatagcagttaagcttactagactacttgcattacattattctagctttgaatgtgacaatttataattatctgtataagataaccaacatatttaaattaatttagtacttttgtacaaaaccttatattgatttgcaaatcagctgatttaaaatgtcaagtattacaacatgagtttttcatataacaattagaaagacttaggcaatctgattttatagactggtaattggtttgattgatctaatgttatttcctttatatccaagtgttctcatggtgtggccttgggatactatcagttcattgagaagagttcattgatatgtttcaggttccatattctaactgagataggagtttttatgtttcatcaaaaatatccaaaattttatgggaaggctattgaaatacacttctcccctccagttacattcctgtataaagctgggccttcctcatatttcaattcatgtttcttaacaaattgagtagaaaatcagataaaagaatccacttatcctctattaagtcaaataccaagggatttgcaagtgttaggcaattaaactattctattttatttaaaaccatttatatttatccaaaaaatatttgttagttatattaacgtttaatgaatgaaaaagcatatatattggaaattatcaggttaattttgggtgcaataaacatcaacaggtataatccacataaacaaaaactctttggaaaactcaatactttttagcaatgtaaagggatcctgagatttaaaaaaaaaaaaaaaaaggagggagtcaatttttgttactatgtcccttctgtctttatttgttaaaacatttatgtgtttaacacctcccagccccgtcaagacccgatattctaccatcctggtagtatcttcacactactgggttttgtttaaatgctaagtagcttttaatcatattatcttaaatatgatttttttctccagccaagacaccaatatttcagagaagccatttcatggcagtgactcacacttaattgttgcatctgatgcccttaagagggtacaaagcagtgtaaatgctcaacgaataaaaaaatgaattaatgaatgaatgatatatgaagagatggatataagcactttccttttagctaaaataaatctagtttgctattttatgtttcaaattatttaacatagagcttgttatattgctgacagttttctttcttttttaaacttgcaggaatatgctgtcaagtcatttgtttggtatgaatctatagctaagtaaccaattttgatagttaacttgatagttaatgttgagaatgtcaaaatatatctccacaaatgatcagattaatagatatgtaagaattcctattgcagattcagtttcaggaacttcctgctaggctttcttgacttcaatctccaactaaaaagtctgagaaactgtattcccctacaactcctcaagtaattggtaatattggtcaaggattgtttcctaaataaaaccaaagccgattacatttgagttgctaaaatcaaaataggactatactgattttagttcccaggtccactttgactcttctaccagtcactggcaaccaaagtttattaagttaaatttattcagaattcataatgactttattgtagaaatctgcgaatagatttgcacttgatagatagacaaaaattacctttgatagaattagtaaattaatagttttaattggattaggtagggacttaagatgaaactgcttaacttatttaagaaaacaacttggtctaagcagtctactagagcacttgtatagaatagtgtgctaattatgtgtttcttatctcttcattaaggtagatttgtcagaatcattctttggcaacattgtttaataattggtttatattgctttatagccctgaagaaaataaattcatatttggttataaatgccctacatttctgacttttaactaattacagatgataacttcctcaccccaattaactcaattaatgaagttttacatttttttctttttctcttgtgtgattttggtaatgttaatcaacactgaaaaacattgtttttcaaaaatttgctagctttttttatgctctgttttagtacatgttgaaacaggtataagtaactaaaagaaggcaaacaagtgtctgtacatattcttcacccactttttgatggagttgtttgtttttttcttgtaaatttgtttaagttccttgtagcttctggatattagacctttgtcagatggatagattgcaaaaattttctcccatcctgtaggttgcctgttcactctgatgatagtttctttggctgtgcagaagctctttagtttaattagatcccatttgtcaattttggcttttgttgcaattgcttttggtgttttagtcatgaagtctttgcccatacctatgtcctgaatggtgttgtctaggttttcttctagggtttttatagttttaggttttacatttaagcctttaatcgatcttgagttaatttttgtataaggtgtaaggaagggatccagttttctgttttctgcatatggctagccagttttcccagcaccatttattaaatagggaatcctttcgtcattgcttgtttttgtcagaagacatttattgggccaacacacatatgcaaaaaaggtcatcatcactggtcattggagaaatgcaaatcaaaaccacaacaggataccatctcatgccagttagaatggcaatcatttaaaagtcaggaaacaacagatgctggggaggttattgagaaataggaacacctttacactgttggtgggagtgtaaattagttgaaccattgtggaaggcagtatggcaatttctcaaggatctagaaccaaataccatttgacccagcaatcccattattgggtatatacccaaaggattataaatcattctataaagacatatgcacacatatgtttattgcagcactatttacaattgcaaagacttggaaccaacccaaatgcccatcaatgatagactggacaaagaaaatgtggcacatatacaccatggaatactatgcaggcataagaaagaatgagttcatgtcctttgcagggacatggatgaagctggaaaccatcattctcagcaaactaacacagcaatggaaaaccaaacgccacatgttctcactgataagttggagttgaacaataagaacatatggacacaaggaggggaacatcacacacgagggcctgtcaggggtggggacaaggggagtgagagcattagtagagatacctaatacatgtggggctgaaaagctggaagatgggttaataggtacagcaaactaccgtgacacatatatacctatgcaacaaatctgaacattctacatatgtattccagcgcttaaaataaaattgaaaaaaaaaaaagcaaaactagcactgaggaaacacctaaagcaatcctgggactcataaacactcccatattttctaatataattctcaaaacagtgtccagttattttaagaacagaaaatgaactgaggctaagaacaataaattatttctccaagatcatgcagtaagtaggacaactgggatttacattgttttttttttttttattctgaaagactccttatgtcttacttcaaaatatttctatgttctctaaaaagtgaactgagctaagcctacgttttgtggtgcataaaccataccaacataccaacatcattatggcattaatcattcattatggtaccactttgctttatgttccaaggcattcactgtcttctagatattttttattttatcatgaataattttccttatttaagcatactattattattattttagtactaataattcaactttatcaaaacacattttttatttctcatttaaaaatatctttaaagagtcataagttaaataactgttctcagcacagactgctatgggcagatgccaagaaataagttctgttgagtttactaagagattcttcatagttttattttttaagttgttttctttctaattttatggttttattacactcttatttaaactaaagcaaaaatacttattctacctaggtctacagtcttcatcactttaagaggaaaacaaagctattccatttaagtatctgggtattgcaataattcattgtgtagttacagaacatatcatagagcagtcatctaacccttctctcagacagccattcaaggctgcctatgtctttctcaggaggagatagaatggttaagctgtcattatcttctagtgccactgaaaggacaatagtttcaatgccatattgcctgacatttaaactgatataccttgggatattgagaaacagaagggactaggggaaggagagagccagtttttaaattgttactatataagaagattctaggattttttcccactctgaattttaacttgcattccatgtaacaaaaaatagaccatgtaaaatgaatatcatcattttatgtctattcttttatatcactgtgaaagaaagcaacagaaatttaccaaagaaccaaaggattgtgaatgacttttcagaatatgagtgagtatgcttcacagaaaaccaaagagctgctcccctaattacaaatggctggtctgagagatgtcaaatgacaatgagattaaaaaggtaatgtacaactcaacaaaaacgtgagctaaatgattggagatccagctgtagtataaagttaaacacttttactctgtagtcagagaaacctggattcaaatgccaatttcgttttttttttttttcaaacctgcatggctttgagcaagttaactggcagaaagcttattttccttatctataaaatgattccaggcatggtggctcatgcctgtaatcccagtactttgggaagctggggcaggaggatcatttgagcactggaatttgtgaacagcctggacaacgtaaggagatgctgtctctacaaaaaattaaagtaaagttagctgggggtggtggtacatgccttagttagtcctagctacttgagaggctgagagaggaggatcacttaagccatggaggttgaggctgcagtgagctgagatcacgccactatactctagactgggagacagagcaagaccccatcttgctatataaataaataaattatacatctatataaataaaccccccaaaataagaaagtaaatagaacataactgctacctacatcttaacatggctctgacgattaatgatacagtgcataaaagactgtttcagcaatgattagtgtataaaaaggatgtaataactagtaatattggccacaaattctattaatatgctttatatgtaaagatatataaaataagtaaggtattaagagaatacaaatatcaacttatgaaaataaaaaaaaggaaagattagtaaataaaaatgagaccgggcatggtggctcactcctgtaatcccagcactttatgaggccaaggcgggctgatcacttgaggccaggagttggagaccagcctggccaccaagatgaaacacgatctttactaaaaattaaaaaaataaaaaataaaattagccaaatgtggtgatacctgcctgtaatcccagctacttgggaggctgaggcaggagaatatctttttttgttgtttttgtttgttttgttttgttttgttttttgagacagagtttcattctgtcacccaggctgcagtgcagtgacgcaatcttggctcaccgcaacctccgcctcccgggttcaagctattcttctgcctcagcctccagagtacctgggattacaggcacccgccaccacgcctgactaatttgtgtaattttagtagagacggggtttcaccatgttggccaggctggtctcaaaatcccgacctcaggtgatccacccaccttgacctcccaaagtgctgggatcacaagggtgaagcaccacacctggccagagaatctcttgaacccaggaggtggaggttgcagtgagccgagatcatgccactgcactccagcctggacaacagagactctgtcacaataataataataatataaaataaaaatgaaatctatttagtcctgttatttgcctgcactttttctctatgcatccaagtggatatagtaatgaactcacttttatcaattacagtattcatagtgttcataagaaataagacgttaattaggtcatagggaaaagtcagtataaactgactttaaaaggtatattgaaagatatggtagatgttatgtttacaaaatccctagaataaatttaataaggcatgtccaacagttgtttcttaaagtatatgctagtgcaagccagaagcatagaggtaattcaacacagcatgaacaatactaacaggagccacagcaatgcaggataactttccatagctcttaatgattgagttgaagtcaagggcacgatgtagactgtcaacatacttccagagaagcgggggaagtctgtaataaaatcatctgacatggactttaagtagttttccataaatattggttaatacaagtcaggttgtgataaagaacagtagagtctaaagttatacaagactctgggatgtactgacacatgtacttcatccataaaccccatcaagggctgtcaagaatgagtatctgttctttcatccagtcataacagtggcaataatgttaataaacaattcagcaaattacttcatgttgccctatagctcaggaatgacacttgatgatctttctttctctgtagcaaatgacttaaaatattcttattcagacagaagaagtaatcatatatgccctacctaacatgagcaagtttttaccatcacataaacagctacagatgaagaataaaaggataaccaattctaaaggactgccattatctaccataccctaaaatattggataaattgagaatgaaattgtattatgaatttttattaatagcatagtgaaaggatgaactattttcaaaatcttggatgttaaaaagaatagttttaggcagcagcttccgctgttagcttattggtggctgtggtaacaggctcctgcatagcactgagcctcctagaatcttcctccagttaatttcctgtgggtgacgatcactcctgagccaacaccagcacattttaacttcttcaggagcagccatcatgacatggaaaactaactgcttttttaaaggatgttttcacagatacctgttgaaatcagatagattcatgtcaaataagttaggtcccaaattcgtttttttagcagcattgatttgaaactgtcagttatgatagagtaatatctacttaaagttgattaagagaatatttattccttgtcggtgtcaacttaaaggatttcccctgaacctttatatttatattgcaatgtaagaaacaaatgctagtactgtgtcaaaagctattgccattccaatgaatatcatcaatatttccttcaacaatatgggaggttctcttttgatttttatttcatatattttcttttgttttgtctaaggaatttcatttcatatctcaggcaaagataataaaaccatttttcaccataaagagtttaaatgtttctattttcattttgctttttattcatttaagccttatgtgttgttgtcatttggcattataacagtggaatattgtctataggtgatctccacattctagcataaagattagtccttttatgagatggagaaatgagggattctgaatttttgtcgtttaatcaggcagtatgcaaacgtcttttatgagccaagcactgcattactggggtatggtaatgaataagacagacacagtttataccctcaagcagcttatactgcatcagagaagaggtacattaagcaaatggttttcaataactaaacacattatttcaaatgtagaaaaggctttagataactacttggttataggtaggttgggaagtactaatatttctttgtgtgatttctggacactgcatttttatcctaatgaggcctgtaatacttacttaggtctgtgtggtgtttgtgatggggatggagaataagggatgagaaagtgtgaaaagacacgtgcagaatgttctgggaatgagatttaataaaacacagctcttgataatgtatcaagtgaaactgccctgttacttcgccttggaaatgtatgatgagaccctgtttcctcaattcagttagcatgggttgaatacctacatagtatcagaaactctgtaatacaacaaagattgaaacagctttacttttctgagaacttattttaaataagtcaaagaatcacaaaattttaatatgatatggcagtgctcaatggaaagtaaaatttactgtaaggagacaaaacaagggttgagaataataaaaaatacaacaagcagctgaaagaggtaaaaaaaaaaaaggtaacaaatgaagatgaggttgagggtagggaaagtatctcaaagtgtcaaaacaaaggtaggaaggaggaagataatctaagcattctatgcatacattaattatttttggaggctgcataagagaatgaagacattgaataataaagtcagataagctaaaagtagctagcagtaggtagagaggcatgtaagaatattataaaaatgtttataattgtttatattatctgtctatctagtacagaggaagttctggttcaggaaattctacagataatgcttatgctgtttctcatacgtatgaggctgtacattagttttacctactgccttctacatcagaattgcatgaggtcctgttgacaaggcagatttcataggctgtagcctaatgccagacataagaagaatttttaaaatgggaccaccccccatgccagttcttacccccaggtgattctgaagccactaacatttgagaataattagataaaagcctgtgacaatttccttccctacatttcctaaaatttacatacacaaatgtatgcatacatataaaccttaaaaaattgttttaatggtaatgagtgtatacactcccctccacacttcgtattgtctttcactttgtccatataacaggaatcccaatatattgtgtccaaatttccctctagacaactccttgacagcagatcacaggcttaatttgattgtggaatacttctacggtagtttctgtatttcttggtgtcagagaccctttatattcttaaaaaatattgagaaccaaaagagctttcatttatatcagaggtcagcaaactgtagcctgcaagtcaaatacaaccagtatcttctttttgtaaatagctttttttggaacagagctactgccatttatttttgtatcatctatagctgttttctcactgtaacgacagagttgagtagtgacagagatcatacggttggccaagcctaaactatttacaatcttgtcctttacagaaaatgtttgctggcttctggtgtatgtggattatagctattgatttttagcacagtggaaactaaagctgaaaaattaaaatcaagaaatatactagcacacattccattagccatcagagctaatgttcaaaactccactgtataatcatgaatgagaatgaaaaaggcaaatagcatcttagtattattaagaaaatagttttgacctcatatgacaagctgaatggatttgatgaacacagtttgggaaccacttggatggtacatggcaaatagcagccgcttaatacatatttgaatgaataagtactaaccaaaaaaaaacagaaaatatttgcattgttatatattacagtttacaaataattttcatgtccatttctactttaggaaaatgtaaggaggcagaaatatcaaggaaaaggattttggtgtaggagatattagagcatgtaggctgagtagaaagacggccctagcctagtaaacagaattaaagacacacacacacacataaatgttaatttaaaatagaccatataaatgcacttaattgacttagtttagtatttggtaaaccacatagactacaaaatagtcccatagtaaaggaaatataatgtaataatctaataggtgggggaatagaagaggaatctttgaaacagcaaagcacagatctgcttcaaaagaaaatcgaaaatcttcaagcgaagattgcttgaggaaattttaaaatggaagacacagggtcatcaaaacaccaagggttcagtctaggtcctgctgctggctgcacagaaggccaatgactgagactgtgagagtattgccaaggaagtgcttcagtcgaggagatgggagttcagtctcaaatccatctccctgaatgactaaaattaggagtttctatagcagggaagaaatgtagaaagcaggaactctgaatggtaacgacacaatcctgatgaacgaggggcctggtgtttcattgtctggatgaaatgatctgctgagtttcagttctttgatactttttaagaggcctggggatcctttcctgagaaaggaactcaaacaaatacaagtttcaagctttaagaccagaagggtccatttctatgtttacccaagaacaagtctccgtgaaactattgggtccgtttcaacactaccttcaaaaaaattggggaaaactgtattcagtgtgtaattccactctagacatagcctgtatttgtacccttcaggttaaaaaaaaaaaaaaaggccatgtacatttttactcatcaaatgtaaccttgaaaaaatattcagtggttaaaattttatgttctgaatttctgtctaaataagatgaaaaatatgaaattccaagaaaaaatgtttttggtgttcagaaatggccaaaggtatttcaacacttcttttataatcagaagttaatttgagaaggggtgtggcatactaatatactattatactgtacctttccatgttttacttggtaaaaagtaattggatttggactaggatctatttattctcatcacatatttaattgcacgcaaatacatgctctatcataaattaacaacaacctaattgtggttaaacaatgtatgatttatgtttgagccgcgaattcaagtccttgttcaaagtctttatggcaaatgtctccttttacatatgtcacttgactataagctttattcctaggagagatatctaagtgctacacagtaaccaagcattcaattaaaataatgttttaaaaaaatgagatcagcaattatgaacctaaactcatctagaaacaatttgttctattacattatcgaaaacaaatgcaaacaaacttcagaaagccatggtgttttacctccttcaatattatattgacattatttgcacagcaggattagaaagtaatccctgtggagatattaagaaaatcatttatttttctgttagatacacaaatgggtgactgtgtattatacaatacataatggcttttaactgggagacataaaaattgaatatcactaccatgtgtgacatgtgaattttgatataatatttataaatattttagtagttaccatttaccagatgggagtgatgtgtgtctttgtgagcatgaaacatcttttttatgataatagtctacacttgagataattgattctgattttgcaatatggatgcaagttctctgtactatatacagtattcctagcttttagcaaatcaaataatcccaaacataaatacacatcaagatgaatgttagtaatccatttgactaatgaatattaaattgaaatgttttacctctgtgtctgctataatttgaaaccaaaaggctgaacaagcttgcatgtacatttctattatcaaatgtaaccttgaaaaaataactttaatattttaacatggagaaaatgacatggaagcccatgttctattagacataaagcattagactgttactgtctatatgaaggtggtaaactaacattcctccatattttgtaatctggaagaaatacctgctcaatctctgttaggaggtgagcagggaactttagccccaattttctttatccttttaggatcatttcctctcctctcagatctctattacctctatcatcacctttctgaaatgctatggatttatttaaagttacttagactagtctttatgtgagttctatagttgccacgagcaacaatacaaataaaacattacagggtcactctttccttttctactgattaacacaatggattatctggccagcgtcctgcttatgaattggtgtgtctgagaatgctatggcagtgattttataagtctttcaagcgagcatgtgtaattttagcatttcttgatgcatccttgaagaactgctctttggtgctttcaatcattttaatgaggtatcttagtttgatttacaaatttggtaaacatgacttggtgttgttatgtttagactttggttcttatttcatactgtgtgttgtaagagttctttttttttttaatactttatgttttagggtacatgtgcacaatgtgccagttagttacttatgtatacatgtgccatgttggtgtgctgcacccattaactcgtcatttggcattaggtatatctcctaatgctatccctcccccctccccccaccacacaacagtccccagagtgtgatgttccccttcctgtgtccgcgtgttctcattgtttttaaaattaatgtttttaaaattaaaaagttttctttaaaaactttttaaagaaaagtttttaaaattttcttttaaatttcttcttcaatccagtggtcattcaagagcatattgtttaatttccatgtgtttgtatagtttccaaaattcctcttgatatttacttctatttttattccattgtagtcagagaagatgcttgatattattttaatatttttgaccgtcttgagacttgtgacctaaaatctagtctattctttgagaatgatctgtgtgctgaggaaaagaatgtgtattctgtatctcttggataaagtggcctgtaaatatctattagatccatttggtctatcgtacagattaagtctgaggtttctttgttatttttgtgtctgaaagatctgttcaatgctgaaagtggggtgttgaattctccagctgttactgtattgggacctatctctctctttagctctaataatatttctgttatatatctgggcactccactgttgagtgtacatatatttaaaacttgttatatcctcctgctgaattgacccctttatcattatatagttaccttctttgtctcttcttataggttttgtcttgaaatgtatttttacaatataagtatagtgactcctgcttatatttccattgctatgaaatatatattttttcatacttttatttccagtctatgtgtgtctttacaggtaaagtgtgtctcttgtattcaacagatgcagatcgatcttgttttttcatccattcaaccagtctcagtttttttaatagggaaatttagttcatttacattcaatattattattgacaagtaagagcttaactcctgccatttttttaaatttgttttctgtttgtcttgtagtcttctcttccttctttcttttctccccttcttcctctactgaaagtgattttctatggtgatatgatttagtgtctttttttttaaacatagggagtttattcagtcctcaattattcccaaactccagatgaactgtctttttgaaactcagttacttacattaattcttcataattagtaccaaaagcaaaaatgttgcttcaagaaattctacgtgaaaatgtataatcttgtttcttggggcattttgtatcctaaaagctttcattgagcagcttcttcattgagcatatatgtccttccttcttctatgctacaaagccaaatagtttatactgaaaacatacttagccttgccctcaccagtagtatctttccaagttcaaaatcaaaggaatagttcaaagaaatatttgaagctctcttgcttcaactgcaatattcacatattgaaaatagcaataaatgtagtatttttgtttctcttggtactctgtttctctgtttcagtaactaaatgggttaattctgcttgctaaaaggcctcagattcttttcttcttaataactattccaaatggagaatgaacactgaaacaactgctttcccaacttatcttgattccaagatctgctctggtctcatcaagaagatttaggatatggatggtttatgtgagttgactcagagacagattatgatcttcctagtaactcctctcctcatttaatctaggctgtactagtaattgctttcaccacataatagaacaagttaattgcaaaattttgcttccacaggaactgtcaggtaaaattcactgatttaaagccagctgaaatctttttgtcagaaatgtactcacttttttctcaaaacatttaaattgtttaaatttaccaaatatatattttttcaacaagtaccatacattttccagaaataacaagatagtttatgacctgtatcatctttccacagttataattttacatatgcagaagtcggggttacaagcttatttgaggagctatttatgtctttcaatgtgcttctaatattattagattgttttatttccagaccacaagactcattactatttattccatatttagatgatgattagtttataagaatctaaatatcagttaatattagtttcgctagaaaaagtttaacattccagatgcagtcctttttcctacaaacaggtgcagcattacaagtaagctgcatttagatgcatgctctccagttctctgtggcaatgtaggccaagtgaagccagaaaaattattgcccaaggggaaacatttgtacttctcacttcattttgctaccttatcactaacaatatggtattcaaacaaacacatatatttatatttatagcttaattttttttttcctttagcaattctgacagctttgagttctcctcttgagggaatacataggaatatcatctctaattttattttctttttaacttattgcatttataccagctaaggactgtgaagacaaggtgaaagtgtaaataggcagggctgcagtaaaatgaataaggctccttaactggccttaatgcaatgcttctggagaagttactaccaaattgcagtgtttgcaactttacaaaaccccttaggaaaaatctaggtgtcatctctctaaatacgatggttagatttttaagaatgctgcatgatgctatgcttgtaaattcattatagtgatgtagcccagactctctctagggatcattaaacagcatgcattagggttttggtgctactgtacacaatttctaaacctgctattccataagttatttgttttacttgaaaggacttatggtatctgtgaccacaaaatatttgaagcatagtgattacaaagcagagacggcatgcctgcaatgctcaccatctactataggagagaacaaaaaccaagaaagcagtttttcctacaatgtggtagttatttacatcattaataaataacatttactggatgttgaactcatctatcttagttgtatatgaggaaatttcatatgcttactgaaaagggaaagtttatattttgtgttattctattatttagaaatgtttctaaaatttgggaagataaagtaatataattcgttcacaacaaccactcagtaatgtaggtcaaagtgtacatctccttttagatagtaggcagcttggcaggtgctgagaaatagtattttttctccttgcctagaagagccatctagaagcaaatgtgatctacatggaaaggcaagataaagataagacttagaagaaaaagatgaaaaacaaaaaaagtgggattacaggcatgagccaccatgccaggcctaatctttacttggaagaatgactgacagaaaaacagatcatttagatatgagtatctaaagatctgagagagcagatatcaaacatcaggtgtggtaagaaatgtggtagaggcaggcatttaggggatgtgtattagaaaagatgaggctgtagataagaagtcaaaaccaaaaagaattaaagccaggcatggtgttttacaccggtaatgtaagcactttggcaggccaaggctggaggatcatttgagcccaggagtttgagacaagcctaggcaatataataagaccccatatatacaaaaaataaaaataaaaaatacccaggaggggtaacacatacctgtagtcccagctacttggaagctgaggtgggagaatcgcttgaaccagggaggtagagggtgaaataagctgtgattgcaccactgcactccagcctgggcgacagagtaagactctgtctccgaaaaaaaataaaataataaaataaaaacaagtcaagaagctgaatataaaatcaggtaaagcagaagttcataaattcagccatcaacaacacaaggtctaattcttaaacctcattttgaattcaagaactcctttcacttagaaaattagtgtgggccctgtagaactttggtttttatgagctatacttattgatgtctgctgtatctgaaatttaatcttagaaaatgtgaaaatatgttattacttaaaatggtaatattaaattataaacctgttgcatggtaacataacattttcatgaggaataactatatttttcaaaataaatacaatatcatgagaagatactgctttacccttatacaaatctattttatgttatcttattagaagattctgcatccaatgtatttcagtacttggtttctgttgaacgacttgaggaaaatttagtgtcacaaagatgtgtagttggaaagggaggattttttacaataaccttcaaatatttataaatatcttctttgatactataccaaattcaacaagtagtttaagttttagttgcaatgtagaatctgaaatcatatcaacaaacttttcactttactaaattaaaatccgtaggtctactgtgctctttgaatgcatatttactcatgaatgattttgtaacaatgcattcgtcatttggaaaatgctggttcactgaatattgcagatcttgaaaatgctgacgtagtttattatataatatcaaatcccattgattaatatcaccactgatttaataaaaaaactttattgataatctattaagttgactgtggtagataaatttttcaaattctatttttgcttgaaattttgaaatttattaaattcaacaaggagtataattccgttttccttgaattaacaagcttaactcatttttgagaaaaatctgtcagatactcaaatctagattactagtttttctgtcagtcattcttccaagtaaagattaggccaggtgcggtggctcacacctgtaatcccagcattttggaggccaagacgggtggattattggaggtcaggagtttgagaccagcctgaaccacatggtgaaaccccgtctctgctaaaaatacaaaaaattagccaagcgtggtggcaggcgacgtaatcccagttactcaggaggctgaggcaggagaataacttgaacctgggaagaggaggttgcagtgagccaagatcatgccactgcactccaacctgggcgacagagtgagactctgtctctaatcatcatcatcatcatccacctttaaatacctatatgtgaatgggaacagtatgatcaggattgattgtagcctttcttgtgtcatgtcctacatagcaaatgatgaaaatttcagattgtgccactgcactccagcctgtgcaacagagcaagactctgtctcaaaaaaaaaaaaaaagaaagaaaaaaaaaagattgaatttgatgaagaaatctggctagaccagctcacattcccaaacaatcacacaagatgtctatgcctccttctcattttgtcacatagcgtagtattaaaaagctattctcaagggttaatgcttttttaaaaagtatcttttttactgctttaataaggacattcttaatgaaactggatttatgcatttgtctatttacttgtataataataaatttgtggctgttgagcactaactagtacagtccagtgccatggccttgattaggattaaagcaccaatagttttactgatcattgctctaatgacatcagtacaaatgtgcggacaaggaggataataatatctcagataatattgtgaaaatagtcctgacttgatggtcccctgaaaggtcttgaagactcccagggaccacataccacaccctgaaaaccactggaatagaggcactttgattgatttttctaaatgccatgtcttgaaactctttttattctcttggtttattttttggtttgtttttgatgctcatattcatacagagcagaagcagtagccctgtaacaatttcctgtctttactttttgagttccttaagatatagcattaaattgagttttaagttgctctttcattcatgaaatatctgtagagggcttaccatgtcctgtgcattgttttagaaacttgacaacacctctttgtaaacattattgttgacattggagtgggagttatctccctactttttattccttttggacatgtagatggggtacctgaccaaaaataaaaattttaaaaaaacatagtaaatataccatcctgctctctgccctcctccacccttctcaatctcctttacctccttttacactccctacgagtccaatggatatcaggtgcacacctggcagcaaccacacaattgagaagcaattttgttgttgttgcatgcatttttctttagagataatccctttgactatcatcctagacctctttatattcttccaagaaactcgcttcatcatttggttttcagcatgtatttgtttcacatatacaagctttgctctagtgtgtagtaatttaaggaatgcatttttattctgttaatctgttccataattatgatattcgacaatgtctcttccattttatggtcatagcccttctttctgaaccctgtttgatctatttttccacctggctcttcatttctagccccaacctcaaagctatttaggttttttacctccatttttgtcactagagaaatctatctcttcttaaactgttaaattcatgacttcttaatatctagttaaaattacagatttcatagccacctccttctccaagttggcctttattccctgggatgatgtgtctagctttcgtcttcatttctgtttataatttcaccttttattttaggttcaggggctacatatgcaggtttgttacatggtatatcgtgtgatgctgaactttggagtacagatgatcccaccatcctggtactgagtatatagtacctaataggtattttttgagtctttggcccccttcatctctcctccctctggcagtccccagtatgtattgtactcatctttatgtctatgtgtacccagtgtttagctcccttttgtaagtgagaacatgaagtatttggttttctgttcctgcattaatttgctaggataatggtctcccactgcattcatgttgctacaaagacataattttttatagctatgtaatatccctttgcttacagcttgatctcttcagaccttgcttttagttgcttatcaggtcttcccctttggtttagattcctacattcttggactcctgtgctcctctctctacctttgttttgtctaatccacctgcattcccactgtccacctcacgtattcataattcccctttctgggaagatgaagtgacgtgaattctttactcacccttccagcttagattgcactccagtttaaatatttcagtcagctctccacacaaaaaatacttgaaacaaagagagctcatttttattgtgtgccttacatgtatttagtcattacagtaacccaagatgtaggcgctatgctatttacaaaggaggaaactcagtcatagaaagattcccatgttcccattgatgagccctgaatcctaaggagacaatctgtcttcaaagccagcactttttgttaacacaatagagcctcccaccagtggtatccttttaaacatttaaaatgtaaagataccacttttccattttctctcactatgatcctgactttttatgtcacaagtcaatccatggccattttaagaaatggaatatgttgctaaacatatggaaactctttctgcttggctgacagctgagactttagccattgtcagtgttgcaaatagacaacctcttccttttctaattatgctgctgcttcctttggagccttgcctaaatttttgctgaagcattaggtagacacaaccaggtcaaactgcagaatctcaacccccagcacttctgctcctggcattttcccatggctcagtctttcacaaatactctaagaatggcagatctctgtgacagttttttcttgggcttctttgccataagcactcaatagctgctacatgatttaagttatatctcgctggcctctctatcactgtctttctcttcctttcctgctctttaatattttaaaatccccttctcctaggctgcatttgtgccttcaaataataaatatgaatttctttaaaataacaaaatgtctattttgataacataaagagatgtcttctacttcagatctctgtaattttaatatagctttattcttacatacacagctatactgatgaatttgttcccattaattttataatgacatatattccattccatacttagtctagtgtcataaataattatttcccaaggaatgtttattttatggaatggaatcaaataaaataatctgtttcatgacacaggacagttaagtggcaaacgaacaaatcgtgttccatttactttcttttttaaaaataaagtatactaaaatacttatataataatgatatatatgtttttattcagtagacagtattagcttcctgtgcatttgtgcattcagtgtatatgtatataatagatatatgcctttagaaaggattttcttatctccatgtcaacagtcaaaggacaaggtaataagtaatcaaatcccatcactttacacttatcttactagattttgctattgaagtaatttacatctatattgtgtctgaatggtgaaaataatggtatgttactgtgcatctcttccatttccacagtcattgatgtaacacaaacagctcgaaatcagtctttttggaagtgttcacaccacagaaatcaacaaacacaatcacacattcagggatttttttttttttttcacagagatctagttgctaattatttaccagcactcaactagttttaggcttgacttaatgtagagacacaagttaggctttcaattctctcctttctctactgccttcccttcctgccttgcttcctctacacatctctttctctcttcactcctcttctctatctcaattcattattgtttctactccatatgtatgtgtaccttattccctcctgctaaagaaaggctttctctatggggtgagagaaatggaagcaacaaacgatcatcatgaaatagagttccatgacctgaaaacttcttcaactccattttgcaaagtgcaaatcggaggccttggagtggcctttgattgttctaatacccacacctggaacaatgcctattgtcaagttaatgggtaactagattgatgagtctacatcattaccacctgagaatttaatgaagcgggctacggggatctggagtcacaccagaatgactctattttggagatagggtctttaaagaggagattaagtttaaatgacacagttaaggtaggcctaatctaatctgactggtggtctttataagaagagaaaatgtagacacatatagagacaccaggggtgtagctgggtataaggaagtccatgtgaggacactgtgagggagtggacatctgcaagccaaagagagaggtcttagaagtaactaaactcctgacaccttgatttgtatttttagcctccaaactgtgggaattaaatttctgttatctaagccactcagtgtgtatactctgttataagaggcttaataaactaatacacttgcattagctttccagggtatagagggctataagtatcctgtatatgccgcctaccatcaccatgccatttaccccagcactgaattgaaactggatgatgtcaattgatgatgatgaaaaagaggtgtttctgagtttgtattaggatgagatatcaagcttgaaagcatcttgagtactataatttacctatcagataggatacatcagcagatgcatttttccttagtacttgcctttatctgcagggcctggtttctcttctgggagatggtggaatgtattctttgacttggggatttataacagttggtacagaattctgcctggaatgcactctatttctaaggaaggaagtttgagaccatgcaatgagttagggagtgggaagaagcagttgtcaaaggcaggtaaaaggcatgacttggctaaaatatggagaaaaacatatcctataacaaaatagtaattttaataatttaaacagttgtgcttttctttgatagttacctcacattgtcagcttctagaaacattctcatctgcttaccccttcaactccatttttcaacttataacatcttttcttttagcttattaagcaatctttattatagtctaaaaatcacttatatttactttgatattaccaagacattataatctctaccttaatttattatttattatgtaagattggcttctaatatgaggctagatgattatttcaatggcataaagaaccaagactttttacaataatttgtacttattttccttgtttcattgctatgatttttaatgattgaaatttccagaaatctactttatcatgggttattacagtaaatttaattgcaagaagtaataaagcaattaaagattataatatattttatagctttctacttgagaagacagaattaatcacatgatatgccacaaatttaaatatctttaaaacaattatatttatggttctcagaacattgtgtgtttttcaaaaatgcatgttttatatttcatacaaatattcaaagttcactaatactattgaactattaaaagatctacaaagtttatcagcactaagaaatcattgtttttctagtaatatatattgatatgtttatagataaatacaatatataattataagtgaatctacactacatactggttctatttagatatacattgaaataaaatattttcataattcatattgtatgttataattattctctgttacacacctgaacaaatattcttataaaaatatgcattgtttcaggtattttattcattgtaaaactttttgtaaacaaatgttacatatttacctcttggtgatagttgaacatttttcatggatgttaataaacaatttattttggtagtgaacacaaacaggattgattgacatagatatggttttatttgcagtgttcatacataaacttagaagatcacagacattcattgtgagtattttacaaacccagattgtgtactatggtatcatgtttatttcttacccatatattttagtatttttcctcctaaggagctagccacttttaagaaatttcaagaaaggtgaatctgaattcccaaatgatagaaacagttcagttattttattacaatatagcaagctgctgcagatgtcagtgaccagttaaaaaggttgaaatgtagagctgttgaatcgagacccacaatgacccaagagcaatttacttccttcagatgattgggatgtgttcaaaaataccatttgagcaataaatttctggatatccagagactttaagtgagtcagttgtcttttgaaaattcttcatataatggctttattttaggcaccaataggaaggcattaaaatcatttcattgccacaggtgtgtgcatatgcacatgaaagtcaaacggtgagagaggagaggcagcaaacatgatcatttaattatagtcaagtttacttttaattagtattactgaaatatttttaatttgcagcttattaatctattgtttcaatagcaaatatccttaattatttcaaatcaggcttcatgatcatttaatgccatgtgatggtaatatgtacttgtgaattactgctagacctaaaatattaacaaatcagccaaatactttaaataaaaatttagcaattcaaaagtgcttgcttataagaaagtatgatttttttactcttgatggtaataagaataaataaatatgacatggtaatttgaccatttctatctcaccagaaaaacatttctattaaagcaatgaggcaaaggcaaatacagctcattcaaaatgcatagtaaatcattgagagggttcagtttatatttcattgtagttatttcttatcaggattacagaatttttagagtaatctagtcttcaatttaataaaacatataatagctttgaatagtttttccttcttctacataatcagatattaagaatctcaaaaatgtaattaagagataattatgtaggtaatgtttaacatgcaaaagaggcatatcaaacattagtatatctaaatttcagttaaagaaaagttgtgatgcatagcacttaaaacacttgttcaactttgtaatgaatcagtagtacaggtaaaacaaggaccaaactctaaatgccatgctttccattattataggtcataggagtacataatattgcctagtgaggccaaagtaacacctaagttcctgcctacagagaaagtatgtgaaaaagtgggtgaactttgtaacggtcattcacaaaacaggaatgaatcaaaaaatatgtactttctttgcaaaagaatgcagaaagactcctgagaccacctaaaaaattgcaagaaatcaattcgtaaatatttagagtccttttgttaagaaatttgtaaagagtggtaattatataattaggtctgtgcagaaggggaagaagcaggcctttggtcacaaatttaagttgcattaaaaacattattaaagtattcattacaggcacaatgataggcaaattaaagacaatctcgggtaagagatgaacacttgtgttttctctgtatgtggaggggggtgtatttgtggcatttaaggcaggatagagatgtgtaagggaggtatttgtctataaaaaatcatgttctattttactaggaattcctcatctttacctttttttctcagctgaatacatgctccagccagttccagtcttttcatctgtactgtctcctcttttccctttctgcctcttccagaagactgaatcattaataaactttctgcatcttcttccctactagctcctttccctcagataggctgaactgtcttccaccttaaaataaacaactccacgctgaagggaaactctttcttcaaatttaaattgcatgcttcactccattcacttcaattgtcttaaaatatgtgtccactttcacccatttctgcttcagtgaccccactctgaagctctttgatataatttcctcatcatcaaatgcaatgatttttttccacagtccttgttattagtaaactctcccaggccacagattccattaaccatgccctccttcttgaaagtccccatgtcctgggtttctacaccatttttcctgtagctcctcgtggcgcactctttgctgtaaccacactggaatattatgaagagccacactatttcacacctctttacctcagcacatactctttcttctgctaggaactttcattctcccatgttatgcctgaatttttacccttccttaaattttcagcttcattgttaattattttgtgattctcccttatgccttcctaccatgaacccaggaataatcaatcattctttctgttctgctgtaaattctttgtattttaatatgccagtgtttgcattttcttataatgtgcttggtctgctctgcaaggatatgaacttcttagaagcagaggcaaatccttgacatatagcacagactttggaatcacatagaccatgactcaagccttgttgatccacatttagctgagtgactatggacaagttgtttcagctcactaaccttcaggtcccttatctgtaacacgaccatcacaaagtatcagaaggattaaatgatataatatatgactcaggaagtgccaaagtggattattaaaggaatgtcaaataaataattgattaagacaatgaaactctaacatggatataaacacaataaatgtttgataaatttatattgaataaatagatgaattaattaatgagaggtatttcctttgtatgaagattttttgttttatcttttacactgactttctccaatctcatagaaaatttaaatcctcactgtcactccattaaaatagtattcatatttttatttctgtcatgcttatttgaaatgacattttatctcaccagaattttgactccataaaataaagacacatgacttcctttttttatttgccagagcctaccctgactcatagtagctatttaatataatttatatatttcaatggtagcattttattaaattagttaaaattatttttgagtgaatttaactcttacctgtcaatagtggcttaaagagcatataagtctgatgaattaacagtgaatttggaaaagaaaaccaaataccaaatggtcttacttgtaactgggagctaaacattgagtacacatgtacacaaacatgacaacaacagacaatgtggacttctagaggttggagggagggttgagggaaagggttgaaaaactacacatcgggtaccatgcctgcttcctgggtgatgatatctgtgcaccaaaccttagcatcatgcaacattcccatgtaacaaacctgcacatgtacccccatatctaaaatcaatttgaaattaaaaaaaaaaaaaagatgagaactgtgaacagatctgtggtgcaatgactccagagtgccagaggaccaaaattctttttttctttctttcttcatcatgtggcttcaccttatcatccctaaatacaaggggtggtctgggctacagactttattttgagtagccatatgcaaaaactcaaatttgagagtagagaactagtagtatgtgctataattaaaatcacacaaaatgtttgaattaatgtgctgtatttccctcatgctgaacaagacatttaatccaatagaagacttattactactttcttacatttaggagaaaacatataactgtcttctttttcccttctctgaattctgggctgaaaagatcactccaggggcagagacatttactgagaaagccatcaaaatatttgcttatctgtgcttgaggaacatagagtgatattcttataccacaatgagaacagctaatttaattatacatgtttcgaacactgcaatttctggagagaagttgtgatgtgtgtttgtgtgagtgaggatgtgtgtgtgtgtgtgtgtgtgtctgtgttttgaggatacttagccttaaattagaatctacgtaaacaagatgatatgaaagtcaggaaaagtaaactttaaatatatgttttaaaaaattacacaatagtaaagttttacgaacaagtgcaggataatatatttccaaataaaggtacacaagttttcaaaatttatctcaataaaaatgtattattaatgtaaataataaaaaaatttagaaaggggaaaattttttaaatgaagattgaaagtttatagtttatagaacaatgtcttatttttgccaatctctttgccataatgaaattgagtattctgcttagctcttacttcaaaatatccatttggaaaggaaataatattttgtgttttctacatctggtttaaaggataaaaattcaaatataaattatagtcaccaaactagttttattcaataaaagttctggcatatctgctattcccacttggaagctattctttataaaaagccattttgaaactataaccatacagaattaattgtaagccttttggatgtcccaaatctagcattgtgagactacttcttacagctacctagtgacagaatgacaaatgaatgtcctattcactgtagtgtaaagatgactgacttaatgagctgtgtcctacttgtcaattaagtttctacctctgtatgtcactttagagataaagcaattccctgaaaccacagtataaaggagagaaagatgtatatggtacctgtctttaccttaaaggcgaatagtcctgcacatcagataaaaaattatttgttattattactatatttattatttatatatgccatatgcatgtatattgtctactaatagattcaatcactttagatgaccatggtttcccatgttctttttgttatttgattctgcatatgacattgcttacttaattctagtcattcaaaatctatcactaatattgtaattccattttccagaaataaaacaaaattcatattccaatattgcaaatatacatactatacactagtgtaatggccttgggaatataggtcaaaggaaagtgataagttaatataaatagaaaaataaccattgttgtttataggatttttattaaacttaacacacacctttttagtcttaagaactgattacttcataagtataatatgaattatttttatctggaggtgaatttcctgactagaaataaatactatcttagagatcaatggagtacaagaaggtatataacattaatatttttctttctaattttaaatataggaaaggtgaaatgattgttttcactcattgtacaatgttaacagtctacttgaaggttgcatcatgtcacgcgatgtttcaggctttttccacttgaaatatatttacaattactaggaaaagcctcacgcaaaaaagatactttaaaaccattactgtaaaaagtggatgagtctttcctccaagctggaatttttttccaattatccttaattggttatctgtatctctactcctgtgttactggtttatttttaagacagctgggtctacagagagatccagtttcaagaactaaacaatagatttgattcttccttgttccttgcttttttcaccaacaatttacacgacatatttttctattatcatattttcattcctgtccttcttgtcctctgaatttctatacccactatctaatatcaggccattatttaccaaaactccacctcccattccagtcccttcgctccttaccattatgtttggtctttccattcttaacaagcaatatgcctaaatttaaacagtatactgaaagcctggagtttatccctctaatggcaactgcacctttggaaagcataatagggtcaaaaatacaagtaaatttgtgtgtgtttctgttgcatttttcaacactttttttccagaagatagtatgaaaatcattattgataatcagttgcaatcaaactatgaatttacttaaataaggctgtaccattagatttcacttaaggtttttccactggagtttaagttaaaggatatcactgttatgaagcaaaaacttctctcctgtgaatatcttacctgatgcattagagaagttatccaaaatgtcagcatttttcttcaacatcttgtacgtagttggttttatgtacggacattgttaacttctcaccattgcagggatacctttaagcattttgctttatggcacttcacagataccgaactttttttaaaaaattggaatcttgtggcaaccctgcagtgagcaagtctgtcagtacgttttaacaatgaacacgtgcttacttcatgtctctgtgttatattttggtagttctcagaatatttcaaacattttcattagtattatatatgttaaagggatctgtgatcagtgatatttgatactgttataattgttttgcagtgccattaaccacgcccatatgatagcaaactaaatcaatcagtgttgtctgtgttctaactgctccagcaatggattgttccattcccctcccgctcctcaagccttcctatttcttgagacaaaacaaggttgaaattgggccaattaacaatcctacaatgatctttaagtgttgaagtgagaggaagagtcatacatctctcacttttaatcaaaggctagaaataattaagcttagtgaggaaagagtgttgaaagccaaaataggctgaaatccagggctcttgcaccagttagcaaagttgtgaatgtacagggtgtgttggtgtgttcttaaaggaaatgaaaagtgttactccagtgaacccatggatgataaaaaagcaaaagtgccttgttgctgatatagagaaagttttagtggtctggatagaagaccaaagcagccacagcatttctttaagtcaaagccctaatgcagagcaagtccttaactcttcaattttatgaatgtgaaagaggtaaggaagctgcagaagaaaagttggaagctagcagaggttggctcctgaggttcacagaaagaagtcatcttcataacataaaactttaaggtgaagcaggaagttttcatgtagaagctgcagaatgttattgagaagatatagctaagatcattgatgaaggtggatatacccaacaacagatttccaatgtagataggacagcctgatattggataaacatgctatctaggactttcataaatcaaagcctggcttcaaaccttcaaagaacaggctgactctcttgttatgggctaatgaagctgttgactttaagttgaagccattgctcatttgccattctgaaaatcctagatcccttatgaattatgctaaatctattatgcctgtgttctataaatggaacaataaagcctggatgacagcacaactgtttatagcatggtttactgagtatcttaagcccacttttggagacatagtgttcagaaaacaaaattcctttcaaattatgtctgctaattgccaatgcaacctggtcaacctagacctctgatggagttgtatgaggagacttatgttgtcttcatacctactaacacaacattcattctgaagaactgagtagtaattttaactttcaatctaattatttaagaaatacttttcctaaggctaaagttgccatagacagtgattcctctgatggactgggacaaaatcgtgtggaaaggattcaccattctggatgccattcagaacattcatgattcatgggggaggtcaaaatatcaacatgaacagaaatttggaagttgatttcaaccatcatacatgacttttaagggttcaagtcttcagtagagaaagtaactacagatgtggatttgcaagagaattagaattttaagtggagcctgaagaagtgactgaattgctgcaatcttatgataaaattttaatgaatgaggagtttgtttgttttttttctttcttttgagacggagtctcacactttcgcccaggctggagtgcagtggtgcgatctcacctccctgcaagctccgactcccaggttcacgctattcttctacctcagcctcctgcgtagctgggactacaggcacccaccaccacacctggctaattttttgtatttttagtagagacggggtttcaccatgttagccaggatggtctcgatctcctgatcttgtaatccgcctgcctcagcctcccaaagtgctgggattacaggcgtgagcactgtgtctggccaggagctggtttttatgaaggaataaataagaggttttaagtttccatctcaggaaactattcttggtgaatatactttgaacattgttgaaatgacaacaaaggatttcaaatattgcataaactgatttgataaagcagtgaaagatttccagaggattgactccaattttgaaaatcctactacgggtaaaatgatatcaaacagcatcacattctacagagaaatcttttgtgaaagaaagaaagaatcaatgtggcaaacttcattttattcttattttaaaaaattgcctcagccccccaaccttcagcaaccagaactctgatcagttagcagccatcaacatcaagataaaatcctacaccagcaaaaatattatgactggctgaatgcacaatcattcacaatttatagcaataaagaattttttaaattaagatatgtgcattttgtagacataatgctattgttgatttgatagactatagtatagtataaacacaatgtttatattcactgggaaaccaaaaaattcatgtaattcactttattgtaatatttgctttatagctatattttggaattcaatccagaatatctttgaggtctgaccctattcttttattttaaataattaacaaaaagatccaaaatgaatttccccttcttccttgttatcttatagaaagttgctagactatgatttgtgaaaattatatcctcagattttttccttggattatatttccagattcaccttgtaaaaattcaaacaattctaggagacaatcatacacaaataagtttgaatgacaccttgattgaggagtagataccttaacaaagagaataaagggtttctttattctctttattagtgagaatagtgagaaagaaatgatctgctgatccacaactgaaatttcttcagatagcagcaacttgcctacctagagtagagtttctcagtcttgacacttgacagaaatttcttcattgtgggcatttgttctgtgcattgtagaatctttagcagcatttctggcttctgtccagtagatgccattagcacccctctagtcatcaccatcaaaaatatttttctattttggcaaatataggagggcaaagctgcctctagctgagaaccactgacaagaagaagaatggagtaataatcatatttagtacttcacaaatatcattttatgcaatacttacaacaaaccaaagaattgtctttttttttctggactaaggcccagagaagttaatttttaaattgaagattacagacttaacaagtggcaaacctcagaactcaacattataatttatactggaaaattctacagagttgaatagaacgtaagaggtgacaaataaacattgtgtccacctaacaattttgctgagggccagcaccggtcagctttctttttgttaacatcaattttacaaggctttgcttactcgagatgttggtctatgtatagaattttaaaagcgatttaattttattttctactttgtactcagagcttggattgtagttgttagactatgatttgtgaaagtgcttggaagccaggaaaaaggcagagttttgctattacaatgatagatttgatggcatttcaaagtaaatattgcctataaagagagtaagagtatacaaaacctgggagatcagctataaactgtcagcatttttcaccttttctcttgaaacttatctatgaaatgttaacttctgaaaattgcagttgaagactaaggtagaagttgaaaatgagaggaaaagtgattagtttatttatcctattcatttattcattcggtcaacaagtatgtaatttccatgagggtaaggacttgatttcattcctgttatgactgccatttcgcctgaaccctatacagtacctgaaaggcagttatcaatattaaatatttatcaaatgaaaaccagtgtgaaagcataagaacatgtttcttatcctttacgtatgtgagaaaatgtgctaagtacactaactttaaagagctaatagtttaggaaggtgtgtggggcagggagtagatgtgcataaagacacttaatgagataatataatatgttaagtttaaataaagttataaatatatgacagtaccaagcattttaagtctaagtaaatcaatccttccttacttattaatcctacccattttaagccaaagtctagattattaaattatggctctaccaactttaattgagcaggatttatcattactgtctacatctatattagttttctattgctggtaacaaattatcacaaacttaacaacttaaaagaataaccatttatcagctcacagttctgtgggtcataactcagaaaaagaagggacttttaaaggatggtaatattatgtcaggctcatccttaatctccctatcgaaaagtcacctgcaccatattatataacctaatcataggagtaaaatctatcaaacacccagttctgtgaattacgcaggggacacgcacactagtgcgaaggaaatcttggggctatctgagaattctatctaccaaagcaatcatctttttctcatgctgttttttctcatatggtcctcattgaccacgagactaggttaaccatagctgtcacagtacctactatgatcttgatcttaataatcaccatctttattgtcattgcttttttaaattttgtcttcctttttaagcgataggcatggtaatgtcagggactggtctggcttggttactactacatttctgacacctaacccttccctggactacacaaaatagatgttcaataaatatgtgatgaaggaagaaatgaaagcaaattcttattaaataagaagtaactaatcagactactctttaagttaatccttgttcctattgttcacattttagctccaattttaccttcccacctcattgaaatattgcaaatgtccaccctggctactccatggatcatcattctttttatttacttcctatctcttatcactttatataattatctctgttgcttatgtgagtacttccttattgtctgacgcccactatattataagaccccagaatttttctgtctcatttacccaagtatctccacggttttacctaacaccttgtctataatgggtgctcaataaatgctgaaaatatgaaggcctggcagaattgtcttacagggcatggataaaatttcatgtcccaaagggtactctggatatttaaaacctctcgacaagcatttcaggacctttctaacattttgggacaattgtttcaatcttaacaaagctatctgtaattttcactctaatttcatagtacatttacctcatattttgctacccccaaatcaaggatgttttatgcaaattaattgacaaacttaaggcaattatgaatgaaattcattaagggtttactataacgtgaaaattctaatttcatgatataaatttatttctctaacattcacttgggtgtaatcttttttttattttctacaaagtgaaaattgttttttgtatttggctttaataattgcttgtgttctgatttttaaacttctattagtcggcatgtttctgtgctgctccctgtgtttccctttggaaactcaaagtaaaaacaatatgaaatgtatcactatttgtaaagcactttaatcttcctagagcttcctgtgccatcaccaactataactccaagcatgtcatcctattcactttgtcaaatggaaagtaaaagttttctggtactttgcagcttgataaaatgtctcttagaaaataccttaatcagcataaatttcagttgttgtgcatacattttttataactaaatgttctaatgcagttttaggtatcctaaaatgtaattatttagatagtaactgcaagtaaataagtccttcattcattttcttttaaatcctgaaagctcagtgctctaaatactgctttggtagaaaatcattgacagctgcagactcctggcacttgagacggattgataaatgcacaacaacttttagaaaactccattcattatttaccagtaattatctcccactagctcttctctcggcacttacccatttagtctatcaactgattaatgctaaataactttctaagtctttgagcttaaaatagtaaatcttagaaactgtcttggagttatgcgttgtgcagaactttagagtttttctgtctgatgaaaaaagactgaattttcatttatcttttgatttaggcttttattttttacacttaactttgccaacatgtacatttctacatttttcctacacacatatcgtttgtccatagtgagttaattgccttttaaactccatcctcttaaatataattttgcactgtcctctttgtgctcctctctgtactgtacctaccacctttcattacagtccctatgaagttttgaaataatcacttattcacaccaccgactcctccagcagcctgtgaaaatacttaacctgttcccctagtttataaattcaggcaactagaatgacaaaagtggatatcaataaatgacaacggaaaatgtcccaatcaagattaaattacagcagcctgctcatctactcttcaaatactctgcagccctcattccaaattccacatcagcttttaaccagtagggtaagtacatatttgtgaagctttctctatgtagtattagtgtgtatcttcactttcatcatttttactgtactatgaaaaatatgtcttcattttatggttttgagaacatgtcgggaagtatagctgaaaattccgtgccacaggattttagagtggaggtttctaatagttttgctattgttaggtcaccatggaaggaacatcattgaagtcagtcagtgtagttatggtgccctgagatcatcgcactctcgatgttatttaactaagatctatgacctcaattagagtgaaaaggattcatctctcagctccacaggcttagcaaaagtctcagccattcagttcaaaggattaaataacccatgttagatggttacaattaagactagtaaatactgttttatttccatttagtaacagaatagacacgcctcaaggtgcttcccattaataagatgaataaaattaaacagttacataacgtgtctatccataaatcatttaaattcaactaaagtacctgactagcagtgttttacaataacaggcatagctgccatttgacataaacctgggttcactctgagccaagaacaagatcaacacattgaagactgtccttttcaaaagtctggcaaaagaaatttggattgttgaccaaaacttcttagtcacttcccatgggaaaagaagttcttttggaggacagtactgaatagcttggcatatgctgacacttcgttacagtcttttcaatagcagaatcatttccaggccaccagacacagtgaatgattcctgaatgtgctacatgtggtgtggccaagatgacagtactgccatctggaataataacaaaatttcttcaaaacagacatcctttatggaaggataactcatgcaggtcatgcatcaaggccttgatttcttttgacatttccccactggactttgcagtcacaagcaaaagcacatttatagcaacaaaatactactgcagatatgaactacataaaccacaccctattgccttttgtagccttccagatattaggaagggtatagcatccattgatacatagatactactactaggcctttccatctgatgtgaagaggttacattattgtttgtcatgggaaaagatacaagttcaccagtgacagggacaccatagactactgtgaagataatggtagtacctggataaacaaagacatcttatctcaacctgtatcacggaacataaattcagcagtttatggaaatattctgattgaaaatagcattgctttattgcctaactaacccgtctacctcccctcctggatccccaaaatttatttgatacagccaatagatttttttgttcttgctgtctttattaatgacttcattatccagtgattttcaaacattctactaaacctacaaaacttgtctttgtattaaatcaatatagaagctaaaggtataaaatctgtaggagattgttgtcttaactcgagtgaggtttgaggttccctgacaggatagattggtcccctttgtatataatccctggaattatttctacagaaccctagagcaccaattgtttattttcaaaaactcctgcctttactgtcataatatttacacagtcacttctctttctctagtttgaaagaaaccctgttataaacgtgaattcatcagatgatgttcagagatgatgtctaacaaatggatgttttggaataggttattgaagtaataaaatacaaggtcttttttactatttgtgatctattaaaatggcacaaatagttggacaaaaggaaatattcagaaggatgaaggaaacattcctgaaggaaaaatgtgaaaattaattgtattcttctgccagttgtcaacaagcacctttgtctataacttgcctaatctataaatatatgtgtaaaattttgtcattagacatacatatctgatccttgctatcatattcccttcaggctaaagtggtgtgtaaaattttctctagatgaagtatgttgtgactcaattcactcacagtttcactctttggccaatttgatatagagtacaaaaataagatcccgtgtgtttttcaaataagttgaatgactgaatgaatatttgtgccactgaataaatgggacgactgactgaataatatttcggccataaagcatatgtgttttacagtttgattatcaagaaacggcaaagcaaaaatactcttgtttgaaaatatgcaatacaaacaatgacactaacatgacagcttgcaaaaatacaaacatcgttatcatatactagtgatgaattatttttgtaaaagtgagtaaattaaaatgaaaaattaatttcagctatcactaatagtaaattgataaaaaatggagaagacatgtaagcagttattattcatttacagaaccaaaggcaagatagatttctttggttttcaaatcatggcctacctgaaaaactctcttggtccggcaccctgtgaatgatactgcacacatgttgaggatatttgggatagtgagaggaatattgtgaggaagtgttgtcagaacttcagtaggattttacagtccatcatcactcaaattgttgatacagacatagatggccttacttgttgcctctctgatacactcttacccacttatcagttgcttccttctctgtcatccgtatcacttcatacaaatctttagaagcttccatactgcttttggtattctgcttacctaacagcctctccctctccatcagattctattcagaggtaagtattcacttttgtgccttctttgccttgtcccatgcctaggaaataagtgtccaattggtgtcagcagactgagtaaacaatttttaataaagataattttaagaaccaaatggtgttgttagaaatcattgatgttatccttttttttttttcttctgagatggaggctcactctgtcacccaggctggagtgcagtggcacgatctcagctcactgcaaggtccgcctcccgggttcacgccattctcctgcctcagcctcccgagtagctgggactacaggcacccgccaccatgcccggctaattttttttttttttgtactttttaatagagacggttttcaccgtgttagccaggatggtctcgatctcctgacctcgtgatcctcccacctcggcctccccaagtgcggggattgtaggcgtgagccaccgctcccggccgatgttatcctctttttgatagctaactcacatattctctggcatatttaacattaccatagaatgctaacccctggcattctgttttttgaaacaaattaaacctgtagttaatggctcattcaatgaagcttttatgtccatcatattatcatgtcttccttcagtcttcctgtggatctttttgatggcttagtagtttaaatgatttttattacattttaagaaatttaagaataccgatactgtatttcttcttttacatagtaaatacatcatgtaaatgattccatttatcattaaaaatggttgttaaattttttattaataacatattggttattgcgctgcaataatttatcccattgtcttttataattattcaaagtaacagctatcctaagtggtagttgagcagtttattagcacaaagtcactgaaaaaaagtgctattgattctccttactgcaattaaggaaaccctttattcactagaatcaaggaagaaagctagagtgaaatatgtcaaacaccaccaagagcagtgtgctctgctgccacatctaatggcgataccacaattctaatcagagaagacagtgcagttccacacatacaaaactaagaatgctaatgctaatttagcttgagtactccagtcagtcaaaaatggtaattgagcaagtgattatggaacccctgaatgcagagagaagtttagctgtactattatttttttttttttttgcatgtcaagctttagagaacagtagttaatgtgttggtaaaaggctatcagtaaaatggatttttaacacttggttgctcaatggaaccttaaaaattcctatgatctgcattccagggtatctgtcgtactagatttgctattgtcctgtttgttgaagcttcgtctatatgaaaccagttagatatattgttgggtatgtacagctattcaaatgtgtttggaataccatcatgcaaaaatatacataaaatgttagtcattagaatcatttaacagatcagcaaactgcaactcacagggtagtgattcccaaatccaggttacataagcttcctgggtcccattttcacagttggttgtactttggctcagaagagattttggtgtaggtgataggcaaatgatactgaaaggttttctttctttctttctttctttctttctttctttctttctttctttctttctgtctgtctgtctgtctgtctttctttctttctctttctttctttttttaatgtgcagttgacaagttaactatttcatagtctaatgtattgctattactccataaactttgaatatattaagacaatccacaatgtgctagttctactacttctttgaatagatatattctacaacagggttggttttgaatcatggggcttagctacacagaattttcatgggcagaattatttgaaaaacaaaatacccgtacccaccctttcacaccaacctcataacaaacctgaagcatattaagccttaggagatttggttccctaccagacgcagctaccagagattttggttattttgctcccatacatacgaatttatctattacaaaatatttgttctctaaagatttcattcttctgccaattcaaagttttattaaaacagattagtggaagattaaaatagaaacaagtaggctattctttctcctttaaaacaacaaaggcaatcagtatgttgacattatttgtgactagtttctaaattgtgccatctttatagtagtttgtattatgtcttttgataaattgtgtttgacatgtagatgaaagagcagaggaaaactacattttatgtagtgtgtgtgtgtgtgtgtgtgtgtaggataatgttttacaatgaaatctgtagaaacaccctattaatttcatgaactaacttctaaagaatatgtcaaaaataagttggcaggtacatcttagcatttatcaagagtaatattgccagaatatgtttctatttatattgcttaaaagatgcatgaaaaaaatctacttttttcaaacatggaaatgtaaataagggatttcaaattgtttgattttcttctaggtccctgtctatgacatctaaattacatattaggatgataagtatatacaattttctgtggcctctaaaggaaattacttttaattttgtataaatgtgagaacaatatgtgtttccttctgtgtgtccatctctgcctctttctctctttctttttgtatttataggggtaaatttttcatctgacagattaaaaacattagattacatcccgcttacagtaattacagcttactggtgatactgtcattagctgagcaattttaatgtctaatttatagcaatataacgagtgattaattcaagatgaaatttatcataaagtgtaatcacgatgaaatggataggtactcaatacagaagcttttagcagtcatatgtgaggcagtacccaaaaaacatttaaatagtttaaatttcaaaaatccagcagatgaggtccacatggatataatgagctgatcgaagttttctgtcaaaaataaccaaagcaactggtagttcggatggctcatgtataccttctatttgaaacaggcagagatcttagcccatctttgtgtccttggtgtccaaaacatggtagatctaacattcttttttaaaattaattaatgggggaatgaataaataacaactgagttaccctggcttataaagcccgacattatcccagctgaaaactattgactttcttttgcattattcaccacctcaaccacattcagccagagtgttcagctttcctttccttgatcatgccaatctctttcccacctatcacagcaatttctctccctataatcctcttcccctaaaagtagtcagagcatggttgtgtctttctcatcattcaagtctctcctattcaaagaagccttccagaccaccttaacttcaactatcattttctgaaatgtttgtgcattatatacttgaatattaactataagttgggtgcagtggcccatgcccatgatctcagcattttgggagaccaaggcagaactacatgaggccaggaattcaagaccagcctgagcaaccaatatagtgagaccccgtctccacaaaaaaattaaaaaaaaaaaatagccaggcttggtggttcatgcctgtattcctagctacttggaagactgaggcaggaggattgcttgagcccaggagctcaagtttgtggtgagctgtgatcgtgccactctactccagcatgggtgacagagtgagactctgtctctaaaaaagaacaaaaaaaccataatgtctataaactatatatataatatattaagtacattatacggacacacacacacacacacacacacactttctctctctctctcatttagaatgttcatcttcctcttccacaggagtttaagctccataaggacagcacttttgttattttattcacgttgaatgcagaacagggcttggcttacagtatttaggtgtttcataagaacgtagtgaataaatgaatactttggaagtgtttccaaaatttgttctcaagtgtatcacattgatcactcctattgaaaagaattaaacattataatgtgaataggtgagatatatgtttcagatatatatttattttagtttattttaaataaaaaagaaatacatagtgaacaacaggaattattttaaaaagcattaacagatggcattcaattattaaattatagttcatctttcatagtagagaaatatgaagttgttcaatgcttggaaattgttgtatgcattacatgtgataaaagaaaaaaatagcactaccaaggggcaggggaaaataatctttactagattttacagtttaaaattaggttgctgaaatgtatatggcaaaggtgtgtgtgtgtaattgtgcttatatattgtgtttataactttagtgacaggaaacaatataaaatcatatgaataacttgtgataacatcagcacataatgatccctttcttatctggtgttttattgtactattcaaaagtgctaaataaaaaattcttctaaacatttttttcattaagatggatggatatgtattttctccttctctccccctacaccccatttctctccctttttcattttttaaaacatgtattaggtaaacagaatgttggtagatagaaatatacagatagatagaaacaaaaagtcttctctcctggagttgcgatgcctggtttaacattctgacttggtcactaacttgttttgcttttttatttttttgttttataattgttaactatgttttatttactttttttttttaaaagaactaaataacttcaatggtcatttagccactgggattctctgattctttttttttctgttaatgtaacaagttaaaaggttaagtaaatctttaggcctcagattttttattttgttttggtttgttttgcatatgaaaattataacttaacctagaaggtccctaacatgatgcaattattattctattaaatacagttgagttaattgattacaatttgttttaagttagttaccagaagtttaaaaaccatgtcctggtatttatgccagctgtacattcagggttctctttggctatgacatcagggcagagtactgacactcatgagtcaaggagcagggaagagggtataggaagccaataatttagaaacttaatgacttacactccactttcgaaaccggcaaatattagaattttttttaactcaactttccaaggtaataattttaagttttcagagttcagtgacttagagacacattgcaacaaaatgtacaaaagtcttcttggctccatactgtgaaagacaggggaaagaatattgtctaatgttttctatggataaaatggttgcttaatttaaatgaaaatgttttttactaccttgaggggctctttttcctgtgagtttctttggtgtttcagagagagtaagtcctattcaattaaatgtatagtgaaatttgcgtataaaaagaaataaactctccaataaatctgtggtcaggtgtatgtgtgagtgtgtgtctgtgtgtgtgtttgtgcttatttgtgtacatataggttaaactttgcatttgagaagaaagtttctgaaattgatttagaataatttttatgtttattaacttatttttagtagagaaattacagcttgtttcatatcataattatgttaacaatttattaggataaaatgaaaatgtatgccaaacatcaacattactctttattaatatcaatttatgaacacatttatgaagaaagaatatatgaagaaagctgttcaaatgtaataaccaagaagacatataaatggcaattagttaaactgaaaactttccaatttcatcttagaaaaaggaaactagcaatatgaaaataacaaaaatcaagcttaatttatggaattctccatgaagaaaaatccttaattatatactgcatatttttggtaaggagaaatgtttttattctacctaaaatttttctagaattgtagaattaaatgatggaaattgaaaattaattatttggatgattaaaaataagaaaatcattattttaatttgaaaaaaaaatgttaatactcttctgcagggggcaaatccatgcaagtatatcttcaaagtcagaggaagccaagaggcttaaggaagaggtgaacatattgttctcagaaagaaacattttataggaaatttgaacagaagccatgcctgtgcctccagcaatgagacatgctggcacagctcagtgaccttaccccttggacccagggcttatataccatagggaaagaatgtgtaggacaattgcagggaaaggcaaaggtgctctgtgaatatgcctaagggcaggatttatggtcaaagctgttttgaaataatgcggtaatttttggtaagtacatgctcttactcaagaaacaaaagataaactggagatcttagaggcctttctagaactggagttaactagaagtcaacatggtggattagtacccaagatggaattgctttagcttccacagataccaacagaaaatatagtattataatagtattgagtataagaataaagaaattggactatgatagagctcaaatttcataaaatgaaaatttttttgtttggtttgattgtgcttctttggatcatatatcatgaaatatatttattattgtacttataatatcagtctgtaatcatttagatgtttagtttattaagctcttcaattctattatgtagtatagttttcacagactcatttactgaggtagaatagatcttattacttttattttaggaatgaggaaacagagatttagctaaatcaagtgtcttaaggaagcagcaaattgaaatgccaggatccagtcccagcattttcattctaacttcaactttttttttaatataaccacgattatatgtattttcaaaaaaatcatttaaatgttatattattaaaattggacttgaactcaccttgctccagtataaattctacattcaaatcttgatttttatgtctaggtttacattagataaataaaagataaaaatttagatacgcttctattgtcaaaagccttgtatatctaaagctaaaattacttctgatttcctatccataaaagagaggtagagggagggaaatcttgctgaatttgatactagtttaaacatcctctaattgaggtttttttgtttgtttgttttgttttgttttgagatggaatttcgcttttgttgcccaggctggagtgcaatggcatgatctcggctcaccgcaacttccacctcctgggttcaagcaattctcctgcctcagctacccgagtagctgagattacaggcatgtgccaccacacccggctaattttgtatttgtagtagagacggggtttcaccatgctggtcaggctggtctcgaacacctgacctcaggtgatccacctgcctcggcctcccaaagtgctgggattacaggtgtcagccactgcgcccggcctcctctaattcttattaaagagccctgtcctgaaacttctacttccccctattcttcttacactcaggaagagaaaggagcaggaactgataaagggacccttctcacttggaaaccctcaacctttgaatatccagattttctgctgcacatataattgatattgtcacaacatttgggctcttttgtagcagtctgtgactgatttcgtcttgttttactttatttactgtaacttcaaatgttgtagcgtcttccaattagtagcctcttcatgaagataggactgagtattttgcataagacattcattcaaaataaaatgaaagattaaattaactttattaaaatgaaatgattcggatagcatcctactcattagcctttagttcattttaaaacaaatataatattatcgtctatgctttcaaataaatgtcatacctccatctaattaatagtgataagcagttaagaaaaaataaaaattgggttcaatatgacttttacaacactattttaaacatccaaagagtactcaattattttcctactttccattacttttgaaagcgaagtattagatagcttttaaaaaattacaacatttgtatgtatgagtaaaggttagaatttaaagacagaagctacaaataatatttttcatcttttctatatgaaaagacaccagacccatttaatgcacgccatgagcgtttggggactttgacaagctgacttgtagatgtaaaaaatctaattaaaattgttgtcaattaagttacagtggtactcagataattgcatcactcttcaaagatttgtcttccaaacattaattttaagtatttcaaaccattttattttcttttttcaaaaactttctgatgcagacctggtgttttgttgttggtaattagtgtttacaatcattcacataattttttaaacatttgttttaggcagaattcaagtgtgtatccataaaatcagtaacattttgttttgtaattagaaaacaactggactttattagatgtaaatattgtttaaatttacggtgaaatttcgtgtgccaaggaactagaggtagcaactgaaggataattcatgaaactaaatattaactcaaaaggtttttttttttttttttttttttttttcccgagacggagtctcacactgttgcccgggtttggagcgcaatggcgcaatctcagcctactgcaacctctgcctcccgggtacacgcgattctccttgcctcagcctcctgagtagttggtattacaggcacacaccaccacacccggctaatttttttctatttttagtagagacggggtttcattatgttggccagactggtctcgaaatcctgacttcgtaatccacctgcctcagccttccaaagtggtgggattacaggcgtgagccacgtcgcccggccaaaagtattttttcataagcaaggttgtaaagttaaggttcaatacaacacatttggttgtgtaggagtgaacatctggaaatgtttaataaatataattttactgcatgttagaaaaatatagctaattcttttagaatattattttgaagaaaataataatatacatggtgtgcagatatggcacaatacatgggggtgggctgaattttgggaaacactgatttaatatcacatttattgtatagatgagggaactgagatccagagaaataaaatgaattattctaaatcatgcagttttaggatagttaattaaatttgaaagcaaataccatatctacctagaataaataaaaatgacttttttttgtcaataatcattaagcatttactgaagacttacaacatgtgtaaggtgttatgatggattaaaaaatgcttcccaactctattagttcaattgaggaaagttcttgctttaaggatatttgaactagcagagagcgcctttactggggcctggaaacatgtgggacactaaaatagcattcacggtcatacagtgttctcttcttaatacgctctcaattcaatctcctatataccaaatactataatattaaaattctaatatttttggctttttgctctgaagtcatttaatcctcaatttccagagtgatccctttgtaatgtttagaaatgtcaccttatatatttaaaattatgtattttgacagtgtggattctctgtttcgaacagcaaatttataaattatgaaattaaaaaaacccaattatcttttttttttattattttatttatttatttatttatttatttatttttgagatggagtctcgctctgtcgcccaggctggagtgcagtggcaccatctcggctcactgcaagctccgccccagcctccagagttcacaccattctcctgcctcagcctccagagtagctgggactacaggtgcctgccaccacacctggctaattttttgtatttttagtaaagacggggtttcaccgtgttaaccaggatgatctagatctcctaaccttgtggagacgcccacctcggcctcccaaagtgctaggattacaggcgtgagccaccgcacccggccaaaaacccaattttcttgattattactacagttcagctatatcagtgcacatcttatctaccaggaaaatgggtaaaatgcatcatctgagatctttatcaccagagattctgattcattagtttttatttttacaaaacccacagggagcagcagaacacacagggaggacagggtagagactaagaatttatagttttagcaagtagcaagctaattccaatgttggtggactgtaagccatgctttgagaaaaatttaatcataagttataaaatatagaagtgagaagtaaacatggttgaattgaattaatccctgaaaacatattgaactttattcagtgctattttaattgtattttttaaagtaaaggagaacatgttacttcaacatctatcaagagtgaattatggtttttatttgtgttttaaaatatcttggctgtgtacatttataagaaacaaaacaaatttttttaaaaaactctccattaaaagaacttcatgctaactctgggacctcaatctatgtatagagtctcaacaggaaacttaaatgacaaggaaatgagaaaaattttgccttcttattccttgttgaatcaaggcagagtccaaggttagtacactgcatctaaggtaggaaattgcttaagcagttttcaaaggttcattctgccttcaggcaaggattttctatttaaaagggataagtttagccaggagcaaaatattcctcattgttttttctctaaagacagaaaactctcagtaattttaacctccttgattgtatgtgtggagcaatatgaagctctgaagtaactttgtaactgtgctgagtccgtgaaggaggtacactagttgagtaatgaggatgagcgaggcatcatttatcaaaataatcttcaaaatcttgccttacttcacacacattcttatgtacaagataaagagaattaagttatccaggtcagcatcagcccaaatatacagtttgttcttttgttcttctacagtcagcataaccaggctacaatcaggatacctcccatccttatcagaatttcacaaagaagttcattagtgtgtcctgtcactctgaaaaccatatagtcctgcaaagtggtttgtaagtccatgttgatggatttatgccacacctttagggacaaagatcaagcatccttagctactttataatttggagaatgacttaagatttcaagattggggaggctttttatattttactctccttaagcttttaaatcctctgctcagtatatttacttcttctcagataagttttatagagttggagaccagaaaagaaaaaccgtctggtgtttcttgctccccaggtatttctaaacatttcaatagctttgctacaaatactcaatttgtaccattcaaaattaggacataaattcagaaatcggaggataaaaataaaggcaacatggcagttgtgattgatataactgggttaaattcttctacagagaagagtttttcaagaagcagttagatatctactttcacaggttgatttaaccaggatgtcacttgaacaaagaaaaattccttccctacattgtctgcattacattaattctccattaaaaatgtttattattcagtgtaggaggcggttttactcagtcatctttcaaatatctgcttcactcatctgttccaactgatggtgatagtagtttagaaaaagtatttttaaaaaacaaatatttgaaatcatttttatgtagcccagcagtacatttcatcgacttcaataaatttgatcttattgtttgtttagagtaatattggtgtctgttatttgttgataagtctggctagaggatggggagaaaagagagagtacctggatggtagtttgaactttaaaagtctctattattaagaagttcaagatgattttacttctgtaggatataccgcttgtttaagatttcgtggctcttttcaaaagcaaaacagtgacatctgttttatgatgcatatttgtaaatttcttatactgaatcacacttttttctttttatattcatgtattcttttagcaaatatttattgaattctttatttgcatgatatatagtgatagaaataatattccctgagctcaaagtttatcatttagagagatgacatccatacaaggaattagagaagatagcctttattgaatgtcataaatgaataggaaaatctctagcaagagttcaaatgaggatgaaatcatgtaagacaaaatcccatttatacaaacccgtgaggctatctaaattctgttggtatacaaaatgttatttcacgttttgctgctcaccaagctttgagggaaatggcatcattttaaattaattactcttgattagcataattatctggctttctagagctttatcttattttgacatcaaactgttaaaagcatatagaattgtatgtatattctattttcaatttcgtttaatgcaaatgtatatagacaaagactagaaaaaagatataaaatatggtgattttattttcaaaactgttaatgatactatctttctaagtatatatatttttaaaagtaggaggtatgagggtattgatactttgcctctcccaatcagggaagacagagtaaatactgatgtgactgacccttgtgaaggttgactgacaccaataaaatgacacccaaaatagtacttcttcataggcatcagactgagaaaggaaaaaatgaaataaagtaaatagtactacatctggcacatctaagcccacaataaacattagccctaataagtgctaagcagtcttctcaatgtatagccaggtggactagtagcagtgtatacccatacagctgacttcagagaatttcaaagcacctttgttctggaagtgttatcttctgccagagatcccatatacacttgcctgtaaggcaagggaaccattgtcatttttattcatagctttattcccagggcctaacttactatttaaaacaaagagactttcaattatatttaaaccaactaatcaatcatttattaatttaaaaatctcagtcacaaaaggaaaaataagctttaatcacattcaaatgtttcaacacaatgtgcaggagaagttaagtaaacatcatgcaatgtttctatgttaatttgttctacctggattagtggtgaaactcctcattacggaaagtcaagtatgcaactgttctttggccaagagcttttgaatctcatagtgctccgaattaatgaatccaattggaatccagtaggtaacttagcttaaatataagaataaaagaaaattgtgtatttataattttttttaccaaacagaaagttcaacacagttttgtatgtataaaaatccaaggaattttttgtccagttttggattcagaattttttacagaactcatgattctaggatgcaaacaggaaatcaggatctcaagtcaggctaactctgcaaactgtgtttattcccgttctgtgataatgtgaccttcccaaagcaactcaagattaagtagacaggtagggatgaaaatgaaatatttttggtggagcatttggaggagtattaagaactgcttgcacttgattacctattaacaactggtctttgaggggctttattttcctgtaaagatgatgcaaaagtttttcctctttatcttagatgtcttcaagagacagaatttaaatcataaacattctagtccataatattttttttctcagtgaacaaatttttttccaccttctgactagatatcaaatactaaagcttagtttcgacttttcttgtcacaaaggaaaaataatgaatgattataattatctgattttagctactgctgcagctgaaggcaactgaattttgaaattttgtcatataactgtatatcatagaaagtgtttgtttcgtttcaacatatttctaattcatatttaaggataccaattagtatctatatattctagagggataataaatatggccttttcaaaaaaacaaaaacaaataagaaaaaaacacaacaatttggccacagagatctttcttccttttttattttggacataattttgctcttttctgcccaggctggagtgcaatgacgctatcttggctggctacaacctctgcctcccgggttcaagtgattctactgcctcagcctcccaagtagcgtggattacaggcgcctgccaccactcccgggtagttttttgttttgttttgttttgttttagcttgagactgagtctcactctgtcgccccaggctggagtgcagtggcactatctcggctcactgaaacctctgcctcccgagttcaagcgattctcctgcctcagcctcccgagtagctgagattatagacatgagccaccatgccccgctaatttttgtatttttagtagaggaagggtttcgccaagttggccaggctggaatccaaagcctgacctcaggtgatccgcccacatcggcctcccacagtgcggggattacaggcgtgagccacccagctcggcctctttttttctttaacaataaaaatacactcactcattcaccaattcaatgttatagttctcagagctcgccacctgagttactcaaccctaaccaaattgtcattttcctggcttcttttctttcatgatgccatcttcacctcttgattttacatatataacatttacctgtcactttccaatacagaagctaagtacttggccaatcaaatccttcactgaatactagagggttctcaaggtggccatgtgagaattagtgcaatataaagacaaaagaaaaaatatttcgtctgcttccttttttttcctgacccaataattgatttgcattacaacacaagtcaaggtaaaaattctatatttatgattttatagttgtcaatagatcatatgacagtattgtgattagagaaatggaaggttgcagtgcttaataaaacaaccataatggctgctaaaaacttttgttatagttattaggtagaaaacattactttttaggtattgtttttattaaataggaaatgaatgttgagaaaaatattgtctttcaaataatgaggggaatgacagaattaatgtgatgttgaaatgttttatgaaatatatgttttgatgtgatatcctaataggtgtaggatcataagcaatacactttttaaaaagtattatacttttaaacatattgttttaaaaataaaattagataagtgatttaaatactgttactaaatagtatgttaggaattaattttctatacctttcaattttcattatgtgctggtaatattcttaggacacatatcatttagtaaggattagagccagctggggcagattatggctcaggaataatccttaaggaatgcccagattcaattattcctacttaaatgatttagtttggatgcatttggtggagtagagttttattttagaagaaaggtgatattttttgtctttagttctactcttgaaatagtctgccagattgatggagcctcatttagggctcatcagaagctgtgaacgctgcaatatggtttgattatagtgctaaatatcaagcaacagagacaagaataccatttagccaggtgtggtttacacatatttgaataaaaaatattttcctcagaacttaagataatttgttttgtacagaaagcatattttacagatcttaggaagcaagacttttaaataatgtaagactgtaaataattttagtaaaatatttttgattaaagaaacattactgaggcaatactggatagtcagtggctctctcattttttttttaatttcaaatgcctagaactatattaggggttttcagttagaaaaacactctgttaattaaaaatgagacattttatttactgtgaaatattttagacccttcatcacattaatatacatgcatacctcagagatactgtggcttcagttccagacctccacaataagtgaatattgcaataaaacaagtcacaaagatgtttggtgtcccagtgcatgtgcatataaaagttgtgtttaaagtatactgcaatctgttaattattcaatagcatatgtctaaaaaatgtacatattttaatttaaagtaaaacctttggtggttaaaaaatgctaacaaataatttgagccttcaacaagtacaaatctttttactggtggagagtcttgcctccatgttgaaggctgctgagtggtcacagtagtggttgctgaaggtcggggtggctgtggcaatttcttataataagacaacagtgaagtttgccacattgattgactcttcctttcacaaaagatttctctttagcatgtcatactgtttgatagcatttaaccacagttgaacttccgtaattacagtcagtcctctcaaactccatcactgccttatcaactcaatttatgtaatatttgaaatcctctattgtcatttcaacaagatttatagcatcttcactaggagtagattccacctcaagaaatcattttctttgctcatccataacaagtaactccttatctgttcaagttttaccatagtattaccacaacttagtcacatcttcaggctctgcttctaatgctcttgctgtttttatcacatccacagttattttctccactgaagtcttgaacttctcaaagtcatccatgagggttggaataaacttctcccaaactccttttaatgttgatattttgacctcctttcatgaaccatgaatgttctgagtgtcatctagaatggtgaatcctttccacaaggttttcaatttattttcccagattcatcagaggaatcactgtctatggtagctagagccttaagaaatacatttcttaaataatgagactgaaagttgaaattactccttgattcatagctcgtagaatggacgttgtgttagcaggcatgaaaacaatgtgagtcttcttgaatatctttagcggatgtcttgggtgaccaggcgcattgtcaatgagcagtcataatttgtaagttatactgttttctgaacacttggttttgaacagtgggtttaaaatattcagtaaaccatgctataaatggatgtgctgccatccaggctttgttgttccatttatagaacacatgaagaataggttagtataaatttactggatccaggattttcagaatggtaaataagcattgacttcagcttagggttgtcagtttcattagtccctaataagagagtcaacctcttctttgcaagtttgaagccaggcattgacttctcctctttagctatgaaagtcctagatggcgtgcttgtccagtataaggctgttatatctacactaaaaatcggtttagccacttcatctatgatcctagctagacctctggataatttactgcagcttctacatcagcacctgctgcttcactttatacttttgtgtcatggagatggcttctttccttaaaacccatgaaaccatttttgttatcttctgacttttcttttgcagctttcttacctctctcagccttcatagagttgaagagagttggggtcttgctctgcattaggttttgatttaagggaatgttgtggctcgtttgatcttctatccagatcactcaagccttctctatatcatcaacaagaatgtttggttttcttattatctgtggtgttcactggagtaacacatttaataaccttcaagaacctttcctctacaacacaacttggctaactattcggtgcaagaggcctagcttttgccctgtcttggcattcagcatgccttcctcttgaggcttaattgtgtctagttttgattttaaaataagggatgtgcagttcttcctttcacttgaattcttagaggccacggcaggacttttcactggcctaatttcaatattgttttgcctcagggaatagggaggcctattgaacattgaaactctgcctctttccagagtacaacaagttaactctagctacctgaagcctcctttaatgttcacttgaaggactaatggaattgagtggaagctcttctcaattaataataatgctatttaaaaatttcatgttgaatcagaatgtaatgctttatgtgaaaagaattactaagtatgtccatacagtgtcagttgagaaatgttctgagaatggtactatcaatgtagatgataagctggtgacatttggtctccccaaaaaaaaaaaatcgcatctaaaaggcaaagtgttttaaataaaggtgtataggattaattactgctgcacagtgttacagaaacaagctgaaaaacaggaacagattcttctttcctcttaaacaattcaaccatcaaaataaatttattgaaataaaaaaactgttaaaatttaagtaagttaaacttgatggttttgcctcttgtgtaatcactaatacgacatcttcagtccttgtcaggatagaactaatggagtacaacgtgttgtaaggctgtacttttatgaattaatgatctgaggtttgatggtaatgtttctactgtctttgtaggtttgatcttcctttgccactgctgacagagctaagcctgggggtgttctggttgcaacagcctttccttattgttgtttgattttgagaactcccatgttattgatacgtggagggaattgtaaaacttgttgtgaattaaagctaagcctcagattttttgtgtctggatttgaaattaactcagctctcacttgttcacattgctataaatatgcttagcattttttgtgaggaatatctaaagtgccaagaatgaaaagtgggctgccctgatggtacttttcatttcaaaatcaaacatattccttgcttttgtctgtgatgattctgttgtttaaagaacatgttcttacccccgtttttattgtttggggattctttgttgtaagatgactctcagaaattactttttgattgatagtcagttaaaacttctgatcagaatgaagttgtcttcttcaccactttcagttgtaattctggccaaaagcaaaggaactttgatttacttaatttgtgcacttggctaacatgccgtttatattagactgtttggaaatagcccaagtggtggctgtattgctctttgtgaacctgttatgggtatagtaactctcaagtaggaaccaactgtgttaaaatgttaacttccacatggtaatatactatttctttgttttttaagaaaattcaactgaattttaagctaaatgttcttaatgcaagatcaatatcttgattctcatggttttcttttataaattttggtttatttttaataaatgtggacttgcaattgcaattacaactttcagccctttctagtacaaaataatataataataataagcctcaagaggcctatttcctgaggcaaaacaatattggggaacagccagtgggtggagcagccagaaccagcacaacatttattagtcaattttgccatcttatataagcatggtttatataagcatggtttgatattacaatagtaatatcaaagatcacttagtatagatcaccacaatagatataatcatgaaaatatttgaaatattgcgagaatcaccaaatgtgacacaaaaacagcaagagaggagatgctggaaaaatgggcacaatagatttttagatgcagggttgccaaaaactttcagttagtaaaaaacacaatagccttgaagtgccataaaatgaaatataatgaaatgaggtatgcctctccctgtctccaagaaaaatatccaagaaagacctttatatttgaccagagaatctttaaatttgaaatatcttaccttgctattattattattttaaatttaattttatttaatttaattttatttatttgtatttattttttgagacggagtctcgctctttcgcccaggctggagcgcagcggagcgatttaggctcactgcaagctctgcctcccaggttcatgccattctcctgcctcagcctcccgagtagctgggactacaggtgcccgccaccacgtccggctaattttttgtatttttagtagagacggggtttcaccgtgttagccaggatggccttgaaaacctgacctcgtgatccacccgcctcggcctcccaaagtgctgggattataggcgtgagccaccacgactggcccttaccttgctattattttttgggggaaaaaaaaaactgttgaaatcactaatctaaatattattgcttcccttttacaattatctcctgtcttcaatttccttgctgtgtttaacataaataactctacatatgatttctgtaaaaggccacataaacccacagtactgttaatatggtgttttgtttttttgttcatattgttatcattattgctggttccttgtgctatttcccatcctggaggtctacactctcctgagagatggtaaagagagaaagcccagcaacataatgtctggatggctcagtatccttacataggacacccagagggtgccccaactcagcgtacctgattactgggtttatttttgcagagcttggtgcctggtgactagaaaagcagacattagaaatttgcatatctttgtttttgttttgttttgttttttatcagctctggattgaagaaagttggtagaagtagcagcaggtcagagaagttccttttaaggttctggccccagtacttatgtgcagaaatcatttgtgtcatgttcattgtgtcactcattgtgcacccctctcaagtgctttaaaatgtcttctccctagttagaatcaatggatcttgattctgatctctgcctctaattgcatgatggttttcatatcatggtgtcatcattagataatggtgctaggaccaggtctactgcaaagtagagtagaggaagcacagttttgacaaagatcttttcttaatcagatttcgcctgtgtattttggatgctttcactattgatgaaaagagaatattggcaaaatatgttcaaagtgcctcctgttttctttacctttttctctcttgctttcttaaaatctgattctgtccttaagttctggctgaactgtgcattttcaaattttctaactcattgtctttatttctttctgtcctcttttataccatgttctctcgctaataatagcttctcatttcatgcacacactgtttctatacatctgtttcctagtgcttaacacaaagaataatgcagagtaaaccatttatatatgttaactgaattaataaataaatgagtgtgatagtatctatgaaacctagagttcgaaggattatgatgcagcctatatggtgtatgatgaaccatctagcttaacttgttcaaagagagaagtttatgaaaagaattgttatttcatctttctcaactttctggtactcaaacgattatattgtatctattgtttaaaactgtcatttattctaattattaactccagaacacataataaatgtacttattagaaatacaacatcttagggtagaataaagggctcagaagaggtttttggggggtagtatttaatgatttaaatatttagtaagaaagtaattatttatataattatttggctattctagaagcctgtaatctttcgaatttgcccagtcaaccaagcctggggtttaaatgaattttcaacacctttctgctgacagtcacacatgttaaaccttgatttgcttaaaagtattattaaggatgagaatgtaatactgccagtggtatgtggtgatattattgtggcgctggggggatgaaactaacgtctttcagtaagtaaatgtttaattttacacaccatataatcagttgtattattgcaagtgcacagcaggtatgtagaaaaatagaatgcatatatttaacatattagaaataactttattaatattcctatttcatgttctcatgaaattttaatcatttgcattttttagcttcaaacatttttataatatgtttctcttgcaccctttatctagtagctgacaaccatatagtgatccacttatcagttctttttaatgcaaataaagcggacattttttacctattagatcacttggaaagaaaaaaaaactaaaatcaatgtttcatgctacatattatctgtatatgagcagatatacacattttacaggtcaattttattgtattttggtaattgtctttcctttatcttctcttatttagtctttagatttaaaattgaaactgttgttgttgtactgaatgctaatgcagtgcaaaccaagacagtatgttttacatggcctgaatagattctttgtcactcccttaggaaaaatacgttgttcatctcatggaaataaacctttatatatagaaaagtatttaagagaaagtaatttttaccgtttaagtattaaattttacctaaacttctattacgtgaatctcagtagatacgttcaccattataaagaagcagaagttctggccagggcaatcaggcaagagaaagaaataaagggtattcaaataggaagagaggaagtcaaattgtctctgtttgcagatgacatgattgtatatttagaaaaccccatccatcgtctcagcccagaaactccttaagctgataagcaacttcagcaaagtctcaggatccaaaatcaatgtgcaaaaatcacaggcattcctgtacaccaataatagacaaacagaaagtcaaatcatgagtcaactcccattcataattgctacaaagagaataaaatatctaggaatacaacttacacaggatgtgacagtccttttcaagaactacaaaccactgctcaaggaaatgagaggacgcaaacaaatggaaatatatcgcatgctcatggataagaagaattaatatcctgaaaatggccatactgcccaaagtaatttatagattcaatactattcccatcaagctaccactgactttcttcacagaattagaaaaaactactttaaatttcatatggaaccaaaaaagagcccatatagccaagacaatcctaagcaaaaagagcaaagctggaggcattgcactatctaacttcaaactatactacaaggctacagtaaccaaacagcatggtactggtaccaaaacagacatatagaccaatggaacagaacagaggcctcagaaataaagccacacatttacaaccgtctgatctttgacaaacctgacaaaaataggcaatggagaaaggattccctatttaataaatggtgttggtaaaactggctagccatatgcagaaagctgaaactggaccccatccttacaccttatacaaaaattaactcaagatgaattaaagacttaaacgaaaggcctaaacccataaaaaccctagaagaaaacctgggcaatatcattcaggacgtaggtgtgggcaaagatttcatgacaaaaacatctgaagcagttgcaacaaaagccaaaattgacaaataggatctaattaaactaaagagcatctgcacagcaaaatagactatcatcagagtgaacaggcaacctacagactgggacaaaatttttgcaatctatccatctgacaaaagtctagtatccagaatctacaaggaacttaaacaaatttacaagaaaaaacaaccccattgaaaagtgggtgaaggatatgaacagacacttttcaaaagaagatatttatgtggccaaaaaacatatgaaaaaaaaagctcatcatcattggtcattagagaaatgcaaatcaaaccacaatgagatgccatcacacgccagttagaatggcaatcattcaaaagtcaggaaacaacagatgctggagaggatgaggagaaataggaatgcttttacactgttggtgggagtgtaaattagttcaaccgttgtggaagatagtgcagtgattcctcaaggatatagaaccagaaataccttttgacccagcaatcccattactgggtatatacccaaaggcttttaagtcattctactataaagacacatgcacacgtatgtttactgcagcactattcacaatagcaaaaacttggaaccaaccaaaatgcccatcaatgatagactggataaagaaaatgtggcacatatacaccatggaatactatgcagccataaaataggatgagttcatgtcctttgcagggacatggatgaagctggaaaccatcattctcagcaaactaacacaggaacagaaaactaaattcctcatgttctcactcataagtggaagttgaacgataagaacacatggacacagggaggggaacatcacacaccaggggcctgttggggagtcgcgggggctaggggagggatagcattaggagaaatacctaatgtagatgatgggttgatgggtgcagcaaaccataatggcacgtgtatacctatgtaacaaacttgcacgttctgcacatatatcccagaactcaaactataagaaaaaaaagcagaagcaattaatagtgttgcaattaattttcagttttaaaaatgtataagtacctgttatgtgccaggcattgtattacacactaaagatacaaaagaaataagaatttagacatgatctccagatacaaatagcagactaagcaaagtagaaagagaagtcctggatgaaccacaaggttgtttatctgttctctaaataagaagtgtgaagtgttttggaaaagaaagggagaggttgccttccttttcactagtcatcaggttgtcacctagagctgagcagcatttttttttaagaaaattagcacatgtactgggtgaaaacagcctattttctattttaatgagctaggtacatagaaaggaagacgtaaaattttcctaaagtagaatcagtataggctgtaatgttttgcagccagaatctgggacagacttgcctatctgagaataaattgttacatcggcatcataagagtcataagtactgggggtgcagagtacagagcccacttattgagtcacacttgcacatataatgattttcagtctctgatatatgtaatgcataaatggccattaaagtcagatttttcaagggcagttctgtgtcaaatattctttcctgttttcttaaatattgcattaacatattgagagattcccattattttacctttgaaagtatgcctcttataatgtattttgcacccaaaagtatctctaaacagacacatatttaattatatttgattatgaaaatgtaatagctggtttttttttttgtttttgtttttgttttgagatggagttttgctcttgttgcccaggcttgtgtgcagtggcacgatcttggctcactgcaacctccgcctccagggttcaagcaattctcttgcctaagcctccctagtagctgggattacaggcacctgccaccacacccagctaatttttgtatttttagtagagatggagtttcaccatgttggcctggctggtcttggtttaaactattctgttaaaaaaaaattgagggaacttattctggggtaaatgatgttttcaaatacattgttttttgaaaaatttgttctgagagatatattttcttcattgttaaaaaaaattgagggaactttttctagggtaaatgatttcaaatacattgttttttgaaaaatttgttctgagagatatattttcttcattgttgtggaaatatattatgtaagctatattattatgtgtgagaataaagaatgtattttctctgaaaatgtggcagctcattctttgttcacagtgctggttaaagagattaggccacaaatattagccatcacattgttaatgcactcaaactgccagttcatgaccctgagattggagaaattaataagaaaaatataaacataattttaaaaataactgatagaaaatccacttgggaacacataatttttaaaatctaaaatcatttaatgataaaatagtatgtggtcttgccaaatgatctactcttctactgtgaaaaccatagattattacagatttgtaaagttgttgacactttaaaattaattttatttgttaaaggaaacaatttactaacattaaactgtttagcataaaataaaacagcatgcagcatttcattacagcaaacatgaaatatgaattctaaagaaataaaatatgaaagaaatgcattctttttatagcctgaaaagacaatattaatcaaaataaccaaaatactttgaaaatcaatgttgaatgtgaatgtttctggttttctttttcttggacttgtatttacttttgtcaaggtaacataaagctacagtatatatcctctgtaacagtaaaactcagaatgtagattttttttctgagtatagtgcctaccctagtgcttaccctacttatctttataccccatagagtttaaacccgtgactagcagaagtgagtgctcactgatggaaattaaaatgaatatatgcctgaatggatgaataaataaagttaaccatctgctccttcttgttcgttccttcagaactctttattccatattggttagattatcacttttcaacccaggggcatggtggggaaataggaaggtatctggattgacataaatcctgagcccttgtcctggctctgaccctttctagttatcagacattaggcaaatcactgaacttctctgagcctgtgttctcacctgcaagatgaaagggttagaatagcatgatcccaaaagtatgcttctatattataacatagtagcccatgtgtaactttttttttcctcttaatctttacagtttgtcaaatctctgctccatgcttttcttgggtgtaaagagataattaattatttctgtttaaaagatttcctactgtgccacagctggcacaggtgaaagaaattaagtaagaatgcagtagcacaagacatcatcacccactctgcttaattatagaagtcagaacttgaaaatgagatttatgaggataagttgaaatgcagataatatgtttcgggataatgtagagttgatgatgtgttattttggaatcttaaatttccaagttctgcataagtaaaggatgatggtatcataaatccaagtggaaaatggatccttcagtgtctaggccagtgagtttgatgtggacccagtaaacttttaaatttgataattaattacctagagtgtgggtactaagaaaataaataactacaagctagcaagtcttttggttacagctaggtcagctcaaggagctgtgtgaaaataatggtctttaatttttactaggcatttaacaaaaacatacattatatttttgtccacatggtagagaaatatggaccaaagtacattcataaggttgatcaaacctacccaaatagtgttcatataaatctagagagaaggtctcctttaccgtgttatggtggtcttcttttattagcttttccatgattggatgtttatttgcttattatttttcagtgactgaatatgatatttttaaggttctagatgatgatttagtgcttgcatttgtatgaatgtttagtgttatcttgaatggccaggaggatagactataaaccaagtaggtctacattttataagacaggggttttacatttgaagtttaatgttaaaaaataaataaataaactacaagtacagaatcctgagggtcccagcttgacaatatttcaaatggagaatattggtgattgcagtaatctggagcttaattaatagaaggatagattttaggcaaaaacaggtaatattcctactatgtactatattgctcagacttcatgatgagtacttaattatggggaacacgtttaaaagaacaattgtctaactgaaataaattcagcaaaataataagattgttgaaagttctcaaaatcttgttcagtgaaccgtgcttgatttactatccagattattcaaccagtctttattttatggtggccataagcctgtttccctcctgagaatcaagacttcttccactattaatccttgtatttagggtaaagttgactctacagtctgcttcttgggcaggtcaaggggagttcttgaaatagaattaagatcagtaaagatgcactgtacggccataattgctatttatggccagtgtccattctaactggcctgaacccagttagtttatatatgttatgttaaacctgtctcccatatttaagttaatcaatatattatatttgtcatgccacagggattaatactgtggttaatgagaattggctggggacattttctgtcttttccactaaactcagagttatgaagtcacaaagctgggactatcttaacattaaaatggataaatctgtgaggccaacatggggtagaatgtaagacaagttttgaagatggcaaaacaaggttctaaagatgtaatctgagcctctggtcataccaaacctgtagctggtagatctactccagtacatgggttaaagaaagaatgttttgcttaagccaaaacccaaagagcttgaattgacacatcatgtagaaaacatatatatatatatatatataaactgaaagatgtttagcttacaagaggtgagggaaaacaagttatataagcttatcagacttctcctcattatttagagagaatcaaaggctctatctgatgtaggaaggtagaattttcaggtagaccgaattgggatcaatgaaaaaggatgtacatcttcacaatttgagttaccagtaataaaacaagctgtcttctgtgcttaaaaaatattaaaatagagtgtagtttataaagactctcatattgagttgaaagttctactatctgttactcaaatccttagaatgtgttaactaactactgtgccagacattataccaggcactttatataaatttcctgtaaagtcagtaccattatgaactgaagaaaccagggagtaacaatgttgaataacttgcccaaggtaaagaaatctagtaagtatcaatcaatgaacaacaaaccctatgtgtctgacttttctttccactaacattctagcaatacctggattttttatgaattcaaagtaattatacaactcccctgttgtcagtattttagccatgatttacataacagaaaaatgaaacagtttagttcaaaatgaattatttttgatttagggacagtaaggaatttctaaaaatgcactaaaagcactttagtacgtaaattccatcatgactaaaaggtgccatgcctatgtaagtataattgtgctgaggtttatacaattccataagtactaaaaagagaagttttttaaaaagtcataaaaatgcaaaacaaatatgttctgatttctgagaaagcctagaagagcccccaggcaatatgtattcaagggctatgtagccaggtgttcccctctggggttgtattcaacgtgatttcttgagaattaagacagtagtgaggaaacacagaagaaaaaatttctgctgtaaataaaatcctgatagaaaaagcataccagggaattttggttgataattgtttcgctaatttattgcctctcactttatctcgaaaaataaaacattgtttggcccttattcaaataattttcactagtgcaggaattctggtaacctgatcatatatatctatctttattatgagatcttcagttgtttaaagttaccatattttataatattatatatatatatatatagtcaattgaaaaactgatgtagtcgagaacacaccttgcctaatataactgctacattgaattcatttacatcataacaatttctcagttctttaaaacagaagtttaaaagcagattcattatgtggttcattagattgaattctgtggtcagacaaacccaggttttgtttcttttgtgtgtgtgagacggagtctcgctctgtcgcccaggctggagtgcagtggcgcgatctttgctcactgacacctctgcctcccaggttcaagcaattcttctgcctcagcctcctgagtagctgggattacaggtatgtgcgacgacgcccggctaattttgtatttttagtagagacggggtttcatcatgtttgccaggctgatctcgaactcctgacctcaagtgatccaccttcctcggtctcccaaagtgctgggattataggtgtgaaccaccgcgcccagcccaaacccaggttttaattatgaccctcctgtttgctgggtgaactccttaagactctgcatgtctctgttttctaatctggtaatgaggatcctaatgcttaccttcttcagagattattactggtattaaattatattattttaaatgtctctgtctgcctgcaatggtgctgaatcaacagtagctgccttctctgttttccccaaacaaattctccccatgtctctctaagttctctgcactaatttcaaagttaatgaaaaacaactatccatctctttaatactattcagattttaagcctgtgattttgtgtataaactattctcaatcatacaaaacagtgtacttttagagaaagggcaaagttcctattttgtttgttttaaaaaaaaagtaagttagaatgaatgggagttcatttttaagtcaacatctatttcccttttttgtcactctactttctttcagaatctttccatgccacttccagcaggacttacacgtgggtgccctggcttccttagttgcattgcagaatagttattgtaaacagaaaatctttcactgccaaatttgaacttggagtagggggtcttccctaatttgagaaagtcattcaagtgtgtaactatataggaaatgtattactttataagtttggagaggcttggaaatattgctggaacacaacgaaaaaaggaaatgaaatgaaacctcattaactctgtccctaattcttttgtaagcagatagcagttcccttgaaatggaaaactgggaaaaaggccacaaagaaattatatgattattctcctaagatcacataggaatgaagtacaacagttatgagcataagctaagatgatttaggatgctaaattttggctaagcaaacatatacacttttccagcttaggaagagattcacgtatccaacactacatcttctttacattttaatttttacttcatctgaaaaattgtaagttaaaaaaaagttgtagataatatataagaaaatacaaaacaagttcaaacccacacaattatttttcatatattctagttatttctcactgatcattttgttgaaaatacatgggatatatcaatgtcctgactgcatgaaaaagaatttcagtgaacatccctaaaagaaaagacgcatatccatcctttcttccccgtacccagcaaaatgagaacataaacatttagtccctaaaagttttcagttgccagaaaaacaaagaaatatagttacacatccatttttaaccatatatagaacctagctctgatagacttgaaacaaataacactatttttcccaatgatttctaaaagcagcaaaccatgaaatacaatttcattttcctctaatggtaatagaagatatttcatgttgctaccaaacatatactgtatattcttgtctcttcaaagtctattttttattagcttaaaaccctgagctgttaaatgtagcataaaacttctgtgaaattacactgctttgcatcaggggaaaagggtcttttaattggatgattgcagaagaggagagaaaaaggagagagccttcaaaagtttgggtagttcagattttaaaaatctggatgcttcagcaaaattgccaatcctctgagctttgattattattactaatgtagcgcttacagatactgtaaattagatcttgagcacattatgggccaaataccatccttttatactcatgtgtaacctttaacaggtttcaatgggaaatgtgcatggttactcgaaagcagttttcccattatttttctactctaaatctgatacaaaataaggcaattagaagaaacatgttaaaaaattaatagtaacaataactttaattttgtatagacttttccaattacaaagagttttacacaacataacattatagctgtatagtgaaataagtttgtgtatataaaatcatattaaagcatcttcaatatcaaaatttaacatcagtatatctgataaaagatgattgtttagatttatgtttgacagagtagcattttgaaaagaataaaattttgaattcaattctgttaaatggtcaaacacgttaattttaataataggagtaatttatactttatataatctataaacattattcttttataattgtttttagtttatatttttcttgtatgtttgtaaatctgtcttttgttttccctttatttgcttgtttgcatatttctttttcagttttccgaaaaaatttagctatattatgtttttatttttctggttcattgtcttggaaagtattcaccaggatacaggcttccaacaaggcatattctgaggaagcatcctaagtcattttcacaagtggttgaatttctgagaagtaatatcagtcttgagctacttccattatataacctaggataaaccctgtgcattctagttattcaacaggacttggtatttcctaagcctgtatcaagatgcattaactgatttaatagtcagagttctttaattgtttgttattttgttttattcatttacattttttacaaacaagaagaacactatgatcttcagatcttcagaccaaaaaataagcaaaaacaatgttgaatgctattgtgcaaaatgaaagccatcaataaacaatatttgctgtgggtttttgcttgtacctaagttgatgaaacaaaggatatctctacttttgtggaagagagagaacaataatagcaataaacataatgaataaacacattttatagcctgatggaagatgaagatggtaattcctatagataaagaacagggtcacaaagatcaggtttatggaggagagttgcttgtaattagtcctagccctcgtcaaggaggtgagggaatggtcaagaaattagatgggagaggagtgttctagagatggaggggaaaggatgtaaatttgaaaatgtgcctgatgactttcaggaccagctgaagggtaaatagtgaaaatagcagggaaaggtgaggttagagaaagatgggtaggaatacaatatgaaaggtcattgtcaactttaattcttatttaggtgtgaaaactctaacagactctgagtgacacaaagtggcttttaacaagatcattctggtttctcagtttacagcacattgcaggaagctaggggcagagacaatcatttaacgttttatctacttttttgtataaatttagggggtacgagtgcagttttgttacatgggcatattgtgtcacagcggaatctaggcttttaatttaccttcatcagaactgtatacattgtatccataagtaatttctcatctcctaccctcctctcaccttcccacccagtgtttgctatttcatactatatgtccatgtgtgcaatgatttagcttcctcttataagtgattacatgaagtatttcaatttctgtttctgagttatttcacttaagataatggcttccaggccaggcacggcggctcacgcctgtaatcccagcactttgggaggccgaggcgggtgaatcatgaggtcaggagatcgagaccatcctggctaacacggtgaaaccctatctctactaaaaatacaaaaaacaaattatccaggcgtggtggcatgtgcctgtagtcccagctacgccggaggctgaggcaggagaatggcatgaacctgggaggcggagcttgcagtgagacaagatcacggcactacactccagcctgggcgacagagtgagacttcgtctcaaaaaaaaaaaaaaaaaaaaaaaaagataatgccttacagtttcatccatattgctgctgcaaaagacatgatttcatgttttatgactgagtagtattcgtctgtgtgtgtgtgtatttcccattttctttatccagtcatctgttttagacacttaggttgatgccatatctttgctattgtgaagagtcctgctgcaaacgtgaatgcaggtatattttatacaataattttttttagcggggggattagataccccatagtgggatgctggattgaatggtagttctatctctagttatttgataaatctccatactgttttccatagatgttgtattaatttacattcacaccaaatgtgtataagcattcacttttctccacatccttgccaaaatctgttattttctaactttttagtaatagccattctgacttatgtaagatggctatcttgtggttttaattttcatttctcagatggtaagtggtgctgagcaatttttcatatgcttgttgttgcactgagttgcttgtagattctggatgttagtatttttcagttgcatagtttaaagatatgttcacccaatctgtaggttgtctatttactctatgattataacttttgctgtgcagaggctttttagtttaattcagtcatatttgtctagttttgttttggtttcatatgcttttgaggtcctagtcataaattatttacctaggccaatgtccaaaagagtttttcctaggttttcttctagaatatttatagtttcatttgatttttgtttttaattacgtttatgcagtgaatcacatttattgatttgtatatgttgaaccatccttgcattcctggagtaaaacccacttgatcatggtgtattttattttattttatgatgtgctgttggatacagtgttttgttgaggatatttgcatgtatgtttactagaaatactgatctatattatctttttgtgtgtgtgtgtgtgtgtgtccttgtcttgctttgtatcagggtgatattggcttggtataatgtgctggagaggattctttactgctcaattttcaagaacggttttaataggcctggtatcagttctttgtatgtttggtaggactcaagtatgaatccatctgttcctgggctttgtttgtttgtttatatatttgttagtacagatttaacctcactacttactattttggtgcaaaagtaattgtggttttgccattgaaagaaacagcagaaaccacaattacatttgcactaacctaatattctatttgggatttctatttcttccttctacatgcttgaaaagttacatatttctggaaattcattaatttcctctaagttttttagtttatgagtgtagagatattcatagtagtctctgaggatttttagcatttctctagtatcagttgtaatgtcttctttttcatttctgattgtgtctatttgaatcttctctcattgtttctcgcttaatgtagctagtggtctatcagttttgttcatcctttcaaataatttcttgtgttgttgattctttgtaatttttttggtttctttttcatttagtcctgctctgatctttgctatttgtcttctactagctatgaagacactttttagtttaagttccatttgtcttgttttgtttgtgttacatttgctttccaggtctcagtcataaattctttgcctaggccaatgaccagaacagtttttcctagattcttttctagtatttttatagttacaggtcttacatttaagtctttaatccatcttgagttatctttgtatatgtgagatgtaggggtccagttttatccttctagacatggcagtccaatattcccagtaccgtttattgaatagggtgtaattctcccaacatatgtttttgtcgactttgtcaaagagcagttgactgtaggtctatggcttcatttctggattctctgttctagtgatctatattttgatttttatctagtgacaaaaatctatgtgttgattttatttagtggttaacacatggatctatgtgttgatttttataccagtaccatgctattttggttactatacctcatagcatcatttgaagtcaggtaatgtgatgcctctagattttttctttttgcttaggatcgcttcggttattcaggctcctttctggttccatattaattttaggattttttttcctaattctgtgaaacattacattgtaattttaatgggaattgcattgaatcagaagactgctttagtcagtgtggtcattttaacgatactgattcttctgattcatgagcatgggatatttttcccatttgttcatgtcatctaatctgccatcttgaagggaaaaaaaaaacccacaacattttaaatgaataaaatgaaggctgaaataacaatgtgaactcaggcagatactatgtgggttcttaggtttttataaaattgcaaagtaagtaaattaatatccaatgctcctagattttccataaccttttttcttacttctcctgtgcacatttctctttgtcagacttaatcttagcaaaggattcaatacccacacattaagaatatttctttgactttttaatgagttacctgcattttaacctggaggaacccacaggaataaatttcaaatggttaaatgtcaagccttaaaaaccatgaataattatttttggctaggaataaaatttagatccgtggtgaaccccagtaatttctggctcttgggatttttaatgggaataatttattataaatgtttctctccatcagaaaattaaaaaattttaaaaggcacagtatttttgtttgaggcgagttgataagtctactaatttctctaaaaatgtcatcgaattattacacagaaacaagtagttgccaggcaagaatcaaggcattagagataaaatctgatttacataccgcacttctctctcctcaatgtgctcatagtataaattggaggcaataggtaagtaaacaatgggagggtgttggagagagatctatcatagagggaagtatctatgcttatgaccgtttatctaaacatcattctcatctttgattctgtttaatcatcactacgattcaactcaatgcagtttcttttcttatttctaagaatagtactatattctgtctgtcacacaggctctttcacctggaattgtcactaacctctctcttttcctcactttcaactttaaatttggttctagaataattccttggaatttaataaaagcatattcaattaaattgaatataatattaatgtatggccttttttcaaaattttttcttcatatcattttaatgactcctgtatactcataaaagtttaagtttcaaagcattagcttgtaattttttacacatacatacccaaatatgaagataattttaataccttatataaataaataataaaataaataaaatatatttattttcaataaatgtaaatattatcttgatatttattttgcactcacagttattactgatttaataacttgatatgaaacatccttgttttcagaagtgtactgtgagtttggatattgctgctttttattgccacaaaagagtacataagcatttagcagccagagcatgaagcccatagggtgactgtggcaacagagtttctaatataaagtcgatgtaaaagtatgcaggagagaaatagaagaaaaataagaaaaataattaggccagacctcaaaaataatgcttatataaattagatgtgataaagtgataggtaataaaacttcaagggccaaacaaattaagaaatgaatgatgtgaaatggaatcagctcaggggagcaatgacaatggatggaaccaaagaaagaatacatttatgaattacagagaaagaactttagattaatgaagaggagattttatcatatcaacagagcaattgagatgagtggtccataaagctttatgactttagcatgaattctggtggaaagaaatattatagtagatcatgttaatctaattttactatccttaaatgtaatggcttttaaaattgttagctgaacaattcaaggtggcaatttgctacatcaatataagcagtctcttgtgaccttttaggaatactgagctactgattagttaagtgacagtgatcctttttcaaaacaaatgctatatagagattttactaatttccctacttaattaagaaatgatatttatttcccctaaggacaaaaattttcaatggtactgacgatcatatattagatggtaaagtggattactgaaagttagtgccactctaattaaaaatttgattcatcccacccaagacagaaatggggactgaattttatatcccattgaataaattaattccacacacaagttttaagttcctaaagtctttaacttcagctgtggctctaaaaaaatcaacatgactctaatttataaaatataataacgttaaaattttcatatgattgtgaggatagagttaggtaataaactaaataactacattgtttaaaaatttacaaatgcataggagatctgtaaacattaaaatatgattgaatttttcaatagataattgttctgatgtttgaaatgttctggaagtgttcatatagaggagtatgctgtccaatatggtatttaccagctattgatggctactgagcacttcaaatgtagctcatttgatgaggaaattaattttttaattgtatttactttcaattaatttaaatttaaatactcatatggggctagaagctccaatattgggcaatgaaagtctagaactcacatcttaaatttgatttgattgttgaatacatcaagtttgtaattaatgtagctgctgggaggtattgctacaatcagacaatcagaggactcaaagtttgcaatagagatttaaggtaaactgtgagcaagacacttttagtgatgaatttctaattaatttattaatttcagtactgagttcgctctataattaagtcttaatatgcatattacttaaagttaattataaatactaattcttggttttatcaatcacaaatgggtgtagggggtagaaaatgtgaataaaaatattggagagttaatttatatactagtcttacactgagaggtgaatagtttatgtttggtacagattagctacatttagtcaaagcaaatattgtagaaaaataaacatagtgcctcttttgaatatgtaagtatttttagtgacaatttgattattcaaattgattatttgaaaatttgattatttgacaatttggattttagaaatctgtagacctgaagcttcccttgaaccaggattaattaaagacaatattgccaattaacaccagacagtataactggtgttcttgctgtgcttttatgtatgtgctctaggcagagcttttactagcttacacatctctacgcagatttttaagcctttcaagaattttgccacttctgagctgagctcagagccaaaggagagctgaattttagcactttggtggaagcagctttcatgcccctcaggcttatacttaaatctgtctttactctaggaaacttcatagagctctcttggcctctgtgcccctttagtttctaaactacaagggaacccagccctttcatccttaaaaaagacacttttaggactttacttatcatttatttatttatttttttagaggcagagtctcactctgtcacccaggctggagtgcagtggtgtgatcttggctcactgcaacctccacctcctgggttcaagcgattctcctgcctcagccacacgagtagctgggactacaggcacctccattaataactactaggactttaagccttttcccctagaacaaaatcctctggtgttttatttttccttgacttagattaatctcaattttacagtttactactcaaagtgttggccttggactagcagcatagcttcactctggagcttgttaggagtgcagaatatgaggccccacaccagacgtactcaacgagaatcaacatcttatgatccccaggtgtttcataggtacataaaagtttaagtactgtatgtagcacacttcttcttgtttgctccataagaatacaaaggtattttattaatggaatttgtttttatagtacttccttaaatgagccaaacttcatgatcatcaaccagtatatgccccgtttttccattccagatcattctttacattttatttattaacttttttaaaaaaattaagacaagtacaagaaagagccagacattcattcttcccttgtcttaatgtaaagtataagtgtgcatattcattgtctcatctgtcctgcactcctctcactttagcagcaactctgtagaggacaaggatcatttgtttctataggtaggtatttggtacctcttagaatattatctacctgtcctagaaaccatatagtccattccagttttaaatttttttttgagacagatattcgctcttgtttcccaggctgtagtgcaatggcgcgatcttggctcacttcaacctccaccttccaggttcaagcaattctcctgcctcagtcccccgagtagctgggattacaggcatgtgccaccacacctggctaattttgtatttttagtagagatgggtttctccatgcttgtcaggctggtcttgaactcctgacctcagttgatccgcctgcttcagcctcccaaagtgttgggaatacaggcatgagcccccacacctggccttaaaatgttttctttaaaaacttaaattttcagctgggcacggtggctcatacctgtaatccaagcactttgggaggccgacatgggcagatcacctgaggttaggagttcgagaccagcctgaccaacatggtgaatccctgtctctacaaaaacacaaaaattagctggatgtgttagggtgcgcttacaatcccagctactcaggaggctgaggcaggagaatcgcttgaatccgggaggcagaggttgcagtgagccgagactatggcactgtactccagcctgggcaacaagagggaaactccatctcaaacaaaacaaaacaaaaacttgattttccttattatctaaaaacacagtaagtttttcatgaaaatctcagtgctaagcattgtgagattcactagctattctcatgcagatcttaatgtagggactaatgtctatcagatgcattcctaatctgattttgttaatagtttttttattgacagtaattcatcagagataagtactagtttccttttacatgtaaaatattcagtataattgtattgattgaattatagcatcaactattttaacaataaattattcctactctacacatccactgagtacacattatgagtaacattatggtaactgctgaaatatagaagtaaaaattagagttcttattttgtagtagcacaaagacactgaaaagcaagatagagctttcttagaaaaatattagcgttaaaaatgtgaccattacttgtcgtgaacctgggaggcggagcttgcagtgagtcgacatcgtgccactgcactccagtccggacgacagagcaagactccatctcaaaaaaaaaaaaaaaaaaagcagccattactaaacaaaaaatatgaaaaaaaagtactaacaggtagcacactttgctagattcaaaataaattttatagtatctgattctaaacagcatgttatagatgaattcttaaagagaatagttatataaaaaattctaatttattttggaaaattaaatttctgtcaaaacctgtaatatttatgaacagacatacttttcttttagcacgtcaacagagttgttaggttgtcttaatccttcactggctacctgcactttcccttcaattcgtcaggcacctttgaggctgtccttatatcttcatcaattgtcttcaacaaaatggatgagactatgaatagaagctcattgtcatgaaagtgatatgagaaataaatttgctgagtaaaagattataaattcacattaattgattgttcaattttcttgaaaactgatgattattctgattttaatatgtttggcagattttaaattatatacttgtttttcaaaatagagcttggtaagagtgatataccttatcatatctttaaaagaattattttttattttaagtaattagtgtcctaatctagccatatatacaagaattcagataaaaagtttactggttgaattaatctacactatcatagaactgtgaaaacatgcaataaagttagtttttttctttttttttttcaagaaatgctttagcaaaccaaaacttgttttgcgatagccatctctcctatatatctctaataaaagagcactttttcacatatttttaagtagctattccattataaacaccttccctcaatttgaaatcaattaatattttaaatactggagaaaaggcaaatctaatatatatcttctaaaatattttttacatagtagcaaaacctctgattatggctttaattttaaaccactcccatttgcctaacgctgtcctgattccaggattgaaatttccacattctaggaaactcctcagttgcagggatacttggatgattggtcaccatcatgtaccattttattgccttaatattttaatattcaaagtgtaaaaatgtgtcttatacaggaattcagagctccttgggatgtctatagtgataactttaacattatttgctaatgccttctgttattttaaaacccattaattaagcacctatttttaaagcattttttatgttaaaaatttcaatagatcatgctctatgtccttaaggaactcatagcttaaccaaagagcaaggcatacaaaataataaattataaatatgaggttggaattgttaaaagaaagcaaatttcttctaaacacagaagacttagacacttactttacctaggagaaattaaggaagtcctccattagtcctaattaaagaagttgtggtattttaggagaaacaggagttaaccaaaagagaggaaaggaggaaaggatttccaggcttggtggtatgaaaatgaaggctgtactcagtgtttggtgagaaatttaaagccattataatataggatggatgatgtggacataatcatttggaagagcattgatgaccagaattgagcaataggatttaccctataggagtggtttgaaaaaaataaaaataaaaaaaaaaagtaaatgctcaggacttaatcagaatcacctgggaagattttacaattacagactgctgcaccacttccagcccaatcccccagagaacctgctgagcagatctgaggtgccaattacttcagttcatatatttgtaatgatcttcataggattacgatgtctgtggagatttagaacctccagatttcccatagagagccaatagtggtaattaagcatttgatttacatgattttatttgatttaaaaaataattctagaacatttttgtagagacagtaggccactaagatttctttgaatgatgcagttgagagataaggaactgtactgaggctttgtcaagggaggagaaggtagtgctaaatacaatgagaattttcaaaagttgagtacaatctattttttcagagtgtggctgccatttggtatccttgggggactggttttaggacctcttttcatacaccaaaatttacagatgcttgagtccctgatataaaatggtgtggcacttgcatataacctatgcatatactcctgtatactttaaatcatctctagctcacttataatacttaatacaatgttggtgtcatgtgaatagttgtcataatgtattatttagggaataatgacaagaaaaagtctgtacatgttcagtacaaacacaattaaaaaaatattttccatctatgaattcatggatatggaggaccaactccatatgttttacgaatatttgttatactagtttctgatacagttgatatagtttgaatagagtacaaatactgcacgttgaatatcagtatataataggacaaataatgagactatttttctcatgttttccactgtatctgtttatttcttttttcattattggattgattcatccacatagtaagtaatttttaactgcccaccatgtgccgaacagtgctaactagatgaagtattcatttattgttttttggaaaggattgaaagcaactttaattaaaatacaaattattgtatttagtattcatttataataaaaatggtatattttcaaaaggaccatacatttcatacaggtattgacattaaagtgttctacttaccttttctttgcgaagaatttagaggggcatttataatataaattgttaccacttttctgaaggacaacttacctgtgtaacaaaaacacttaaagtgtgcaacacatagtggatatttatttctgcaggtagttaggtataacagttgctgaagtagtattcttaccacgtgtatgctgtattgttggactgccatgataaaacaaatactatgtcatttgtgcatatcttttttttttaacaaaacaaatttatacagggattttaggaccacaaaacaattgctggtgtgtcatgaagaaaatatattgtggaaataatatgttccatctgtggttttcttttttaaatgtaccaccttaatacagaactgcatctctaaatcaaataaccttaagcaataaatagagacttgctttcaagtattggcaaataaatgccttttttttttttacaagaacaattttttcctagttgttcatgtgaatttaggataaaaacatgcagcaacaataaatcccttgtggtattaattcttaaggtttatcacaaatagtattagagataacaaaatatagtcaacacaagcttccagtttttcctgtttatggcttaataataatttggacataaagatgcctactttatcagcatgttattggcccatattttatatttggggaatgataagaattttttcataaataatagaagataatatttttatgttatcatgtctgtcatgtactttactatattattgctgaagacaaaacactttcttgaagaagttttatttaatctatacaggatattatatttcagtcttcttaggttttccaaagtaaaatgaaacaatttttacatttctacaaggatatatgagcttttaacttcgtaaaagagaagggtatactacacatgatgttcatctgttcagcagcaaaaaggtcaagaagctaaacaaatatgccctcaagtctgaaagtgaaaaatagatcttgtaagcaagagagacactaaggtattacattagagataggtagcattttggaaccttagctgcaacacactatttgtaaaatgtatttcccatacgtcctgatggtaattgttatgcattttagttacacagatagtgttttgatatgtacagaaaaaaaatgtttatcatttaaaagataccttattccataatatatataaagaaagttgttattatagtcattaccaggtacaaatcagcaaaaaacacttatgtcaatagagtttcaagaagtactttaatatgaaatgttttaacattattctgatttttaaaaattgatacatttgttgagtggtatttaaattttgtgatattatttaattgtagaggcaatgagttatagagatgtcgaaaacaaactctttaagaattgtgaatatacaactatgatttcttaaagtttgagactttataaaagcagtggttccaaaaaaagtgcataaatacacatttacacgtatgtttacacataacttggtgggaatcacagatgagttgtaatttacccatgacatcaataaatacattgtatcttatccatgacaccaatttggaacctagaatagaaacttctataaaagtatagaagatttgttttacttccttatatacaagtagagtattgatcctaattttgatttattaaagaggataactttgtggtttaagattatattttgatggtgaataatcatcaatattaataaaataaatgaaaatatgaatcttgactttaaaatttctgtacttctcataaaacttctgagtatgtatgaaaaaatgtttggtttttcatgataaaagttttgtgaatatcaagtttgaaatatattacagacatttgctactttgtctcctcaccttggttctgtgaaagaatcatctggaaaataacttggaaagtttaccttcctagtataaggaggggaatagtgaaatacgacaattagaaaacttgtgttttattgctattctgggcactaactattattattattgttacgtttttgtctgataacaacctacattttttccagatctccatctatgcattcacaaggcacacatgtctttcaagattatcctaaatataacttttatctgaactccctctgttttatatttcactttcattcttcaagagaccaatttcctgcatgaacttgtcctagatgaagctcattttcataaatgttattttcttttgtaattagactgtatacgggcatctaatcactagcaaaactgcagcacttgaaaaccaagattatactgtagcatttgactagctttagaaaatatagtagatttttattggataatgaataacttactggttgagagagaaaattgtctgtatgttaacaaaaaagaagtataaaacgaagaaacgtttcactaagtcactcagtataccagagacaataaataaagtgaaacgactcaaattctataaaaggaaattcctcttccctcacaaaaaatgactactattttttcaaacattcattagaagtggatagtacgttctacttgtaagtacagaattattttaaaaattataattagcaagtctgctagtcattcatagcatactgcatttgaacagtgtttgaaaagcagaaatggtttggtccaaaatatattgtagttaatatacatgtgaattacattagttttattaaaacaacaatgaattaacatttgcaaatcgatctttggtttattttagcatccaaatatgtgttgtattttctatccactttgcattaaacaattgtacatatttaataatgtataaagagataaaatgtaaacatattttccccaatgttaaacagtcatgcattagattgtgcatggacatttttactcaatagtctattgggtaaaatgcttggtaattatttccttagctatatgcagactttataaaagtgtaaatttccctcttatactatgtttttaacactttaaaagaaacatatatctatgttcttcaaatattatttctctaatctttggaaatataatttttttacttttatttctggtttggagtgtaagtgcaggtttgttacataggtaaacttgtgtcatgggggactgttgtacagattatttcatcaccccggtattaagcctagtaatcattagttacttttcctgatcctctcccttctcccacccaccgcattctgataggccctagtgtatgttgttcccctgtatgtgtttgtgtgttcttatcatttagttcccacttgtaagtgtgaacatgcagtatttgattttctgttcctatattagtttgctaaggataattgcctccagcttatccatgttcttgcaaaagacacggtctcattctttttttatggctgcatagtattctatggtatatctgaactacatttttttaaatccagtctatcattgatgggtgtttgtgttgattctatgtctttgctattataagtagtgctgctatgaatatgtgtacatgagtctttaaaatagaatgatttatattcctttgcatatgtattagtctatcttcatgttgctataaagaacttccccagactgggtaatataaaggaaacagattcaattgactcacagtccagcatggctgaagagtccccatgaaacttacaatcatggccgaagttgaaggggaagcaaggcacctcttcgcaaggtggcaggaaggagtagtgctgagcgaagggggaagagtcccttattaaaccatcagatctcatgagaacttactcagaataatgagaacagcaagggggaaaccgcccccattattcagttatcttcacttggtctctcccttgacacatggggattatgtcctattagccttattctaatgcctaacagcatagattagttctaccatttttgttgtttcaaaacatctagatgtctatgctgttagacattagaatagggcttacttggggcaagtataatgactggaaggcacaaagagcctcaaggatggtcaaatgttctggtttttcatctgggtgctggctatgctagtgtacttattttgtgaaaatactattagctttacaatatgaattttaaaattgtactttggggattatgggaattgcaattcaagatgaggttttgggtgagaacacaaagcctaaccatatcagggtagtacccagaaatgggattgctgggccaaatgttatttctgcttttagatttttgagggatcaacccactactcttttccataacagtggaactaatttacactcccacctacaatgtataagtgttcctttactgcatagcgtggccagcatctgttatttctgactttttaatagtagccattctgtctggtgtgagatggtatctcattctggttttgatttgcatttctctaatgatcagtgatgttcagcgttttttcatatgattgttggccacatgtatgtcttcttatgaaacgtatctgtttatgtcctttgcccaatttttaatggggttatttgtttttatttttggtaactttgtttaagtttcttatagatgctggatattagacctttatcagatgcatactttgcaaatattttctcccattctataacttatttgctcactctcttaatagttttctttgcgatgcgtaaactctttagtgtaattagatcccatttgtcaattttagcttttgttgcaactgcttttggtgtctttgtcgtgaaatttttcctgtgcctatgtcctaaatggtattgcctaagctgtctttaagagtgtttatagtgttgtgttttacatttaagactttaatacataatgagttaatttttatacatggtataaggaagggttccagtttcaatattctgcatatggctagccagttatcccaatttattattttgaagctagaaaacgatcattgtctctgtaattttagagaaaccgacactgtttttaaattatactttaagatttagggtatatgtgcacaacttaaaggttagttacatatgtatacacgtgccatgttggtgtgctgaacccattaactcgtcatttaacattaggtatatctcctaatgctatgcctccccccagcccccaccccacaacaggccctcgtgtgtgatgttccccttcctgtgtccatgtgttctcattattcaattcccacctatgagtgagaacatgtggtgtttggttttttgtccttgtgatagtttgctgagaatgctggtttccagcttcatccatgtccctacaaaggatatgaactcgtcattttttatagctgcatagtattccatggtgtatatgtgccacattttcttaatccagtctatcattgttggacatttgggttggttccaagttttgctgttgtgaatagtgccgcaataaacatagctgtgtgtgtgtgtctttatagcagcatgatttataatcctttgggtatatacccagtaatgggatggctgggtcaaatggtaattctagttcttagatccctgaagaatcgccacactgacttccacaatggttgaactagttaacagtcccaccaacagtgtaaaagtgttcctatttctccacatcctctccagcacctgttgtttcctgacattttaatgatcaccattctaactggtgtgagatggtatctcattgtggttttgatttgcatttctctgaccagtgatgatgagcattttttcatgtgtcttttggcggaataaatgtcttcttttgagaagtgtctgttcatatccttcgcccacgtggtgatggggttgtttgtttttttcttgtaaatttttttgagttcattgtagattctggatattagccctttgtcagatgagtagattgcaaaaattttctcccattctgtaggttgcctgttcactctgatggtagtttcttttgctgtgcagaagccctttagtttaattagatcccatttgtcaattttggcttttgttgccattgcttttggtgttctagacatgaagtccttgcccatgtctgtgtcctgaatggtattgcataggttttcgtctagggtttttatggttttaggtctaacgtttaagtctttaatcgatcttgaattaatttttgtataagatgtaaggaagggatccattttgagctttctacatatggctagccagttttcccagcatcatttataaatagggaatcctttcctctttcttgtttttgtcaaagatcagatagttgtagatatgtggcattatttctgaggactctcttctgtaccattggtgtttatctctgttttggtaccagtaccatgctgttttggttactgtacccttgtagtatagtttgaagtcaggtagcgtgatgcctccagctttgttcttttggcttaggattgacatggcaattcaggctcttttttggttccatgtgagctttaaagtagtttttttccagttctgtgaagaaagtcattggtagcttaatggggatggcattgaaactataaattaccttgggcagtatggccattttcacaatattgattcttcctacccatgagcatggaatgttcttccatttgtttgtatcctcttttatttcattgagcactggtttgtagttctccttgaagaggtccttcacatcccttgtaagttggtttcctaggtattttattctctttgaagcaattgtgagtgggagttcactcatgatttggctctctgtttgtctgttattggtgtataagaatgattgttatttttgcacattgattttgtatcctgagactttgatgaggttgcctatcagcttaaggatatattgggctgagacgatgggattttctagatatacaatcatgtcatctgcaaacagggacaatttgacttcctcttttcctaattgaatgccctttatttccttctcctacctgattgccctggccagaacttccaacactatgttgaataggagtggtgagagagggcatccctgtcttgtaccagttttcaaagggaatgcttccagtttttgcccactcagtatgatattggctgtgggtttgtcatagatagctcttattattttgagatatgtcccatcaataccgaatttatggagagtttttagcatgaagggttgttgaattttgtcaaaggcctttctgcatctattgagataatcatgtggtttttgtcgttggttctgcttatatgctggattacatttactgatttgtgtatattgaaccagccttgcatcccagggatgaagcccactggatcatggtggataagctttttgatgtgctgctggatttggtttgccagtattttattgaggatttttgcattgatgttcatgagggatattggtctaaaattctcttttattgttgtgtctgtgccagactttggtatcaggatgatgctggcctcataaaatgagttagggaagattccctctttttctattgattgtaatactttcagaaggaatggtaccagttcctccttgtacctctggtagaattcagctgtgaatccctctggtcctggactttttttggttagtaagctattaattattgcctcaatttcagatcctgttattggcccattcagagattcaacttcttcctggtttagtcttggaagagtgtatgtgttgaggaatttatccattttttctagattttctagtttatttgtgtagaggtgtttatactattctctgatggtggtttgtatttctttgggatcagtggtgatatcccctttatcattttttattgcatctatttgattcttctctcatttcttctttattagtcttggtagctgtctatcaattttgtttatcatttcaaaaaaccagctcctggattcattgatttttttaaagggttttttgtgtctctatttccttcagttctgctctgatcttagttatttcttgccttctgctaacttttgaatgtgtttgccttgcttctctagttcttttaattgtgatgttagggtgtcaattttagatctttcctgctttctctagtgggcatttagtgctataagtttccctctacacactgctttgaatgtgtcccagagattctggtatgttgtgtctttgttctcattggtttcaaagaacatctttatttctgccttcattttgttatgtacccagtagtcattcaggagcaggttgttcaatttccatgtagttgagcggttttgagtgagtttcttaatcctgagttctagtttgattgcactgtggtctgagagacagtttgttataatttctgttctgttacatttgctgaggagtgctttacttccaagtatgtggtcaattttggaataggtgtggtgtggtgctgagaagaatgtatattctgttgatttggggtggagagttctgtagatgtgtattaggtccgcttggtgcagagctgagttcaattcgatgtccttgttaactttctgtctcattgatctgtctaatgttgacagtggggtgttaaagtcttccgttattattgtgtgggagtgtaagtctctttgtaggtccaaggacttgctttatgaatctgggtgctcctgtattgggtgcatatgtatttaggatagttagctcttcttgttgaattgatctctttaccattatataatggccttctttgtctcttttgatctttgttggtttaaagtctgttttatcagagactaggactgcaacccttgcctttttttgttttccatttgcttggtagatcttcctccatccctttattttgagcctgtgtgtatctctgcacgtgagataggtttcctgaatacagcacactgatgggtcttgactctttatccaatttgccagactgtgtgttttaattggagcatttatcccatttacatttaaaattcatattgttatgtgtgaatttgatcctgtcattatgatgttagctggttattttgctcattagttgatgcagtttcttcctagcctcaatggtctttacaatttggcatgtttttgcagtggctggtaccagttgtccctttctatgtttagtgcttccttcaggagctcttttagggcaggcctggtgttgacaaaatctctcagcatttgcttgtctgtaaaggattttatttcttcttcacttatgaggcttagtttggctggatatgaaattctgggttgaaaattcttttctttaagaatgttgaatattggcccccactctcttctggcttgtagagtttctgcggagagatcagctgttattctgatggacttccctttgtgggtaactcgacctttctctctggctacccttaacattttttccttcattttaattttggtgaatctgacaattatgtgtcttggagttgctcttctcaaggattatctttgtggtgttctctgtatttcctaaatttgaatgttggtctgccttgctagattggggaagttctcctggataatatcctgcagagtgttttccaacttggttccattctcccagtcactttcaggtacaccaatcagacgtagatttggtcttttcacatagtcccatatttcttggaggctttgttcatttctttttattctttttttctctaaacttctcttttagcttcatttcattcatttcatctttcatcactgataccctttcttccagttgatcgcgtcggctactgaggcttgtacattcatcatgtagttctcatgccatggttttcagcttcatcaggtcctttaaggacttctctgcattggttattctagttagccatttgtttaagttttttttaaggtttttaacttctttaccgtgggttcgaacttcctcctttagtgcagagtagtttgatcgtctgaagctttcttctctcaactcgtcaaagtcattctccatccagctttgttccattgctgttgaggagctgtgttcctttgaaggaggagaggcgctctgatttttagagtttccagtttttctgctgttttttcctcatctttgtggttttatctacctttggtctttgatcatggtgacatacagatgggattttggtgtggaagtcctttctgtttgttagtgttccttctaacagtcaggaccctcagctgcaggtctgttggagtttgctggaggtccactccagaccctgtttacctgagtatcagcaatggaggctgcagaacagcggctattggtgaacagcaaatgttgctgcctgattgttcctctggaagttttgtctcagaggagtacctggccgtgtgaggtgtcagtctgcccctactggggaatgccacccagttaggctactcaggggtcagggacccacttgaggaggcagtctgtctgttctcagatctccaactgcatgctgggagaaccgctactctcttcaaagctgtcatacgggtacatttaagtctgcagagttttctgctgccttttgtatggctatgccctgcccccagaggtggagtctacagaggcaggccggcctccttgagctttggtgggctccacccagttcaagcttcctggccactttgtttacctactcaagcctgggcaattgtgggagcccctccctcagccttgctgctgccttgcagtttgatctcagactgctgtgctagcaatgagtgaggctccgtgggtgtaggaccctctgagccaggtgcgggatataatctcgtggtgtgccgcttgctaagacagttggaaaagcacagtattacgatgggagtgacccaattttccaggtgccatcgtcacccctttctttgactaggaaagggaattccctgaccccttgcgcttccctggtgaggcaatgactcaccctgcttcggctcatgtttggtgcactgcaccctctgtcctgcacccactgtccgacaatccccagtgagatgaacccagtacctcagttggaaatgcagaaatcacccatcctctgtgtcgctcatgctgggagctgtagactggtgctgttcctattcagccatctctccacccccccagaaactgacacttaacttttaggctcatttaatgtaaaaatgaactgctctgaactggttgtcaattcaaatatggttttaatatgaaattacaaaaacataagaatatttctaagaagaaactcactatgtaatagtccaaaatctaaaaacaactcaagtatacatcagcaggaggataaatatataaattatataataaccacttagtgaaatactgcaaatcaatgaaaatgaatcaccactatacaaaagatggatgaatctcacaaacgtcatgctgaatgaaagaagccagaaacaaagcgatgcttattttttgatttcattcaaaacatcagaaatggcagaactaatctatgctgttagacgttagaatagggcttacttgggggaagaataatggactggaaggagacacaacggaggctctaggacgctgaaatattctgctgtttgttctgtgcacttgctatgctgttgtaattattttgtgaaaataccattaaactttacatatgaattttgttcttttttgcatgtgcattatacctcaataaaaaagttgttttaaaactggaatatatcaccattttctaccatgcatcatttaaacataattttcatgaaatgcaatagtgttatataatcactatgtagtaatcttaatgcatattggtttaaatttgcatattttaagttttgaaaggataactgtcaggaaattgaagtatatactatcagtgatgtttgtaagttttttatcatttttgttagtgaagaactaacatgtttatgctgataattgaatatactgttttatattacaatgtgaaatctactttcagaaaacttgatatggaatgaatgtttcctttaaagcttttcagaattaaaatattgctttattgttgtaatcttttaaaaagatgcaaaacaattaacatcagatttttcataaagatacaaattcaagtgaatagtactaataccatatttaattagaaatcaataaaaaaatcactttattctttataaatactttagaatacttatttctattctgccattttctttgttttattttctgttataaaagccaaccaaaaatgacaaaaatataccaggaaagataaactgcgacgtaactggggagtagatacattatacacatactactttggcaatataaaaggaggaaataatctgttattacagatagctccatgaatattcaccagtgaagcacataatgatcatttccacagtagcaatacagagactgcgacattgaaattattcagtcctcctgtaaactagttcaaccattgtggaagtcagtgaggcaattcctcagggatctagaactagaaataccatttgacccagcaatctgattactgggtatatacccaaaggattataaatcatgctgctataaagacacatgcacacgtatgtttattgcggcactattcacaatagcaaagacttggaaccaacccatatgtccaacaatgatagactggattaagaaaatgtggcacatatacaccatggaatactatgcagccataaaaaaggataagttcgtgtcctttgtagggacatggatgaagctggaaaccatcattctcagcaaactatcacaaggacaaaaaaccaaacaccacatgttctcactcacaggtgggaattgaacaatgacaacacatggacacaggaaggggaacatcacactctggggactgttgtgtgttgggaggagtggggagggatagcattaggagaaatagctaatgttaaatgacgagttaatgggttcagcacaccagcatggcacatgtatacatatgtaactaacctgcacattgtgcacatgtaccctaaaacttaaagtataattaaaaaaaaaaaagaaattattcggtcctctaaagtgagggtctgctgatttttccatggatgtgtaagaaatcgtcaccatttctgaaattaagttttgtttgttaagaagaaacagcctaactttttagatagttttaaaaattatcttccaaaacactgctgcatggacaaaccatagagcactaaatcttgtagatagatcggtccatgccatgctgttgcatgaggttatatttttctagttacattcactgcatcatagcctggagaacaaaaacacagcatgacaacatatgccatgtctctaaaccatgcatctttaagagtctgatattcagcctttcattcatttaccttccttgttagcctttcatttaacactgattaaaatacttcaaatgattaattattgcacatttttgcctgatttatcacagctcagcaataagatcctttgttgtagcttcatcatattaatgtggaagctgttaatgtgagataatattacaaactcttctgtttctgacctgcttttcttagttcctatcttctttacctgagatccatcacttaaaacagcctttccccaaaggtaagcagccctctttaagagtcttgccacattttaacatatgaattaatctaagcaagggtccagaataaaataacacgtggtgtctttgctcaactaggttagttttccacaccttcctgtaacattatcagcagaagtcattcacacataaagcaacgacctcaaaattaaaaagttactttggataaaattcattttattgtgtaatctgggtattccttctctgtctctcctttcacccccaccatgggactttaaaaaagtaagttgtaatgctgagatttctgtgtcaaggttaaagagtgaagagaatcatttcagagattagaggtgtcactcatgtcaagaaacattataagagatctctggaggcatgtaccaacatattaaattactacatggaaaaataaattgaaaaagaaaagccctgaagtaatgaaagctgactacattttcaaagcaactactattttaagaagagtatatttcctttatccacaaacaaatacaaggcaaaaactgggtgtgtaacaatatatgatcttctttatgatatttacatgttggttgtgtcacccaaactagatcaaatgatttttaaaataacatttatattggtaaactctttcaaaataaatgtagaaattttctgtggctggcttctaggtgtggaattagggaagcaacatgtattaacttgaaattcctacccaggcattcacttgaaaggtacccaaagttatatttgatagtaacatagttttaaaagcttctgctttctgttttaactgatttgcttctacaccactccatggacatcattaagcctttttatttagaattatgacattgcttttatttcattaatttcactagcacaggttcaaagggacaagagttagttttagatgtaatatataatgtaattaaaaagttcccatcatttgtgtgtttttgtagtcactacttactaatgtaagtagtctgcacattccaattctgtttactacagaattaaagttgcaacatcaacagttgtctgagactgtatgttttatcttgaacaaggaaaataaggttttaatagttctgattgttattaaaagcctttatgaagtaacatttataaaacacttctaatggtggagattaattttgcccctcaggtattttggtccaagtaaataagaagcgactgatggtcccactaaacaaaataactacaaggaaaatgcaggaatttcttttcttcttgttaatgaatattttgaagatggttaatttacggttatgtagacattctgcaatcagctaagatgttaagtcacatgttttatatctatgaaagctactattttgtagtggtgacaatttgttgtgtgaatcagtatgtacaatgaagagtgacccattacatacaatagaaagtggtggtagttcaccatagaaattatctgttgctataataaatttcacatattctttgatttttaatgatttctaaacaaggcatataaatatgctatatacatcatattaccaaagacatcctttcaagtataactgctgaaaaagagtctattgaatgagttagtaaataaatgattatttatttgcaagccttttggtaaaatagcgttatttacacaatgaatttcattgttttggcattgtaactgtgtcttattctgttttgtgctgctaaaagagaacatctgagactgggtaatttatagagaacagttctggaagctgggaagtccgagattgagagaccacacctggtgagggtgttcttgcagcatcatatcatggcagaaggcataacatgagttaaggagcaataactaactcattcccatgataatggcattaatccattcataagggcagagtcctcataacctaatcacttcttaaaagttccactctcaactgttgcactggggactaagttcaacacatgaactttaggagacacatttaaaacatggaagattatatcccaaccagctctcctttaaaacccccaaatctgatacttacctgattgataagagtatttaaaataataaaatgagacaacatctttaaaacatctttctagtattatgaacttggagataaaccaatatagtccaagttgattatagctcatattccagtatcaacatgttcccagcactaaagcaattattttctacagttaaagagaagttttatttcataagagaaatccaaagagtaatacccctatcttagttgttgagggatcctgtaaagaactgtgaatctgatgttttatcttacttgctataatagcttacaggttagcctgccagttctatggatgctggcagaacttcttgggacaaagagaaaatattttatttttcacaggaatcatagccagtgtgtcagcattttcttgtgtttgtgcccaagttccaattcccacagggtagcacaaagagagctagatgctacctgtacacagttgggttgcaataacaaaaaaagagaaacctgatcctaggtacaaaaaatcatttataatgggtagtaagcatgtctggacttagtttactggacagtaaccatgcctgacctttgctctagtgagaatcactatctatatcttcagtgttttttgctatacagatttgagatcctttatccaaaagacagagccatcaagagttgtctgagagtgtgcatttaattttgaacacggaaaataaggttttaatgttgcagattcttatggagatatttacaagcctttttgtgaagtaatatttatacaacacttctcaatgatgaggattaattgaaaaatctgaacgatttcagatttttgcatttttttggatgttagaatgtttgcattatacttaccagttgaggatctcaaatctgaaaatccaaaatccaaaatgcttcagtgctaatattctttggatgccatgttggtgctcaaaatgtttcaaattttacagcatttcagatttgggtttttggattcaggttgctcaacctgtataagcatctttgaaaacttaatccagaccaaaagggctaccagtgctttgtttccaagactaaggaaacttgagaaaccaacagagaattgtctctcaacagaaccagatacaggtgcaatagaaaaaccaccagtctattttattatccttataaattcccactaactacagctgtttagaccaattgcttcagcaacaggaactgaaaatggaaacttatttacagagtaaaaagtagagggctggaattgtgtgcatccagtaatataattttcatataatttttatttagaaagatttaagtcatttcatgatatttagaagtagatatgtagagaatgtagtcaactcagcaataatctcatagaaatacaaaatacactaatagagtttcccatgcatatttaggttctcatacacggagaattaaatacaaagtaataaaaaatgactataaagtatacagtgaatatgctgtgccaatgtagttctgcagcataatatatccataaattttcttgcctttattgaacttacataatttctcctaacatttacttgagatgcattcttgtgatttatttaaagaaatgatatttgtggccaaaaattggaaagtgatatttcgctttagtacataggtaattaaccactgaactaaaggtctgatcatttatccactttcacattaaagtgcaaacactgaacaaaacataggtaagagatgtttcccatttcaagtggcaaaatttctagtgattttgtggtttacagaattcagttgaggtttgtatagtcattcacagagcaaaatattcaaagtagttattttttgagaaccatctttggcaacatatagcagtttttgatttccccatctagtaaaagcaatgagctaaagaagtccaccttccaccccacccccaaatgaagcccaaattaaactgttctaagtaggcattgaattcaacatattcattttgcttaggattaatttagaatattaaattaatgtgatcagtatatcttctttttatgtttatttcattttctttttgcctattagaaatactttaaaaaggcaaactctgtaaatcctcaatctttaaaggagccacatcagcatcagctttaaaagaacatctttttttttattgttaaatgaagcacctgttaatattattgttgcatgaataaaactgtctcttcatagctctttatctaaaaaagactgatttgaatgaaggtaaacatatgtggatacagatttccttgattttttaatacattcataattttgtttctttttttctcattttatataacacctatattttgattaaaaaaattatttcttctttaaaagatacattaaaaaacctaacttataacaagtgtaagtaatttttctagttgttaggttataatgttttaactttagtttttgtatagtaagtatggatgcatttttcgcaccacagagttgatcaaaataacagactgacataagagttggctgtctgataatattgtaacttgtgaactaaatgagcatgtaaaagtcatgctaacattcatttatttgataaagtcttcttaaagattttgagggcattgatagtacaaatcaaatgcacaatttaaaactgagatggttttcttatttactgaagatctgaacttggatattaaaatctctcctttgccatattctgcatgaaattatttcagtctcttaaccttactttttccatgtgtaaaatgatattattaatgtctaatttgtagattttagtttttaaaaaaggttaatatgtaaaagtgcttgatacatactgtttgcttaataaatatattaaacatacattcttttttacttgggttgtacaaaatcataatatcttaggtatgtaaaacactttttgagttctggcctaattcaatatttctggtgaaaatatgggaaactccttctccctccctccatcttggccttgcccaccacagaagaagaaaatatgtattgaagaacagtagcatttaattttcataactttttcgtaaatgaggataccggaagtcacacaaagtaaatgacttactcaagatcacatagacaggaaggacaaaggtaggattcacacccggatctgtctgaatccaaaggtgaattatgtttcatcatattatgctttttatcatagcttagagatttttctagcatggaacattatttagcaatatctgtgtgattaggcatctgcttcctaattcaacgttttcatcttcaactaaggtttattattaaatataaaacatttaataaaagtcaaaacatttgcttgttcaatttattttaatttatatttttgccttgccataaaaaatattaaagaaggcttaaatttgaatatacttgctatactaccttttaattggtgatatttcaaatttaataagcaaactgcactatgaagacaggatataagaagatttaggcaattggaaagattctttatcttgttacactttcggcatttttttttttttttttttttgccaattctcaatgtgaataaatttacaacatgtgaagcatcaaaagacttataaaatcttgagtcttgtctgaaattagcaaattaaaataaatatatgtgttgaaagaaaagtcctgtcttgcagatgttttggattagaatgaaaatggacacacacatacacatgcataattgttaactttcatttgaaataaaatttaacttagcaaaactaacaagaaaaaataaaataattgaatatctatattctattaaggaatgtaaatttaaacaaaaacattccacaaagaaaactccaggcacggaaagattggcaggttaattctatcaagcatttggggaaaaaacgaaaaagtaaaagcaacattacacactcagaaattaaggaaggaaacactttccaatgtgtttcatgaggcagcatatctctgatacataaacctgataaagacataacaaagaagaaattgcaggttttttaccactacaaacatagttaaaatccttaaaaaaattccaaagttgtattcagaaatacataataataaatcataatggagcagagtttgctataggattgaaaagttggtttaacatttgaaaatcaactcactaattcaccatattaatagaataaaggagaaataacttaataggcattaaaaaaaagcctgacatgacactcatttatgttttaaaaaggtaagactggaagagaacttccacacttttctgaagggcatttatgaaaaccttacagctagctaatttattgttacagatgaatcactgaatacttattcccagcagttgggaacaggcaagatctcttcctactcctgtactcaacattgcattagaattcttatggtagtgtaatttagcagaaaaaaaataaatatgatacataaatattgggatacatgaagtagaatgataatcatttgcagattacgtaagtgtgtttttaaaatcactaagaaattacaaaacaactacccaaggctacaagatagaagatacacacacacacacacacacagcattcggaatagatctagagtaaccaaaataacctggataaaaaaaaaaaagtttgaatacttaatatgatttgattattttttataatgctactgcttctagtaataaagtcatgtgttattgccgtaagaatatttcagcaaaacataatgagtagagatatttatccacacacgtgcagtcaattgttttttgacaaaaacactcaggcaactcaatggaaaaaagaaggcctttttaatagaaaattctcaaattactagatatttgcataaaatatgtaaaccatatgctttcattttatttcacacataaaattaatttgggataaatcaccaacctaacctaaaaactggaactgtaaatcttctcaatttggaagtaggcaacgatttcattggcaaaaaataagaagcatcaagcatgaaaaaattgatgacatttcttctcaataaaattgcaattaagcatatgaatagataagaaaaagagtcgggaaaagtaatcgatatttaataactgtcaaagaatttttatccaaaatatttaaacaacttttatgagtaaatatgaaaaaaacaacacattaaaaaatggtcaaaagacttgggtcgtcaccttaatgtgagtatgaaaaatatgctcaatgctaatatcattagacaaatgcaaattaaaaccacaagataaggttttgcacaactacaatggcttttagacacacacacatacatgcacacatgcacacacattaacaataccaaaatttggcaaggatgtgaaacaattgtaaactatagctcccatacaccacgttttgtggtaggaaaaatgtatgtgaaatagtacaacaattttagagaagtgtatttaatatctgtcaatcctaaaatcaagcaaccccattcccagatatttgcccaagagaaatgaaatcatatgtccaccaaaatacttacacaaaactattcatatagcacatttaattcatattagccagtacctgcaacagctcaagtggcccaaaatagaatggataaatacattatcttatattcatacaatgaaatactacactgaaaggcaaagcaacaaaaacgaatgcaggcaaaatgtggatgaatctaaaaaagtctttattgagctaaaaaagtcagatataaaaagtatatatcatatatatggtatattctgtatgtatgtgatctgatttatacggaatttgtaaagtaggcaaactattgtgataattgaaattagactgttgttgcttttgggtagaagtgggaatgattgaaaaggagtgtatgggaaatttgggaaataatgggaaaagtcagtatcttgatttgagtagtggttacataggcttataatacaattagcaaaacctatcaaatactatacttaaaaacctctccattttattttatatacattataattcaaatacaactgataagaattatagaaaatgtggacaatatgtacaattttatacattatatatatatacacatatatatatgtaatgtttcccttaaattttacctcttaatcggattactgtggaaatatattcttaaaagtattatttgtatgtatcagttgcaaatctgacttacattattttaagtggtgtaagatattaggagaagtttgttatctaatgtaccttgatcactaatttatattacaaaaagtaatatgttccaatccatatttcttattggttaaatcagttctactgaaaaaattttaaattctatgcttcacaaacaaaacagagagaaatgtatttgaatactgaaggctacactgtgtctatttccaaggggctaataagatttaagacttcaaagattcagtcttgtggtcaagaataagtgatgtggatgcctaagaaatgataagccatgccaggagactggaacataaatttgaggctgaatgactgcaattttccaaacatattttctgtttatcacaaagtttcatagtagttccataacttttccctccactcggtctctttaaaattctactgaacttctgagtaaaattgagaataatttggtccactgaatactatggcaaccctcccaccaaaataaataaaatgaaaaatttttctttcttttccttgctgttttctaattattttatctttgattatgcttcaaaagccccctattttctcggaaatggaatgttgtatatcttcttagattcactttgtttgtaaaagggaggaatatctgaaagtagaaggtaattatttacattagaagcagtgttttttactctctatgaaacttcctgcaaatataatacttaaacactctataaaagattgcaagtatacacagcaagtttgtaaatttttattttaatatctctaaagaatgagtagattgtaattttgtatttgataaaaattattgaggcctgaaatgcttttttcctactttagaaatttaaatgccattttcataatattgattcttcctacccatgagcgtggaatgttcttccatttctttgtatcctcttttatttcattgagcagtggtttctagttctccttgaagagatccttcacgtcccttgtaagttggattcctaggtattttattctctttgaagcaattgggaatgggagttcactcatggtttggctctctgtctgttattggtgtataagaatgcttgtggtttttgtacattgattttgtatcctgagactttgctgaagctgcttatcagcttaaggagattttgggctgagacaatggggttttctagatatacaatcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagatcaacagaacagaacagagccctcagaaataacactgcatgtctacaactatctgatctttgacaaacctgagaaaaacaagcagtggggaaaggattccctatttaataaatggtgctgggaaaactgactagccatatgtagaaagctgaaactggatcccttccttacaccttataccaaaattaattcaagatggattaaagacttaaacgttcgacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcagaagaaactagcatcagagtgaacaggcaacctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaaggctcactatcactggccatcagagaaatgcaaatcaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgcttcctcagggatctagaactagaaataccatttgacccagccatcccattactgggtatatacccaaaggactataaatcatgctgctataaaaacacacacacacgtatgtttattgcggcactattcacaacagcaaagacttggaacccacccaaatgtccaacaatgatagactggattaagaaaatgtggcacatatacaccatggaatactatgcagccataaaaaatgatgagttcatgtcctttgtagggacatggatgaaattggaaattatcattctgagtaaactatcgcaaggacaaaaaaccaaacactgcatgttctcactcataggtgggaattgaataatgagaacacatggacacaggaaggggaacatcacactctggggactgttgtggggtgggggctggggggagggatagcattaagagatatacctaatgctaaatgaggagttaatgggtgcagcacaccagcatggcacgtgtatacatatgtaactaacctgcacattgtgcacatgtaccctaaaacttaaagtataataataataaaataaaaaaaagaaatttaaatgctgtctacttgaagaaaatgtttatattgaaatgttaaacaaaagaaatgcacttttaaaattataaagtatattttgttatctctttaattttctttcaattgttacatttatattgtgatcttcacaaacgaatcattatgaaacacttttgacaccaatttgatctgttgactaatagttcaattaattaatagctaaataggctttgtttcctttcaaattgattaaatgtttgcatagtttaaaaatagaaaaaaattacactaaggcattatctgagattcgtttgtaaatataaatcacgccattaattatactgcctaattcatgataatagagttaaggggtctgttttatttaaataattttctgtggttttcaacatgatttaataaaaatattcctgaaaaagatcaacacatttcccattgtgaaaattttttcatgaaattattatctagtatttaatcatgtaatattagtagattgtggtttccagttgctttgagataattacttccttttaccagaaaacttcaacatcaaatttgtaggcctgttgtcatttataaggtctgttcaatcaaggtcacaattctgtcttaatttcatagtattgctgtaacttcaattaagagatttttggaagtttgcctcatcaatttttctgcctctggccatgataatacataaaattgtgaggatataatatttttaattacttacttctgagaatcctcagtcctcaaagaaacttagccaaatatatgtatgttttgtttgtttgaattttgttttttattatagcccccatagttggtatgaagtgatatgttcttttaatttgcatttccctaatgactaattatgttgagcatcttttcatgtgcttgtaaataatttgtatttcttttttggagaaatgtctcttcaagtccttggtccactttttaaaataactgtttttctctgttgttgacttgtgaaagttctttatactttctgcatactaggcggttatcagatataagatttgcaaatatctcccattatgtggcttgtctttctctttccctttctctcgctgtcttgatagtgtccttagatacacaaaatattttaactttgctagagtccaatttatttttctttcattgctcatactttcggtgtcagatctgagatattattaccaaatccaaggtcatagagattttccgcattctttcttctaagaattttatagttttagcacttatatttaagtctttgatccattataagttaattatttatatgatgtgaggtaggagtccaacttcattcttctgtgtgtggatttccagttgttccagcaacatttgttgaagagactgctcttgccttcaaaaaatggtcttggcacccatgtcaacaaccagttgaccataggcccctgggtttacttctgaacttccaattgatcagtatgtttatccttatgccaatgatccatatatttatatttatgtcagtatcaaattatctggattactggtgctttgcaataagatttgaagggcaaattaccctgttatattatttttcataattgttttagctttggggctccttgccttccactggattttaggatcagctttctttaacatttacattttagcaaaaaaagaaaaaaatcattgggatttctatacggattgcattgagcctgtagattgcttttggtagtattttcatcttaatagtattaattcttccagtgtagtttattttggctgattactctgactagaactttcagtaccaatgttaaagcacaagggcaaatgtggaaatgcttgtcttcttccttatctaagtagataggtttcaatctttcacctttaaatatgatggtagctgtgggttttccacaaatgccctttattatgttgaggaagcttcttttaattttcagacttcccattgtttttaagatgaaataatgttagatttttttaaatgctctttatgcatgaactgagaagaatttctgtttatttctctttgttttatcaatatggtatagtacattgattgagttttgtatgttgaaccaccctggtattgctgaaataaatcacacaaaatcatgatataggatccttttaatatgctgctggatttggtctgttagtaatttgtgataaattatcagttcttatttttagttgggattcttttcttatcaatagcataaatcttctttatggcccatctttctggttttgtttcacaagaatttcaaaaaaactattataaaccatctttcttttccatgcagtcaattgaaattccctgataattatttttcataagagaaataactattttccaagtatggcctactacttctatttctaaatctctttaaattgagatggttaaagtacagtatagtaacaaccctagctatgtaatattaagattagtgggaggattaatgtcaatatttctttttttttattatactttaagttttagggtacatgtgcacaatgtgcaggtttgttacatatgtatacatgtaccatgttggcgtgctgaatccattaactcctcatttagccttaggtatatctcttaatgctatccctccccccagcccccaccccacaacagtccccagagtgtgatgttccccttcctgtgtccatgtgttctcattattcaattcccacctatgagtgagaccatgcagtgtttggttttttgtccttgcgatagtttgctaagaatgatggtttccagcttcaaccatgtccctacaaaggacatgaactcatcattttttatggctgcatagtattccatggtgtatatgtgccacattgtcttaatccagtctatcattgttggacatttgggtgggttccaagtctttgctattgtgaatagtgccgcaataaacatacatgtgtgggtgtctttatagcagcatgatttataatcttttggggatatacccagtaatgggatggctgggtcaaatggtatttctagttctagatccatgaggaactgctacactgacttccacaatggttgaactagtttacagtcccaccaacagtgtaaaagtgttcctatttctccacatcctctccagcacctgttgtttcctgacattttaatgattgccattctaactggtgggagatgatatctcattgtggttttgatttgcatttctctgatggccagcgatgatgaacattttttcatgtgtctgttggctgcataaatgtcttcctttgagaattgtctgtttatgtccttcacccactttttgatggggttgtttgtttttttcttgtaaatttgtttgagttcattgtagattctggatattagccctttgtcagatgagtagattgcaaaaattttctcccattctgtaggttccctgttcactctgatagtagtttctgttgctgtgcagaagctctttagtttaatgagatcccatttgtcaattttggcttttgttgccattgcttttggtgttttagacatgaagtccttgcccatgcctatgtcctgaatggtattgcctaggtttttgtctagggtttttatggttttaggtctaacatttaagtctttaatccatcatgaattaattttggtataaggtgtaaggaagggatccagtttcagctttctacatatggctagccagttttcccagcaccattaattaaatagggaatcctttcctcatttcttgtttttgtcaggtttgtcaaagatcagatagttgtagatatgcagcattatttctgagggctctcttctgttccattggtgtatatctctgttttggtaccagtaccatgctgttttggttactgtagccttgtagtatagtttgaagtcaggtagcgtgatgcctctagctttgttcttttggcttagaattgacttggcgatgcaggctcttttttggttccatatgaaatttaaagtagttttttccaattctgtgaagaaagtcattggtagcttaatggggatggcattgaaactataaattaccttgagcagtttggccattttcacaatattgattcttcctacccatgagcatggaatgttcttccatttgtttgtatcctcttttatttcattgagcagtgatttgtagtttttcttgaagaggtccttcacatcccttgtaaattggattcctaggtattttattctctttgaagcaattgtgaatgggagttcactcataatttggctctctgtttgtctgttattggtgtgtaagaatgcttgtgattttttgtacattgagtttgtatcctgagactttgctgaagttgcttatcagcttaaggagattttgggctgagacgatggggttttctagatatacaatcctgtcatctgcaaacagggacaatctgacttcctcatttcctaattgaatgccctttatttccttcccctgcctaattgccctggccagaacttccaacactattttgaataggagtggtgagagagggcatccctgtcttgtgccagttttcaaagggaatgcttccaggttttgcccattcagtatgatattggctgtgggtttgtcatagatagctcttattattttgagatacatcccatcaatacctaatttattgagagtttttagcatgaagggttgttgaattttgtcaaaggccttttgtgcatctattgagataatcatgtggtttttgtctttggttctgtttatatgctggattacatttattgatttgcatatgttgaaccagccttgcatcccacggatgaagccctcttgatcatggtggataagatttttgatgtgctgctggattcggtttgccagtattttattgaggatttttgcattgatgttcatgagggatattggtttaaaattctcttttattgttgtgtctgtgccagactttggtatcaggatgatgctggcctcataaaatgagttagggaggattccatctttttctaatgattggaatagtttcagaaggaatggtaccagctcctccttgtacctctggtagaattcggctgtgaatccctctggtcctggactttttttggttggtaagctattaattattgcctcaatttcagatcctgtaactggtctattcagagattcaacttcttcctggtttagtcttgggagggtgtatgtgtcaaggaatttatccatttcttgtagattttctagtttatttgcatagaggtgtttatagtattctctgatggtagtctgtatttctttgggattggtggtgatatcccctttatcattttttattgtgtctatttgattcttctgtcttctcttctttattagtcttgctagtgttctatcaattttgttgatcttttcaaaaaaccagctcctggattcattgattttttgaagggttatttgtgtctctatttccttcagttctgctctgatcttaattatttcttgtcttctgctagcttttgaatgtgtttgctcttgcttctccagttcttttaattgtgatgttggggtgtcaattttagatctttcctgctttctcttgtgggcattgagtgctgcaaatttccctctacacactgctttgaatgtgtcccagagattctcgtatgttgtgtctttgttctcattggtttcaaagaacatctttatttctgcgttcatttttttgtgtacccagtagtcattcaggagcaggttgctcaatttccatgtagttgagtggttttgagtgactttcttcatcctgagttctagtttgattgcactgtggtctgagagacagtttgttataatttctgttcttttacatttgctgaggaatgctttacttccaagtatgtggtcaattttggaataggtgtggtgtggtcctgagaagaatgtctattctgttaatttggggtggagcgttctgtagatgtatattaggtctacttggtgcagagctgagttcaattcctggatatccttgttaactttctgtcttgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaattgatccctttaccattatgtaatggccttctttgtctcttctgatatttgttggtttaaagtctgttttatcagagactaggattgcaactcctgcctttttttgttttccatttgcttggcagatcttcctccatccctttattttgagcctgtgtgtgtctctgcatgtgaggtgggtttcctgaatacagcacactgatgggtcttgactctttatccaatttgccagactgtgtcttttaattggagcatttatcccatttacatttaaggttcctattgttatgtgtgaatttgatcctgtcattatgatgttagctggttattttgctcattagttgatgcagttgcttcctagccttgacggtctttacaattgtgtatgtttttgcagtggctggtaccggttgttcctttccacgtttagtgcttccttcaggagctcttttagggcaggcctggtgttgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccgagagatctgctgttattctgatgggcttcccgttgtgggtaacccgacctttctctctggctgcccttaactttatttccttcatttcagctttggtgaatctgacaattatgtgtcttggagttgctcttctcgaggagtatctttgtggtgttctctgtacttcctgaatttgaatgttggcctgccttgctagattgaggaagttctcctggataatatcctgcagggtgttttccagctgggttccattctccctgtcactttcaggtacaccaatcagacatagatttggtcttttcacataggcccatatttcttgggggctttgttcttttctttttattcttttttctctgaacttctcttctcacttcatttcattcatttcattcatttcatcttccatcactgataccctttcttccagttgatcgcgtcggctactgaggcttgtgcattcatcacatagttctcatgccatggttttcagctccatcaggtcgtttaaagacttctctgcattggttattttatttagccattcatctaattttttttcaaggtttttaacttctttgccatgggttcgaacttcctcctttagctcggagtagtttgatcgtctgaagccttcttctctcaactcgtcaaagtcattctccatccagctttgttccattgctggtgaggagctgcattcctttggaggaggagaggtgctctgactttcagagtttccagtttttctgctctgttttttccccatctttgtggttttgtctacttttggtctttgatgatggtgacgtacagatggggttttggtgtggatgtcatttttgtttgttagtgttccttctaacagtcaggaccctcagctgcaggtctgttggagtttgctggaggtccactccaggccctgtttgcctgagtatcagcagcggaggctgcagagcagaacagcggctactggtgaacagcaaatgttgctgcctgattgttcctctggaagttttgtctcagaggggtaccaggccatgtgaggtatcagtctgcccctactggggggtgcctcccagttaggctactcaggggtcagggacccacttgaggaggcaatctgtccattctcagatctccaactgcatgctgggaaccactactctcttcaaagctgtcagacaggtacatttaagtctgcagagttttctgctgccttttgtatggctatgccctgcccccagatgtggagtctacagaggcaggcaggcctccttgagctgtggtgggctccacccaattttggccgctttgtttacctactcaagcctgggcaattgtgggtgcccctcccccagccttgctgccaccttgcagtttgatctcagactgctgtgctagcaatgagtgaggctccgtgggcataggaccctctgagccaggtgctggatataatctcctggtgtcctgtttgctaagacagttggaaaagcacagtattagggtgggagtgacccgattttccaggtgccgtctgtcacccctttctttgactaggaaagggaattccctgaccccttacacttcccggttgaggcgatgcctcgccttgcttcagctcatgctcagtgcgctgcacccactgtctgacactccccagggagatgaacctggtatctcagttggaaaagtagaaatcacctctcttgtgcattgctcactgggagctgtagactggagctgttcctatttggccatcttcaatatttctaacatattagaatctatttgattttttaaatctacataaactcgtgtactaacagttattttatttgtaaaacacttttttttcctatagtatgttggacttatcaatattttgaatatgtaagtcttaccctttggagtttactgtccaaagggcaaaccttatatattttaaatgtatagcttctaatgttctgattatagaacagttatgcatgggatataagcaacaatttgtcttccaaatatgtcatatttgccactgttttcatggattatatgaaacctgtgaataattgcttttgtgtatattgattcttcagttacattcagtggtggtaactacttgaaaatatttctgataactaagtttgaaattagattttaactgttcctgtaagtccctcattcagtgacttattgtgtaatgctattttattgcttctatacatcctatttcttatgtaatcatgcatgtaagatttaatcttgaatctttgaatatgtgaacctcactttattctactctcttgattgatagtttactgtagaataaatttgattggttgaaagtaattttctctcagagttttaaagtcattgttctattattttatggaatccaacattacttatgagaataataccaaccatttcaatgtgtctttgtaaataagctgtttttttttcccaatgggagaaacttaggatcaactcaatgtttttgctgctctagaaagtctagaaaaatgtggctaggttttttacaacatactattcattgagataccaagacaattaatactgtaagtcttcatctctaggaaattatgtttgattcttacaattgtgataattgttatccttcgttttctctattccagtgaacgaagtaccagtgatggtcactggggagggagttttaatcaacagcactaaggttcatggtagctgcttcagtttttcccaaatgattacttgaaaaataacttttgttttgttttgaaagtgggaagtttaaattggatgttagtgattttattgaggatgatggaagagtgcagttgatgagaatattttcatttgatcatcttattttcagcctttttactgtctgtaatttttgatttttcaggtctgcctcccaaccctctaagtgtattttaggaaagatctatgcccccttaacttcagtcctcttcataaatatttctggctgcaactacttgcactgtgttttattagcgcatgcctttttacatgccttccagaaatatgttggaatctctagtctgctaatgactaccaattgttcttttaattttaatagcttatagctcttaaaactgcctttaatctcaccgtttaggtctcatatgaggagaaaatttaaaaaattatattttctagtccatattcttcaaccgctgtttccttaaaatgattcattgacacaaaaaatggcatttggatatgcgaatggattccatcaaagccttcaaaatgggaggtctggcaaacaatttattttttcttacaatatatacctattcccaaaagttatttgactactttgtttatatattttgtgcttatttgactattctattccttagcctactttttctttacccactcttctcttgcctatctcatagcctatttcagaaatatgtttatgcagatttttcatctaaatcttttttcctgtcttttccagagtatttcttcagaatttcactttcttctgaagtagcttattcacatatttcctaaataccttttcttcccccccaaaattatattaataacttttatttaagttgtttgttttaaacctgttccattaaaaattccaaggctttgtttgtactactatgcaaactctactgcatattactcagcaatattggctttagctgattatatccagcaatgaatgcttcttcacctctaagacataaactgttttctgcagaaaggccttacatcagatggacagaaagtctcacaactttctgtaccttacagttatggttctccaaatgcagcatcgttcaaagtcacctgaagaacttggtaaagcactggtttttaggtccaatcttgtaatttctgattcaataggcctgcatgaaagccaagaatttccattcctattaagttcctaggtaattctgatactgctgatctgagagctgtagtattagaaccattgcctggagaaccactattccattggtaaaagggtaactcacatgtccttactctgaaagatggaaagatttatagaaagtccaaacaagtcaatagtttctgaaagcactaccttgtataattatgacatgctaataattttgtaggtagtcaacataaaagaaagatgtttgaggaggatataacagaaaactgggtttatttatatgtctgttggctttaccaatatctcacagtcttgggtaaactgatcaaagcacacataagttctaactctaatttttgcaaatactatagattctaaagagaaaaacaatgaaatgattatgaatctcatcctctttgtcagcatgcgtgtgtattgtctacctgtatgcccaatatttatgagttattatgtgctaatatgaaagaaatatttattaaatgtgctatgtttaacaaaataatgcagttcttccctaagcaatcacaaagtatgtatcattggctgaaatacaatcagatttgtcaattttccattttgtatagtagtgacatatgtgctacttatggaagaataaagataaattataaagggatttttattagtaaagaataaacttgcaaagtttcagatttatatttttttttcaaaaactgactatatcttatgctttaacttttaagaaatgttagatagcattgacaaatgtctacttcctgaaagtttgaattaatgaaaactgtttcttgaccatatatagccttcaaatagtcttcagaggtgtatatgggttgtgtgtgtgcgtgtatatgtgtgtgtttgtaatgatgtagtgaatacagaacactttttaaagtattagaaacaataaaagggtgcattagaatggatggcatctgcatcatatatatcacaagcttttaatatctgataatcagtatttttattatgtccagtgtgataataaaatgaatcctatgttgtttgttaattaccttttgtaaaatatcattttacattatactatcagcatttttatgccatcaaatatgcttctgaaaaattatttttattgtgtcatatgaaggtggcacaaatttagcttgtccctcaattaatgggaatttaaaaaaatttgttttctaagagggaaattgccaagttaaagtgtataaatatatttatggctcctaataatttttttataaagccattatactcctacctgaggtttcattttacattttaaagtatgcttgttacataaatagtctatggttatttatatttttaccaatttggtaggtaaaattataatatgttatatagttttaatcggcatttttgtaactttgtttggaatagaagtttttaacatccttttttgctacttgtatttgaaagtgaagaataaagcatttatggctttagtgggtataatctatcctgtcaaagcagaaaaataattactaaaattttgtaaaggttatttttatactattttcctattttaaatctaaagatatggggtaaatacatgcattattgttatagttacttttagtattttagatttacagacatttctctttctctttccttttttctcttctactttgtatgcccttaagaatgacttatttaaactcatttgtcaaaatcagaattagtgcataaatagttctatggataagaaaaactctgttttatatgtgatccaaaatgcaatatatgaatgttatattgcctagaataaacgttcttaattttttagggaatggaactcattatgaaacatacaaacatgtttacctgtttgacagtttaccataccagaatcgtttcttttgcaaattgaagtataatgaattagtacaatctctgagaacacagagatatcacatgagaatgaaatctacagcatttaactttcagatttattctttcacttattctaggtgtatatatatcatttgtaaagtgagtgactcttcactttttaaatctaggaataatatcagtttttttttcaggaagaaacttcctccagtcaactcattactaaatatttgtgtgagtgtgtgtgggctcgtgtgggtttgtgtgggcttgatgtgcttttctcttagttgaataacagtatcagtcctataagcatgtaatgatacaagaagacaaccaaaaaagatctggaggcatccttgttatacaattagacaaagaaaatgtgtgtgtgtgtgtgtgtctgtgtgtgtgtgtgagagagagagagaaggagggagtatttaacgagtagcttctaaaattttgagatgggatagattaaatggagctaaatgttgaatttataattactaaatatctatgtaattattaaagataaaatttaaaataaaaatagggcatagtctttttttattatacttcaagttttagggtacatgtgcacaacgtgcaggttagttacatatgtatacatgtgccatgttggtgtgctgcacccagtaactcatcgtttaacattaggcatatctccaaaatggaaagctaaaataacctttacattttaagaagtgactgaattttagtttatgattgactgtcttctagcggtagaattgacatagttcagaaagggagctaaatgtgcctccactgtgataagaaatgggaagaaaatagaaaaagtaattgctttagcaatgatctagtatgaaagtgatggattctttcaggtagaatttggtaggctttcagtggctggcacattcttcggagcactcaatgaggtcaaatatctcagtgtaggaaggtgtaaactgtttagaaacctgctaccatccaacaaattgaaactgaactgatgttagtgtagctgtgcactaaggcatgtttttctgtgtccatgagtatgagatgaagagggactatctcttaaagatttttctatctgatactcttcaggatctaatgagatcagccagctacagataaacaaactgatgctgaacctgcaattggccatctcctctcagctaacccatttgtctttagctgttctcacagagggaatgacagtgcatttatttagggcaaaagaaatacctatttttatataactatttgagaaaagaatcaagatgagtcaataaagatgtagcaaagtttggcttttggatccgtcctgttttgcttctctggccagctacacacgtttggggaactaatcatttactttgacagagtttcctgcatcacaccttctactgaattttctaaaaaagcaaaaagtattttgtcctccagcattcaaacaccaggtggtctaatttttgcctgttggctcaaaatatgtgtttggagattttctccctgacctgaatcgatcctctaactgacagagcaatgtaaatcttggacataaacaacaaagagtgtgtttctactggcaaagacagtgtaaattatggaggatttatgtactatggtaataaattaagttcctacaagtgcttttgtttgaatagaaatatcaaaatcccaaggcctgttgctttagacatatacgtgatttttttagtccaactttgattattagcttatatccctttactcccctgatgcttcattcatttcagaattagtacttggggaatctcctacttcagtcccagaagaaactgggttagtcacagatagttcttcatagcatgcttcttctcacagtggtaccaacgaagcatggcaatgcaatacattttgtcctccaaatcatcagccatgaaaattggtccttaattttgtctttactttccattatttatataaacctataagaaaagtacttgttttataagcttgatgtcatttcgtgtagtgtgtactagaaaagtattgccttccaggtaaaagagaagaagagtttgtttcttttttatagtagtacctaattgtatttcagttctggagtgcccacatattctgtagctttgaaaattacttggcaaatccattttcagattatgtatactgattatgatttttacaaggtttggttcttatttactttcagtaatttcctttcctgttagaaaaatctaaatattgctttgttcttctaaaggaaactctttaaccaattttctctggaggattcttagttttctgacatctttttgaaattaaggactagaaccacactatctattagaagtacatatattctatgtatgtagagataatgttttctgatgttttcactactgtttattatttccatggttgtcatcactacaacagaatcatccattttaaatgagccttaagttttctacttattaaatatcttgttttttgaataaaaggaacttaacaatagattttatgttgttctatataaaattgttctccaaaaattcgcaaaattttttatttatttatttatttatttatttatttattttgagacaggatctcactttttcacccaggctgtgcagtggcgcagtcacacctcgctgcagcctggaccttaagcaattctctcatctcagcctcctgaggagcttggactacaggtacactccaccacaactggctaatttttttgtattttttgctgagacagggtttcaacatgttgcccaggctggtctcaagcgatgcaccctgcttagcctcccaaagtgtgtgactaaagttatgggccactgtgcccatccaaatttttacttttacataggtaataccaccataagttcaaatattaaaaagcataaattcatgccaagccattagttttgcaccaaactgtgtgacccaaacacccaattcctcttccaaaattggtatagattcatatgcaaatactaattttctatcctttctaaattgaaattatatatgcattgtattgcacctttcttcaagtgtttaatatgttttggataacaatcttttattaatcttttattcctaaagagttccatattctttttatggctgtgtattatttcattacatggatatgctatctcacctaagtcttattgattgatagataaggctttcctaatatttttatattaaaaacaatgattcagtgaaacactgtgtacatgtcccttcacatatgtgcaagtataagaaaaaaataaaatctcaaaagttaaattgtttgatcaaagggtaaatgcattcatattttgccaaattgccctccaaaggatttgtaccaatgtggacttagcccggtgatatttgagagcacctgatttctacatactcattaagtgccctaacaaatttgtaaatctttattattctgataggtaaacatgttttctctcttaaataatttgtagcatccatacatgttattttctttgaactgtttacatatttttatcataatatttcattgtgttctttttatcaatcgtagacgacctttattcattgaggataatagatctctatgagattgctttattctgctttcttaaacacattcagaaattatgatcaaaacatgaatggtttgaaattattacaataactcagattgtttttgcagaaatatttcatattttgtgcttctcctcatgttttttaaatctcatttctgtttctacacaaaaggttcatagtctagtacaattatattaagaggtggtatttggtagctatatgaagaaagttgtgggtgatgaaatcagtgatagcatagtgactaaacataactgaattgcctaactcaaagtttaatccaatttttgaataagtcaagtagtagtatctttctcacctgcacatttggaattcccatgtttcaggcttcttttgtcattgtattttatttcctaattcagtaaaacctgtaattgaatgtattcgtttcctacgactgccataacacaatatcacaaatggagtggcttaaaacaacaaaaatgtactgtctcacagctcttagagcgagaagtgaaaaatcacggagtcagcagaggtatgctgccactgaaacatgtaagagagaaatctttgccacttcctagcttctggtgatggtcatcaactggcatttttttttactttcagctacattactccaatctctgccactgtcctcataaggcattctccctgtgtgtgtgtccacatttccctcttcttagtacaccaacagtcgtattggatttgggcccactctaatgatctcacctttatttgatcacgtatacagagaacttctttacaaataaggtcacattcagagggactgggagttaggcttcaatatattttgagtttggggaagccaattcaacctataacattgagtaatagcaggtaaccacaatgctttagtgatcttataaaaatgatgtcgaaaagtaagctctgtgttctagagtttgttttcattataaagattacattcactgaaagctctatgcatataatgtatctttagatgatagtctactataaatgttgatgctcttagctttagaaaaattcagtaaattctaaaaactttcttcaaattgagctgaactcatctgtgatctcactatttctgtgtcacaatcaatttgggaaataaacatattttaatattatattttctctttgttcatgacgggcatagtcaagtgatgattagtttatgtgattcattttattgcatttaatagaaattactaaccagaattacagctcaagtctctcgacagggaacaaatcacagcaaatgaatccaacaggaatcaatatgatgattcattagcaatgagctctcactgagagtcccaacaagctgaagacttcataccatatttttttatgaaccaaatgtcaatagcgaaattaactactaaaaagtatcacagaaatgtgctttattttaatatcatatttcacaattttttaaacaactgaaacaagtttatgtatttcacttttgcttctacaaattattttaaaatagtttccacatctcaaatatcatattggaataattattagaattttataaagtctgtttcccaaaatatttactaaatattttgtcctcataatctcactagaagattacattccattatatgatattttaacagttttctcattggtttaactgtggcatgtatgcacaaatacacatgcacatgaatccatgtgcagacacacacatatatgcacagcacaaggtcgaaagcacattaaaagatttctcaaatatagatatatcaatatataaatatgaaaaaagcatactatgtgtgtgtgtgtatatatgtatacacacaaacatatacacacacatatatatatacaaacacatacacacatatatatacaaacacaaatatgcacacatcaactttttggatatgacatctaattcaactccaaatttccccagttatactgtcatgaccttagaaatgaagtaggtagactgggggatcttgggataaggagtataacactgtttctgcagttttattttattttattttattttattttttgagacggagtctcactctgtcgcccagactggagtgcagtggagcgatctcgactcactgcaagctccacctcccaggttcgcgccattctcctgcctcagcctcccaagtagctgggactacaggtgccagccaccatgcccggctaatttttttttttaattttcttttttttttattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaagagtccccagagtgtgatgttcccctttctgtgtccatgtgatctcattgttcaattcccacctatgagtgagaatatgcggtgtttggttttttgttcttgcgatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgggagatggtatctcattgtggatttgatttgcatttctctgatggccagtgatgatgagcattttttcatgtgtctgttggctgcataaatgtcttcttttgagaagtgtctgttcatgtcctttgcccactttttgatggcgttgtttgtttttttcttgtaaatttgtttgagttcattgtagattctggatattagccctttgtcagatgagtaggttgtgaaaattttctcccattttgtaggttgcctgttctctctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccattttgaattgatttttgtataaggtgtaaggaagggatccagtttcagctttctacatatggctagccagttttcccagcaccatttattaaatagggaatcctttccccattgcttgtttttctcagtagagataggatttcaccgtgttagccaggatgttctctatctcctgacctcgtgatctgcccacttcggcctcacaaagtgctgggatcacaggcatgagccactgcgcctggactttctggagctcttaaaaaataaactttatttagaaagaaaacaaaaaacaaaaacaatttttggaacagttgtaggttcacagcaaaactgagcagaagttacagagatttcctatatacttcctgttcccatattaatataccatctgtcattaacaacatcttcctagagaacagtgcacttgctacaattgatgaagataacttgacacatcattaccaacccgggttcacagttaaagttagaactcacttttggtcttattgagtctatgggcttggacacatttttaatgacatatatgcacaattatggtattatgcagaatagtttcaccactcaaaatcctctggattctccttatgtatccctccctatccctaacccttgaaacgactagccttactgtatccacagtttcacctcttccagaatgtgatatactcatttatgtttcttccatgtcttttcatggcttgatagctcatttttttagtgctaaataatattccactctctagatgtgccataatttatcaattctccaacatctgtttcttccaagttttggcaattataaataaagctactataagcatcaattttcaggtttttgtctgaacataagttttcatctcctttggataaatagcaatgagcagtatggctggatcctacggtacgagtatgtttcattttctaagaagctgcctgtttttcatagcagctgtaacaatttgcattcccagtggtaatgaatgaaagttcttgttggttcacatcctccccagcatttggtattatcagcgttctggatttggctattctaataggtttgtagaaatatctaattgttgttttaattttaatttgcatttccctaatgacatatgatgtggagcatattttatgtgcttgtttgccatctgtatatcttctttggtgaggtatcttttaatgtatttggctcattttttgtttgttttctttttgttgaattttaagcattccttgtaaattttgtataatagccctctatcagatatgtcttttgcacgtattttctctcagtctgttgcttgttttatcattctcttgacagtatctttcacagagcagaaattcttaattttaattaagtccaagttatcaaatttttctttcatgaatcatgcctttgttgtagtatctgaaacgttaccatcaaacccaaggtcatatgatttttttttctatgttatgttgtaggagtttaatatttttgcattttgcatttaggcctgtgattcacttcaagttaatttttgtaaaaggtgtaaggtttatgtttagattcatttttctccaggtggttgtctagttgttccagcactgttttttgaaaaaatttccttttctccactgtattgtcttttcgcctttgtcaaagattggtatactgtacttatgtaggtctctttctggactcttttctgttccattgatctatttgtctgttctcttaccaataccacactctcttgaccactgtagctttataacaaacttttgagtcaggtagtatcagtcttccattttttttttcttcaactttaacattgtgctagctatactgaatattttgccacttcataaaaacttccgaatcatttagtagatatctacaaaataacttcctgtaattttgattggggttgtatattatttatagatcaaattgggaagaattgacatattgaaaatattgaatctttttgtccataaacataaaatatttatccatttattcagtcctttttatatctttcattagagatttgtagttttcctcatatagattctgtgcatattttgttacatttatatttaaatatttccttttggggatgctaatgtaaatagtgtgtgttcttggtttcagattcctcttgttcattcatggcatataggaaagtgattaacttgtgtatattaactttgcattctgccacactgctataatcacttgttagtttcaggaacttttgttgttgttgtcgattgttttggatttcctacataatgatatcacctgtgtacaaagacacttttaattcttctacaccagtaagtatacctttatttctctttgtataattgtgctaggactttcagtaaaatcttgaaaaaagagtggtgagagttaaccttgcctacttcctgatcttagttagaaagcttccagttttccacaatcaagcatgatgttggccatcagttcctttgtagatgtctttatcagtttgagcaagttctattcttagttgactgagagattttatgatgaatgactgagagattttatgatgattttatgatgaatttttggattttgtcagatgctttttctacatctattgatacagttttgtgatctttcttatttagcttgttgatatgatggaccatattaattgattctggaatattgaaccagccttgtatatccgggataaatcccacttggtcatggcatacaattctttttatacattgttggatttgatttgctaatattttgttgaagatatttgcatctatgtccacaacatatattggtgtgtagtttccttttcttataatgtctttatctgattttagtattcaggtaatgctgacttcatagaatgagttagaaagtattcactctgtttccaccctcagaaagacattatagaaaattggtataatttcttccttgaatgtgtggtagaattcatgagtgaacccatctgggccttgtactttctgtttggaaagttattcatttttgattcaatttgtttggtaaatattcacctattcagattgccatttcttcttgggtgagatttagcagattgtgtctttcaaggagtaggtctgtttcaactaggttatcaaatttgtggtcatggagttgtttacaatattcctttattatcatttgcatgtccattagatctgtagtgatgtgtcttctttcatttctgatgttagtaatttgagtccactcttcttttttttttttttttttccttagcctggctaaaggcatacagattttattgattttttttttttttcccaaaagactgacttttgatttcactgaatttctctattggcttcctgttttctactccattgatttctactctggtttttagtactactattattacttccagttactttttatttaatttcctctccttttcctagtttcctaagatgaaaacttagattattaatgttagatctttcttcgtctctatacaatcaatgttataaatatccctgtaagcactgctttcattacatcttacaaattgttatgttgtgttttcatttttatgtagttcaattttttttttaattttctgttaagatgtcttctttgacctgtatgctatttaaaagtgtgtttgtaatgccccgtaaccttcagcaatcccactgttgggtataaacccaaaggattataaaccattctactataaagacacattcacatttatgtttattgcagcactattcacaatagcaaagacttggaaccaacccaaatgcccatcaattatagactggataaataaaatctggcatatatacaccatggaatacaatgcagccataaaaaaggattagtccatgtcctttgcagggacatggatgaagctggaagccatcattctcagcaaactatgcaggaacagaaaatcaaacaccacatgttctcattcataagtgggagatgaacaatgagaacacatggacacagggaggggaacatctcacactggggcctattgggggatagggtagctagggtagagatagcattaggagaaatacctaatgtagatgatgggttgatgagtgcatcaaaccaccatggcacatgtgtacctatgtaacaaacctgcatgttctgcacatgtatcccagaacttaaagtataatttaaaaaaaaaggagagaagagaaaaaaaggggtgtatttgtttaatttctatctattttgaaaattttcagctatctttctgttatggatttctggtttaattttattgtggtctgagaacaaacattgtttgattcctattctttcaaatttgttaaaatatgttttatggcccagaatgtggtttaccttggtgaattttccatgttagcttgagaggcatgcttttctgatgttgaatgaagtacccaatagaggtcaattatattcagttcattgatggtgctgtagagttcaaatatatccttacttatttcctgcctgttggacctgtccatttctgatagaggggtgctgaagtttccaaatataatagcaggtttatctatttcttctttcagttatattagttgttccctgatgtattccgatgcaatgctgttaagtatgtacatattaaggactgtcatgtcttcttaaaggattcatccctttatcatgtaatgctcctccttatctctgatactatccttgctctgacgtcggctctgtctgaaatttgttttgatgattgttagcataatatatatttccccattcatttactgttaacttatatgtatttatatttagggtaagtttcttgcagacaaaatatagtcttgcttattgatccactctgtcaatcttatcttttaattgatatatttataccatgatgtttaaaataagtattgatatagttgggttaatatttatcttatttatgactatcttctatttgttgcctgtgatcctggttcctttttttgtcttctactctttccgcattttatgaatttaattgatcactttatattattccatttcatcttctttttatcttagcatatcagttatatatttttccttggtttcttataagttatttttagtggttgctctgaagtttgcaatataaatttacaactaatccaagtccaccttcaagtaacactatgctgcttcataggtagtgcaggtaccttacaataactccctaaaaataatacttaatatttctaacttcttaaaaaataataattaccccctccattctttgtatcattgctgttattcatttcacatatacgtaagcatacacatatatatgcatttttaataaaaacattgtttctgttattaatttgaacaaattattgtccatttgataaattaagaaaaaggtatttattttactttcacttactcattttctgatgctctttctttatgttgatacaagtttctgatctatttcagttttcttttctctgaagttcttcttttggggtttcttgcagggagggtctgctgacaacacatcccctcaaatttttttttttttttggtctaagaaaattcttatttctctttcacattttaaggataatttcacaggttacagaattttaggttgatgatattttcctcttaatattaaatatttcatttaattcttttcttgctttcatagtttctgataagtcagatataattttatcttagtgagtgctttttttctttctctctagtttctctcaggatttttgtttctttattttgattttcttcaatttaaatatgatttgtctaggtgtaggttttcttagcatttatcttgcttgctgttctctgaggttcctgaatctttggtttggtgtcagacataacttgaagaaattcttggtcgtgggtgattcaaatatttcttctctttttttttaattcttcttctgatagtctcattacatatatgttacactatttgcagttttctcacaattcttggatattctgtgttgttgatggtttttttaatctttttttatttttcttttttggcaataacaattgaaatatccttaagctcaggtagtcttctctcaaccatgaccgatctactaatatgcccaagaaaggcattctttattacttttacagtgtttttgagctctagaatttctttttgtttctgtctgagaatttccgtctctctgcctacattgcccatctgttcttacatgctgtctcctttatacattaaagttcttagcatataaactgtagctttaaaaattcccagtctgataattctaacatccctgccttatctgagtatggttctgacacttactgtgtctcttcaaactgtgtgtgtgtgtttctttttttagtatgccttgtttttttaatatatatctgaacatgatgtagtgggtaagtagaactgttgtaaatagacctttagtaatgtggtggtaaggtgtggtccttaatcataggtctggtcctatgattgagactcggtcttttagtgagcctgtgcctctggactgcaaccttcacaagtgcttctctgttccccctcccaccctcttttacctttaataggatagctagaatgggctgacgttgagtattttccttctcccagttggaaggctagagcctgctggagttgggcatttccctttcccaggtcatgtagactcgaattaacccccagtaggttaggttcaagttaaacagtttccccagggacagacattgtgaagaagaaaagaatagtgtatttcaaaatggttactttctcccttcccctgctggaagcatgaagggatttttttttcctctaatattcactgtgggaatctagttcctcaaggcaaaactcacataagtatgggcacccgcctatgactagatccccctagagtttttgactctcagaattttccacactgagtctccagcaagtcatcaaatacagttcaggttttcctatagcccagcaatagttcccacagaggtttctggtccagtaagttgcaattctccttacaggcgtatcttgccttagagacattgaaggttcagttccagatcacagccacaaagtgaatactgcaataaagcaagccacacatttttttgtttcccagtacatatcaaagttatgtttccactgtgctatagtctcttaagtatgcaatagcactatgtctaaaaaaacaacatgaataccttaatttaaaatacttcatttctaaaaatgctaacaatcttctgggccttcagcgtgtcataatccttttgctggtggagagtcttgcctgggtattgatggttggtgcctgattagggtggtggttgctaactgaggcaatttcttaaagtaaaacaacaatgcagtttgccttatcaattgcctctttgtttcacaaaagatttctctatagcatgccatgctgtttaatagaattttacccatggtagaacttctttcaaaattggagtaaatcctcttatccctgctgctgatatatcaactaggtttatgtaatattcgaaatcctttgttgtcatttcaacaaggtccatagcatcttcaaaaggagattccatctcaagaaaccactgtctttgttcctccataagaagcaactcctcattattttcattctcattttattgtcagattgtagcaatttggtcacatcttcaggctctacttctaatactatttctcttgttatttttaccacaactgcagttacttcttccactgaagtattgaactcctcacggtcattcatgaaagttggcattaaattctttcagacttctgctcatgttgattatgttgatcacctcccatgaatcacaaatgttctaaatttcatctagattggtgaatcctttccagaatattttcaatttactttacccagacccattggaaaaattgctatctatgacagctgtagccttacaacatgcatttcttagataatatgacttgagagttgaaactactctttgacccataggctgcagaatggatgttgtgttcacaggcataaaatcaatattaatttccttgtgaatctcgatcagagctcttgggtaaccaggtgcattgtcaataagcagtcataatttcaaagtaatattgttttctgagcaccagttcgcagcagtggccttaaaatattcaggaaaccatgctgtaaacagatgtgctgtcatccaagctttgttgttccattaataggacacagggaggatagatttaacagaattcttaagagctctaggatttttggaaaagtaaatgagcattggcttcaacttaaagtcagcagctgcattagcccctaacaagagagtcagtctgtcctttgaagctttaaagctaggccttgttttgtcctctctagctatgaaagtcccagggggcatcttcttccaatataaggctgctttatcttcactaaaaatatgttgtttaaatgagaacacatggacaagggaggggaacatcacacaccgggccctgtcaggcataggggacaagaggagggagagcattagaacaaatgtacatgggggttaaagcctagatgacaggttgatgggtgccacaaaccaccatggcacatgtatacctatgtaacaaaacagcaccttctacacatatatcccagaacttaaagtaaattaaaaaataaaaatctgttgtttagggcagccccctttgtcaatgctttcagctagatcttctgaataacttgttgtagcttctacatcagcacttgctgcttcctcttgtacttttacattatggagaagacttttctccttaagcctcatgaacaaacctctgctggcttctattttttcatctgaagctttctgacctctctcagacttcagagaattgaaaagacttagggcctttccttagattttgctttggcttaaagaaagatagtggctggtttgatctattcagaccactgaaactttctccatatcagcaaaaaagacttctttgttttctcaccatccgtgtgttcactataatagtacatttaatttctttcatgaacttttcttttacatttacaacttgctcaactcctcgatgcaagaggcctagctttcagcttatctttgctttcaacctgtgttcctcatcaagcctaatattttctaaattttgatttaaagtgagagaggtgggacgcttcctttcacttgagcatgtagagaccatttgcagagttattaattggcttaatttcaatattgttgcatctcagggaatactgggaggggggaattggggatgaagcaatcagaacacatgtggtgtttattgattaagatcgattcattttgccatcttttatgggcatgatttgtgtcccctccaaacagtaacatcaaaaatcactgactatagatcaccataagagatataacaacaatgaaaaagtttgaaatatattgagaattaccaaagtgtgacacagagacataaaaagtaagcacttgctgttggaaaaattgtgcaaatagacttgtttgatacagggttgccataaacattcaatttgtaaaaaaaaaaaaaaaaaaaaaaaaaaaaaaaaaaaaaaacacacaacatctgggaaatgcaacaaagatgaagtgtaataaaatgaggtatggctatatctgctcctgtctccaaaattttgagagtagatgtttaccttgcaatctcacttctattatgggtctaagaagagttgctggccttctgtgtgttcagctttttacttattgttgcaatggagtgatgatttccaagttcttacatttggggcaggaaattggaagtccaaatatagtattttcaaatgacagaagagcatattttcttcaaaaatatagccagtatcaatttaaaactcaaatgtttaaattcccagatgacgaaattttgtatattttctcttattctgatttgctgacttattcttttacaatatttatactgacaaccaagccctcctccaagtatagccaggagaatttagtcttctgaccaaattcttgttcattgattgaaatttataaagttcataccttttgccaaaaaccaggctcattcttagaaacagaaagacttacaggacaataaacttgccagattatgtggcagattcaggaggaaactctcacaatgtcttttgtgatatgaatctgtatctgaagaagtattcatggacttccacgctatgcaagacattctgacaggtactatggaagttaacagaaaacaaagggcaaggcctctgccctcaaaagtccattatttagttggggagaaaagcctgaaactgaaacatcaagtcatgacataagaaaaatgcaggatgttaaggagtagttgccttataaggtataaaagtggtatgataatacttgccaggagttcatgtgaggggtcgacccttcggccaaaaaggataaggtggaccacaaaaaggacaaagcccttgacctactttttggaagaaatataatttggatacaatgttatgctcatgattcacattatgctatctcacatccagatttcagtgggctctgatatagcttggctgtgtccccacccaaatctcaccttgaattgtaataatccccacgtgtcaagggcagggccaggtggaaataattgaaccatgggtgcagtttcccctatactgttctcatggtggtgaataagtctcacaagatctgatgttttcataaataggagttcccctgcacaaactctcttgcctgccactgtgtaagacatgtctttttctttcttcaccttttgccatgattgtgaggcctccccagacatgtggaactgagtcattaaacctctttttctgcataaattactcagtctcgggtatgtccttattagcagtgtgaaaatgaaccaataaaggctctgtgtgtctttctcttttgaaagtatagaaaataattagagctaactttaattagtaacttactatattaggtattatcctaaacaatacaatgattatgaggttgatctgatataggcaccgttgtcatgatcattttcggatgagaaattgagatactgagagattatgcaattctccttgattcacacaggtcagaagggatgagcataatcaaacctaggcagcctaattacaagtgtacccactttatatgtactctccacttaaggcaacaaactgataagggaggtcagtatgttccaattagcatttaaaatcagcatctccctctaataaatgtctaaattatattaaatctgggagccttgtgaattgtagtggattcattgagcaaactaattaagcatggttcaccatttgctggattgattttatatcacagaaatcaacctttcaaataattatgaaacaccaaattgaatataaactaaaccaggtaataaaaacacactccgatgcttcacagtaaaattcaattattattgctttttgaaactaaaataaattgggcaaagtgtttttgtatttagtctataggaaaatttcttgtttattattcatttgtttatcttagctctgtagcttttatttatttatatgtgtcatttttttaaaaaaatattttttaccagtaaaggaagaatcattaattctaggaaattgctggaaagcaagctctttattgtattctgtactacctgattttatgacttcagatctctcctgaagcatttcgtgagttctaatataaattcaaattcaactgtgatgtattttagttctataatgaaaataaagatgagctgtctttcaatttctggagttaattatctttgttgagttcaggattatgaaaatatattgtagaatgtggagggacaagactgtgcacaagcgagggtatagctattggatagctccaacaaaacatctttcagtgagcagcaataattctccttgaaatcttcactggccctccactccgaagtaatctctcctttctctgaatgtggaaagcggtgcaggatgtatctctattagcattctatcactacttaggttatttgcttacctcttattcataatgaatgtaagcatgagtgcaggaaccttgtgcgtctattttctagaacaccattaggcctgatgtctagagcatcaggctacaaaaacattttggagtataatttatcagtgcccaccttgcatagaaaagttttgatttatcaacatagaagcagagctaagtaataaaactatcacctatgttcatgaggctcagctagtgtgatgaactctggtgatagtcattattcccctaattttcacaacctctaaggtagatacaatctccattttacagattaacaaacataagttattaattttattaattaaatttgttggttaaaactcaggctttatttaaaaaaatagtatcactatttgttgagagacacagttcccaagtcatcaattttactattctggattgcatgtctggcctttgaatttgttcagtaataattagtgttgaacctcaaagccaagctattaggctacctaaatctagcaaaaaccacctctttttaaaatataaatatatgcagaacacatttatttactttaagaggatcacaaagtctagtttcattgatacatctcatgtttctcagtattttttatttattccttaatttatggaggtaatttagaaaacttaaaaaatacatcattcaatggctttaatagattcacatagttgtacaaacattgccacattgtaattttagaacagtttttctttttttactgcaaaggaacttcatgcccattaatagtcactcttcatttactccacccacgtcccctagccctaggcaaccactaatctactttctgtctctattatgtatttgtggtctttttgactggctgttttcacttactataatcaaaaacttgtgaagtttatttaaaaacatgtatttctatacagacacacacattcattctaatgatattacccaaagaaaaccattgttgtttattgtttggccatttcatattgtggtccatttccatgtgttcaaaaataaggctgtatttgatataacagagtttttacttaattacactgaacttgagattattcaagctaatataaggcaatagtagcataggttatgatcaagtcacttacatttacctttgggatatactatgtgtagttttgacagcgtgtttgcttaaataattatgttcagctagagtaaagtcaaattatttttgaattcccctagcacatgtcaactaggactagatagagatggatgtaaagtgtcatgtcaagcagaagtcaccataagattaaagtcttattataaataatccacaatgtgaacaatccaactatagataaagaattttgactgcatgttgtataactgccttattagatgctgaaaaatgtggacattaatacttggatggaaattgttatcatgattaataacaatgagttgtggcaattttacaattaagagaatgttttggggatccatgttatataatgagggtctttgtggaactttgataaaattcattcttctagatggaattacaactgataatcataatatagctaacatgtattgagtaattacattcccaggcactgctgtaatggttttacatgcactcagtaatttaatcttcctcataacgctatgagactcagattaaagaaagtaaatttcctatagaccaccagcaagcattggtggatgtgcaaaatttcttaattccatactttcgttttcaatgtgtttttgacataggataattagattattaaaaattgttttctctagtgaagaaatgctactattcctagtaccaatagaaacccttgtttccctttgaaagaaatatggagcgcctgaggactagataaccaaggttgcctgaggaaaggatcacaataacagtaggcaattctgtcccaagaatgagtgcttcttaaaacataaaatagttttaaaaatttcttaagatagaaaatgtattctcagtcagattttttaattttgactttggttaatcctaaaatttccgggctaacaatggaaaaatgtttcttaaaattctagccaaatgttttcatttattcaacagagttagttagtttgaaattcttcttgaatgtctcagtattgctcaatcaaatggaatctaggttagactaacaaatattgttgacattgagtaagaatgccatagagtgcagagatgtggtaggagctcagattccactaatccacaatattatgagtcatttaacacaaattatcgtcatttcagcagaaagtgtttgtacttaattgaagtaagtggtcccattcaaaatctttctttattcagtctcttcaatcaccaaagcaaaacaggatatatgcatctttgaataaatatctgatttattgtgtatctgttaatttatatagaatatattaatgttaaatggcaaaaactgcaattacttttgcgtcaacctaataatagattgtttaataaataatagtgcacatatttgtgataactataaagacaaaatagctaaaactaaatcgatgatatttgacctatgtagctaaattaagcctgtgtctttcatgtttcatacataaattctgagagcacatatctagaatatgatatcataaacatcaaaaatttgaaaatcactttcgtgttagtctttagaaatagtgagaaactgtgttttagaaataattttgttaaattccattagtgcactgatataaagctaactgatagaattatttccaaatatttatgtttagtcaggatctgagctacaattcagtaatggaaaaggaatcgttggtaatatgaaaatatttatcagtgtgtatttcataatattacagtgcttttgacattgataaagtaccccttgctttactacatgttgcttatcactggtaagtagtgtgttaattagcattgcatatatatatatatacacacacattgcatatatatgtatatatacatcgtgcgtgtatgtgtgtctgtgtgtgtattgttaaagctttttttaaaaaaaaaaatttgtacagaagaagactcagacttggctcatactcctgggctcaaatgatattctcgctttggcccctcaaaatgttgggattacaggcatgagccactgtgcccagatcatcttaaagctttaaactaaataagtagcaatgataggataagctttagaaataaatctctgtagggagcattctcataatgtgttctgtcttgattaaccactaaagaattttcttaatgcatattttaagcaggaagagcagggacataggcactttatacaaaaataaattacatatatttagtacagatttttatgttgcaatcaaatcctagatagttacacagaagtaataagggtgcagttgtcagttaaaattgctagtttttttccttttatttttagttgacatgtaataattgtacatacacagttatattttaatatatgtgtatatgtgtaatgatcaaatcagagtaattacatagccatcaactcaaacatttatcatttctctgtgtgtgaacatttaaaatcctcttttctagcttttcaaaaatatacactaaattattgttaatcgtattcatgctgcagtgctacagaacacttgaatttattccttccatttagctgtaagtttgtattcattaattcacctctccctacccccactcctcccattcttcccagtctataataaccacaattctgctccctgcttccatgagctcaattttctttagctcccacataggagtgagaatttgtggtattatctttctgtgcctgacttatttcacttatataatgtcctccagcctcatccacattgctacaaataatgggatttcattttttcaggcagaatagtattctattgtgtatatgtaccacattctctttattcattcatctgctgattaacacttaggttgactccacatcttggctattgagaataatgctgcaattaaaaggggggtactgtttctcttttatatgctgatttccattcctttggataaatacccaatagtagtggagttactggactgtaggatagtcctacttttagtttttttttctcagaaacttccatactgttctccatagcagctgtactaatttacattcttgtcaacagtgtataagatttctcttttcgcttcacctttgctagcatttttttttttttgtctttctgataacagctatcctaactggggtgagatgatatctcattatggttttgatttgcattttcctgatgattagtgatgaacagcatttttccctatacttgttggccatttctttaaatagattaagaagacaaaattttaagaagatatttagagaaaatgtagaaatatagagtaaaatatttgactgtgggggacatgaataaacgtaaaatataaaaacatggtttatgaataacagataatgtaacacaatttggtgctcttttcagtaaaatatatgtctgtatccaatataatttaagtgtactatgatcctagtaaaaatatttaaagatcttatttatctcagttttctagctctctcaggaaaataatttttttttttatttttaattttaagttcaggggtgcaagttcaggtttgttacataggtaatcgtgtcatgggggtttgttgtacagattatctcatcacccaggtattaagcctagtacccactggttacttttcctgatcctctccctcctcccaccttccaccctctgaaaggccctagtgtgtgttgttttcctctatgtgtttatgtgttctcatcatttagcccccacttataagtgataacatgcaatatttggttttgctgttcctgtgttagttggctaagataatgacctccagctctatctatgtccctgcaaaggaaatgatctcagtcttttttatggctgcatagtattccatggtgtaagtgtaacacaatttttttaatccagtctatcgttgatgggaatttgggttgattccatgtctttgttactgtgaatagtgttgcaatgaacatatgcgtggatgtgtctttataatagaatgatttatattcctttgcacatgtgccaagtaatgggattgctgggtcaaatggtatttctgtttttaagggtgtaaattaattcagccattgtggaagacagtgtggtgattcctcaaagacctaaggagaaataatattcaatttcttggaaagagggagacactctgctcttcccatctatattttcccaccttgatgtttaaatagaagagggataatgaaattatataaggaagcaggtgagtttggatcccatactctcataagaacagagaaatagttacaataggtggcatttatggaatggtatctatataaacatagtatgctctttgttttacatgccttaactcataagtcagtattgctaaagagaattcagtttcatagctgttgtgtaaatgagaaaatactattctacctctattatttattaattcataaaggggaagcaattagtttatatgccagtgaattaggtttcgactggaacaagtgtaggaagattaagagcaccagaacctgaaaactaaaatggaagtagccataccaatgtgagatgtgaaagtggagataatttattttataaggtaaactgtgataattagttacttctttatatttagcaaatattaaatgatacttattagtaattatttagaatactaaatcttatttttaaatgactgggaattgtaatacaccttctagacactttgcttttatcatgtgttgattaatgggatcttattaaactaaagagcttctgcacagcaaaagaaactatcatcagagtgaacaggcaacctacagaatgggagaaaatttttgcaatctatctatctgacaaaaggcaaaatccaaaatctacaaaacttaaacaaatttaccagaaagatacaaacaaccccatcaaaaaataggcaaaggctatgaacgacacttttcaaaagaagacatttatgcaaccaacagacataggaaaaaatgctcatcatcactggtcattggagaaatgcaaatcaaaaccacaataagataccatctcacgccagttagaatggcgatcattaagaagtcaggaaacaacagatgctggagaggttgtggaaaaataggaacgcttttacactgttggtgggagtgtaaattagttcaaccattgtggaagacagtgtggcaattcctcaaggatctagaactagaaataccatttgacccagcaatcccattactaggcatatacccaaaggattataaatcattctacgataaagacacatgtacatgtatctttattgtggcactgttcacaatagcaaagacttggaatcaacccaaatgtccatcaatgatagactggattaagaaaagatggcacatatacaccatggaatactttgcagccataaaaaaggatgagttaatgtccattgcagggacatggatgaagctggaaaccatcattctcagcaaactatcacaagatcagaaaaccatctgcatgttctcactcataggtgggaggtgaacaatgagaacacatggacacaggaagggaaacatcacacaccagaacgtgtcgcgggggtaggggggtaggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaaaacaaacaacaaaaaaagtgttgattaacaggccgggagcggcggctcacgcctgtaatcccagcactttgggaggccgaggcgggcggatcacaaggtcaggagatctacaccatcctggctaacacggtgaaaccccgtctctactaaaaatacaaaaaattagccgggcatggtggcaggtgcctgcagtcccagctcctagggaggctgaggcaggagaatggcgtgaacccggggtgtggagcttgcagtgagcagagatcgcaccactgcactccagcctgggcgacagagtgagattccgcctcaaaaaaaaaaaaaaaaaaaaaggtgttgattaacatctagcttattatttatatatgtgcatatatataatatgttgagcaagtagaataaaacatttctgtaagacgtgaaactgattttatattaatacttttttttctttaaaactgtttttcaaaactctgttataatgggatacttctagtaggcaatcttcaattccttaagatacttggttagaccattgtcatcatggatggaacaggcttgaagagagagttgcaatttgccttcctaacctataatggccacaacattagtatcattacttatatgtatcagtacttatcaatgaaaaatacatctatgtcatttattgtatcatatgatgtataccacatcagaatcattacttgaattaaactagtggtgattcaaccttctctgtcacctcactttttctttttatcgtgagaaatttccatgaacttattttgcaaattaagtgctttttacaatcaatgattagactattattagtaacaacttgcttgtcataagttttacaacttatcatagcacagcagcatatcaagaaatttgagcactgcaactctaggttacaaattattatcaacaaatgtagataatgtcaagagaatacgaatttaatatttaacaatgaaacatggagtgttttgatagcaaagaaactaacattctcttctgctcctaaggtgtaggcagtctacttacaagcagagaagaagcaaatttacatgactatatgtgtatatacacagacacatatacatatatgatatttgtgtctttgttgtactcattgaactgcatacaagtgctttttcttaagccaagttttcattaattaatatactagattaaattagtgaacattaccatatataagcagagaatatccagttttcaattacttgtttttattcttctactcaatcatagactgttgattatttagaagacactataaatatttcaccttggtcataataaataatgatctggtcaagtaaaaataaaaattaactgatagctaatcttgttatagtaataaacaatggacatagataaaatacatatgtgaaaaaatgaataaacaaatgatgcagtgtgtagaaatacccactacaaatttaaatcattttcgtagtgaatatatgatatatatctcatgcatgtctgttgtacctatcaattcatgaatagtgagatacagagacagatacacatgtacatttatgcagttgtagcaattgaacctgtgctgtgtgtgttctataacaatattatattaagtgaatatagtcaactcttgattttatatatatatacccttttatgatcaattttaattttaattctgggatattttgccctaagtatataatacatttctggcacactattcccacttcccaacttgcctattgtcagtcagagactacaaggcaatttagtatcaccaaagcaaaacaagattacaaaaatgaaaaatctgccatttggtattatctctatacttctccctatattagcagagaaaattgacttgatgtctattgctgactcttccagaattgtggcttcagcatagctgagtgatttcatggatatattagccagttggcttgaatattttacagcaaataagcaaaaactctcagtattagctttttcattattcattatctttatgaaatcatacactcttacattaaagtaggaacccatgttacgacacttactttactcatgaagaaactgagactcacagattagcatccatgactgactaaagtacaatttataatagcagatctgagagtagaactcatttttttcatctctatgcaattcattcaacaatcaatcagtaaatatttatagaaagtaatatgtattgggctctgggaaactcatctattattacaagaatcagaaagctaaaatgtaagcaaatatatttggaagataattacgtattaaaatatgtactatgcaggaagctaacaaggtaatttgtaaaaagtgcgattaacaggagaagttgtggtgatgcagacctactgaataatgggagacattttccctaaggagatgacatttgatgggagaaccgaaaagcaaaaagtagtcaaccacaaaaatttctgggagaggtacattctacatcaaaggaacaggaaatacaagggttcaaggttaagaaagaacatggggacttcaagaaacagaagagaaattaatataactggcatattgtgatgggggcatagtagaagatgaaaatggagaagcaggcatgagccagatctttgaagcccttcatgccctggtaaaaaatatagattttattcagtgtgaaatgggaatcctctaaagatctttaagcatacattatctgatttgaattttatagagaatgttctgactacaatttgaagaatcaattgtaggaagcaggagtgaaaaccattgctgtaatgtggatgtgaaattaagacttggactatggggttgacaatagagttggagagaagtcaagatatatgtttggatttaaaatcaataggatttcctggtcaggtggatatggagagcaagataaaaggaaatcaagggtgatttccatatttctagtctgagcaattagatagctacaatgtcagttattgagaaggaaaagactaggagaaaaacagaaatgggagagttattgatacagaattattttcacagtatgtgaagatgctaggtcaagagaaaatgtcaagtagtcagctggaagctcagagacagggaaatcttgcacaagttatacatttggtagtattgctagacaaagtcctcattaagatcaccaagggatagtctatataagtaagagaaggtgattcacgaccaatccataggtattttgtaattaaagaattagagtgtgcctatggaaagggcacacatgaaaggaaaataagaaaggatagccaaaggtgttggaggaaaccaagacgcactgaatgtttctcttcattccttttccctttattgtcctagaacaattattaaataattactgaaacatttttccacagtttgatttcagtaattattaaataattactgaaacatttttccacagtttgatttctaactctcattcctttattcctgtttattctctttaagaacctctataagaggaagttcattattcttgtccattattgtagtctcaccttcagtgcagtatctggaacatagcagacactcaagaactatttggtcaagaaacttatttccatttttgctgctgttgtttttattcctactttgtttcttttctcaggttatcctgtttcaagacctctaatggtctgatctaggtctcaggggtcccctctggcttgttttctttccctagcaggtataaaacaaattatggatgttgttagttaagagctacacttaaacagattaaaaatgaaggagaaatttagaaaagagcacaattcatgatttcactagtaaaatattattttgtttctttctaaattatgtaaattatatctaaggctgtgtacagttgctcatgcctgtaatcctggcactttgggaggccgagataggagaatcacctggggcccgagaccagttgggctgcaacatagtgagaccctgtctctacaaataaaaaattagccagacatggtggtgcatacctatagtcccagctacttgggaggctgaggtgggaggatcacttgagctcaggagtttgaggctgaagacctatgattgcacccctgcactccagccctggtggctgagagagaccttgtctctaaaaaataaaaataaaaatgaaaataaaaataaattatactcgtgctgtccgacattataaccactaggcatatgtagctattggtcacttgatatgtggctagtacaaattgtgatgggtcattgtacaaaatattccagatttgaaggcattactaacaaaaaaacctaaaatatgtcattattaattgaatattatatgctgaaaaggtaatattctggatacatttaacaattactaaaattaattgcaacttctaaaatttgtttaatgtggatactagatatttaaaatcaaatatgtagctccctttataatttattataattataataaacagtatttggatagtactgttctatacttttgatacacagagcaaggaccttagatgatttaggtacgactcagtgtattggtaggcatgtaaaatctcaggtcgtttttcaggcctatgaataaaattctgtgttttaagaagatccccacataatttgaatgcatgctgaagtttgcaaaatgctgctgtatatattgttgctgtctccaaagagcaaggtgtgattttgccttcgaacaatgacatatccaacctcatttccgatgtaattcagactaaaatctaaaaactgcaaatcctacagtgatgcacagaaaggttaatatcaagtgtgaacccagcttacaagccatagttctgcattttcaactacaagggttcatgtgccatactttggaattagtgcaagcaaaagccagctcacattgcttgtgcattttgttacctagagagatttgcatttagcaaatttagctcagctggcacttataaaaaagccattgccagaatgcctgagaaatttagtctcttgtatggtacttagagtggtcagcaggaatgttagcagacaacatctcatttttgcaattaatctgctttatcactacagtgtaatttaaaagaattttgtctagcaggagtctttttatttgctgggttgtgattttttccaggttatatgttattcccatgctaatatttgccttaataataatgtgtggactttaatataaatatgattttgcagcagcatattaattacaaatatgttgcaataacttcaagaacccaatttttgactattttatctttacatttgatttattagttttgtagattcttgatttgtttagatagggttgggagagtagagttcctttttaaaaatattaagtctatgtaaacatagtcatgccatctacttatttgcacttgaggttcagaaaaaaaatgttatgagaatttaaaattttgacttaattaatttatttgtataatattttaccttaaaaataattgaagataattgtgatatatcatatagatcacatttcaccatttaatatgattcagtacttaggcaatggaagcagaatttagaaacctctctttattggaattgaattatattaaaagaaatgaaaaataagttattaacacatttcctagaatatgcatcccttatatatttgttgttatgtagtagaggctgtcatttatcaattaccctctgtagtagacagaactaggttttaggagtcataatttttatcatttgttttgtttttcacaatacaaatgtgcaaatgtcaaactcctagaaaaatacattattcttcatatatattatatcaatgatataaaaactgagaattattagacctatgtgcaatgtagaaaagcattgaaactcatttcaaacatagcataaatgtattcaaagcattattgaggaagaatgaataatatgggtttgaaaatgtggcaaattatcccaaaaatatgtagctacttacccagctggcatcatggccacacaaacaaaacactgttcccacattgtttcacttactttccatggcaagtctcaagggcagtcatatcttcattcttatattaaagctgaatttcagaaaagccaagcaaattacccaagggcaaataggtaactgaaataaaaaatataattcatttctgtctcatttcaatgttgataatttgctcattacccatgcctcaataccagtcaaaactcaatatttctgtatctttggtgtcattttaaaatacttccagtatgtatgtataatttagtaggaaagtttgctgaattatacctatatatatgtgtgtgtgtgcatacgtcttaagatattgacagtcccaatagaataataattatttagttcatttttcataaaacattaaaatcactgccaaagtcactgatgtaaacactttgtgacataataaccactctgttccttagatgtagcagttaatgcgtgcgtattattgatcattatctagttgtaacagtaaaagtaattgtacacttgagtaattcttgtaattattattagatgtattccatgtctacacttgtaaatgtggaaagcatcaatagttcaaaagttttaatcaagggcagagagattatatctgcggctaaccctcatttccaaggcctccatctctttatattgtatctttatggattaaaagttaatgcagtttctcagtgcctgcatcaccaacaaatcacatacagtgagttgaagctggatttgtgggaacaattactgttggttgtatttattatataaatacatttgatgattcccaacagttctggagagacatggtcttaataattcaggaaaatattgggaatgcattctctaaaaacacagctaatcaatacaatatagagactaataacaaaatgaataactttttaaaaattatttccattttaattctttgttaaactgggaaaacgcacatctatgcagatcaacaactgtaaatgattttaaattgtgcaatgtggaagtgaacgttgctgagtttgcccaggacaaactgtgctgacatatgggaaatttagtttatttcagtttttacagaaaagtatcttcacagtctaaagtactggtaaaaaaaaaaaaaaaaaaaaaaagaaaaagaaaaaagaaaaaggtgactcaggaatcaacacctatatgtgataagtaggagtctcatttttactcccctactcaactttctctctgttagatgtgataatgaactgtgaaatggtcaaaatgagaggaagaaaaaaggatgcggctaatttccaaactagatagtgtcaaattcagagttgtctacagtaacattagctcttgatatttgtgataaacatgtgatgttgcaaagtatataatattaccagttgaatagatgtagttatatgaatattacatgtaaatttcttttaatcattttagatttaaaaagttgaggtacgttcagattaatttatgaaaatgtcattttagcaatgacatattatttgagtgattaaaaattactcaaattcaattgaataacctacataagttctaaaatcatcagaataattcttcacacttcccattttatcagtttacacacctgatttggtcccaaattctgattcttctgctctgccctttcatcctcaccatcaatgccttagttcattttctcatcatctttcaccaggatttttgcaatagtcttctgcctcctctcaaacattctttactcatttgattccccacattgcctccatggacattcagattccacttattgtaaagtctgctttttcatagttctttggctaaggtgttgtgtagggtaataaagagagaaataaaataataatagatgttaagcagagccatgtattaaaagttgcagattattttaagaaataatttctacttttttaatttaacaaacactcattaagactcattaaccgttctcattaacctttagaggatacataaattatactatatatcctattctgaagacctccaagtagagaggaagcatgtattattgccaatgccaaaaaatagaaactatgtatcaaactgggtcagctctgattataggaagccaagtatctaccgtcaatcagagataggaaggaaaatctccctcatgtgaaaactaatggtggttttaggaatattcctatctgggagtggatggagaagagtgtatcaattaaataaagtgatttggcacacaaaatacaacaatattgatatataacagaatacaagaggatgggtaattaatcatgaacagaaatttatttcctacgtttgctcttggaaaatccaagagcaagttcccagcacctggagaggaactttttactgtgtcattacatggctgaaggtgaaagggcatgcaggagtcagttccatttttaagtgcctttttaaggttacctaagcccattcacaagaaaggaaccctcatgatctattcagctcttaatggccccacctcttaatgtcatcacattagcaatacctgaattttggtgaggacatattcaaaccacagcagtaatctcatgatgcatttacatcatttgacatatctcatttttttgtcttcaaattatcaaatattcttttataaacatatagtatatgattatgaaattttcataatttctaattcattttagtctcataagcaagaaggaataattcattattataatttcttatatatttcagttagaaccctttaagatggaaaacacctatagttagtgcctacatagataaattaagtagaaataagtcaagttttacagatttgccttatttgcctcctcttctaactccaactgtccaattagtctctactataagggcacactgaaataaaggtaggaaggctttactgtcagaactctgtatatgtttattttatgtcaatgctaagggggttcttttaggtctagtgaactaatagaaaacaaaactaaacttgaagaaagaagcaatagcctgtaataggacagagactgggattttgtgccgataactcaacatgtaactttggacagggtacataacctctttggccctcagtgtttttgattgataaaataagaaacttcaatttgatcatctgtgatgtttcttctaattcaaataaagtacagctataaatatttttcataatgaaccaaaattgactttcacaattagccagtttacatgatatataaaaacattgtcatccttctatttttctcatatgtacttgtctcttttttctaaattactggaaactcatactattcctctactacatttttcctctgccaccatagagttacatcagtctttgaacagaaacagaaagtgcagaaagcctgtcactaacgtgacctcctcacagattttgaattattacctcaagaagagggaaagttggaacagcttatatcattgcagaaagatattttacctgtctacatacaatttttctgtgatatagcttgtttactctttgttagagaaagactggcttgtatctttgtgtcttggacacagtacagttgctccatcatttgcagtacagctaatactcatttgggtaccatgcatggatacatctattatctcactttgttttcaccataaacctccgaggtagagatgaccattttcctcatttcgagtaaggaatccatggccaagagaagtgaatagcctactgattccattagctaaactaaagactatttgaatttcaccagatgtccttttctgttctagaatctgacattgcacattgtgtttggtctctggagtctcctccaatattcaacttctttttttttttttcccagtcttgacaattttaatgagtagtagtcagctagcttctttgttgagtctttttcaatattagctttaaaattaaatttggattatacagtatgggcaataaaatatcatagaaatgatattttttctctcactgcttcttggtaggactacataatattaacaagtcttattactgattgtattaaccttgactaactacgtttaacagtttttctttactgtaacactgtgattctcctctttgtattggaaaaacatatgagggggaagtttttgagactgtaacaacagcctgataccttgtttctcctcaaatgtttgctcactgatttcagcatccaatgatagtctcatctgcaacaattattaccgtggtttttgccaaatgatattttatttttataatttcttatatatttaatccaaaataagggtaattttttttttttttttgagacggagtctcgctctgtctcccaggctggactgcagtggcgcgatctcagctcactgcaagctccgcctcccgggttcccgccattcttctgcctcagcctcagctgaggactggcctcagctgcgactacaggcgcccgccaccatgccgggctaaatttttttgtattttttagtagagacggggtttcaccgtgttagccaggatggtctcgatctcctgacgtcgtgatctgcccgcctcagccttccaaagtgctgggattacaggcgtaagccaccgcgtccggccggtaaaaatattttttatatggtctcctttatctctagtcaacgttcttctctcccctcttctctcctgaaagcatgacaaaaaaatgatttactgcatgatttttatttccagaatgaatgaaggtaacatttttgatgactttgtcctttaaaggggttaagatattacactcttttcaatacccaaaggcgaactgtaacattcccacaaatttgagaaatattccgcttatgattgagtcagatgttgtcactcagccacaagttatcttccagagtttgaacttcctattgaagttatacatcaattatagaagctgactgaaatattgccatagattatatatgtgataggttctacatctgaggaggaaagcatctataatacattttcattaaagcagctctcaattcaccgtctgcttaattcctacattctcatgcatataacttatgagcagttttcaaaaaatgaaagaaaattgaaaatgtagcacagccaaggcatgcattggtggaacaggtaaaattgatttttatatttgcttggggacatggatcacttccctgaatctggtttgcattgatcagtgttgatggactatagattaaatgtcatacataagcccccattttcaaattcattatcctcaagggaaaagtatctgaagaaggatggactatatttataatccatgccaatatcaagatgaaatttgatacatctgaaagtgagaaactctaggaagaatactatttgtattaataagaggtaaaatattttcaataaagagtctattttttgattaaatcagccaataagtcaagaaaaagtgaaaaatatatgtgttgagggtctactttatacctctctgcacaatgagatatagggtttaaccacagaaattctttctatttaaatgttggtcatggtaggcacaggaaaacaaggaaagtggcaaatactgaaagtcagggttacttcctcccaaccctagaaaactactttggtagcacaccactggcgaatagtgtagcaatgttaactttctggtttccatgattgtgctaaggttgtgtaatttattaatataaaggaatgctgcctagggggtatatatgaactgtgcactgtatttgcaactttcctgtaagtctaaaattatttcaaaatacagacttttttaaaaagctgtaacagaacaggactaaatattataaatactgtataacaataaaataatttatatttttaagttcttatgttctgaagataacgtaaagataaataaagtccttgtcctcaaagattcattgcttaacatagttgagagctcttagaaaatgtggacagcttggtgagttgacagaaactgagtggtatagggtctttccttccttctttttgtcccccaaaagcctcaaacctgaaatattccaggagttaatagaaaaataatgtatacccttgaacaaagttttatgtgtgaaatttcagagtagattcttaacaaaggatggaaactgtgcaaatattattgtgtctatttataactgatttacattaattttcatttatcaagtactgattttttgccagctctcctggttcagaaaggaaattactgttatactaaacttacgagtaagaaatcagaatctctaaaatacggtgactgataaaatttttttttagtaatgggaaatggaactaagatttgaacttcctcaccattaaagaaggtacaggcaatgttgatagccacagcacaagacagaagggtaactcttcatgtaatggcttcactgagaaattgtagtgcagcctaaatggtgtacactcagtgaaattgccagaacagtgaggttcctttgtttcaacaactattatttataatgttgtgggggtgggaggaggggagagggatagcattagggagatatacctaatgttaaatgatgagttaatgggtgcagcacaccaacatggcacatgtatatatatgtaacaaacctgcacgttgtgcacatgtaccctaaaacttaaagtataattaaaaaaaaataaaaataagaaataaataaatgaaaagaaaaaataaatcctattgatgctagaaaaagtaattatagttttttcttctaatgagatgatatggtttttgaaatattttattgaatgaatttagacttagagattgtcatttttttcagaatattaaaacaaaaaatatatacttgtagaacttggcaaatgccaactctctctaattataactgttaaaatacaaatactatatggtaccgagaatgggagtaataaggcaatatttaattagatatctgctaatatcacatagatgttatgttttgtgcttcctcatgagatgtttgagggatttcagtgatatgacattttttcttcagtgcatattgtgttacagacttaaaatttacattaattgatcaattcaattatttatttattcaattcatttattcaataactattcatattggttatctatggctgtgtcacacattattccaaaattcagcaacttaaaaccacaaacatattaccttatagtttttttgagttaaaaatccaggaatggctcagctgggtgcttctggctcagggttcattacagaagctataatccagatatcagtaagggcttcagccatctcaaggctcaactggggaagcatcaactcttaagctcaaacaggtggtaggcagggttttgctcttcaaggactgttgtactaaggcttcagttccttgctgcttggtggctgaaaaccagtgtgaatcgctctctaaggcagttcactacatagcaactgatttccttgagtgtgggcaagtcagacagcaagaaaaaggaagcaagacaaaagccagactcttcttgtaatctaatcttggaagtggcatcccttatttctgctatattttatccattagaaacaggtcactagatccagatctcacttgaagagagaggattgcacaaccatgaatcagagatcattggggacaatcctacaggctgcttatcatggtatttattacattttaactggattacccaatttatagacacgaaaaagattgatcatggttttatggaatggcttaacttatggtccctatcctagaagtaattaaaatccctggaagaatatagaaaaataaatggataaattctaacaataatatgataaatagcataattgtggaataaacaaactgacaaaggaaaacatgtggtgtgttattcactctatttgggaactgtaaggtctaaagagaaaatggcataactgatacatgaagagaaacagcctcataattagtatcaaggtattctgtgtttcctataatattttaggtcaacttcaatttctaaacatataaacaatgatctttaagtatatataaaaatccctggccaggtgcagtggctcaagcctgtaatcccaggcatgggaagccgaagcgggcagatcacgaggtccggagatggagaccatcctgactaacacggtgaaaccccatctctactaaaaatacaaaaaattagccgggtgtggtggcacacgcctgtagtcccagctactcgggaggctgaggcagaagaatggcgtgaacccgggaggcggaggttgcagtgagccaagaccatgccactgcactccagcctgggtgacagagcgagactccatctcaaaaaaaaaaaaaaaaaaaaaaaaaataataataataatcccatagctattttatatgtgtgtgcatgtttatgtgtgtgtatatatgtatatgtacacatatgtatgtatatgtaaacatgcaaaatattccacaaaatagaatgagagggacatgaagttaatgcagcttttatgaaggaggtggtgactccttcaccgagatggcttatcatataagttagattttctcaaggtttgcatcccaataaaaaaaaggtacgataggttttaagctgtataagtgaatgtataactagtatttgatgtcattttactaattatcaacacagctgctctggtctgaaatttttaatgtcatgacagagctaattttaataaaaggtaacattttatgaccccaaataaattacacaccaatatatgcatctgctgcactaaagtaccataatattaacctgttaacaattgagccaaaatctttcacacaattcatcataatttatctgggtgacatatgactttcagatgctacatctctttactgaatgttttgaaaattgagctaagacaaaaacatccgtttatatgaaagaaagaaaaaacatacagaaatattgtaagattctaagaacatttatttaaaatgttcactttattaagaactaggcatcaggaattgaaagaaaaacctagatgggaggaatttactgaaatctccgtgttaaaaaagagagcatagcacttgtctggctttggaaaatactttcacagtaatcaaacaaaataaagacatttgatagcaaacacttggaagtggaaataggctaagttctttaattttttatgtaaccttctttatgttggtgtatagcaaaaatacatgggtccaaaatagagtggcattcatcttaacattttctgtgtgtgtgtgtgtgtgtgtgtgtgtgtgtgtgtgtgtgtgtgtgtgtgtgatatatgtatatatatatgtacgtagatatgtgtgtgtatatatatatatatatatgtgtgtgtgtgtgtgtgtgtgtataattttttttgagatagagtcttgatctgtcacccaggttggctcactgccacctgggttcaagtgattctcctgggttcaagagattctcctgtcagcctcctgagtagctgggattacaggtgcacgccaccacatcctactaatttttgtatttttagtagagacggtgcggggattcatcacgttagccaggctggtgttgaactcctgactacaggtgatctacccgcctcagcttcccaaagtgctgggatgacaggggtgagccaccacacccatcacattttctggccatttttaatgtgttagtaaatgctacgtatatttacattgcaaatattataccctgtatcatgataatttgaaatgactgaagaaaaaaaaatgaagtccaatactttcacagacacagagacctaaatgaaagaacaaaagatgacagccctagaaacggatttgatggtgactactgaaaatatacaaacacaatttccattgccctctagaaaagtaaaaacataagcatgatagctctaaaaaagacaagtctgaatgtactttagttcaaattattctagcacacatattgtagtattgttactaaagaatactataacaaaattactattatgaaaagtgggcaataatgatgataatggtagccatcttgaatgtcagctcaatatgccaagaattacactaaactctttatatattttctgcattacggacaatgactctgtgaatagggtattattgtttcattattttttatgaatttaaattacctgagatttatgaatattaagcattaacccaagtcacacagagaattggtgtgaaaccctgactttgtttaaattttaaagctcagaatcttgcagggctgtaataatcatggtttgcaatactcttgaagattcaataaaagggatttataaaggacatatacagactatcaggacactcttggcaaaacataaaagtaggccaaaaaaattactgtagtctttgtttttgaatctcagagtaaagcatagtaagctatcaaactgacgataagtgtgaaatcatgaattggaataaatgtggtgtaaatgagatatcattatctgacgaagtccacaccatagaaattaataaaccatctccgtgcaaataattaatgctgtttaaccacccaaagggtaaatagaatgtgaatcgaatgtctcaagttggttttatttataagcagtaaacaaagttaaagaatgttgctaagtataggataggcaacaattaaaaagcaaggaaaatgcttttctgagatctgctacacatttgtagatctgagtttcttaaaaaggattttatcgcttgccaaacgttgtagaaaattaatgaataaaaactaaatttaaaacaactaaaaagtatcaggagactgacagctgcacctgcgagtaatttaggcctgagtacaaatacacaaaagttaggaattaaatccaaatgacattttgaaatttactcttaaaccaaaacaaacaaacaaaacacattaccacattacaggatacataggagtgatatttttgaagtttttttaaatacaaaaatgtattttccaatactttatatcaacgtatgtgaggggaataagaggtacattggcaaaggtaaattgcactgtctcgtagccctgcacctttgtaacatttcaggaaagtcagtggggatacccagtaacgatgactccttttctgtacaaagttgcatcaggtagaagaaggcaaacccagtttaaagaactgggttgcctgtaagaccatgtatctttacattttcactatttatctcagaggatgagccattctcataaggtaaatacgggacttttccaaaccacttttatgagtgggtcaaaggttaaccacaaaatttaggtcagaggggggcattatagtgatgtctctgagaatggatgataaatattgtttcatggcaacttcagatttatttaccacaactcctcatcatttctaggtgcacaaataatgcaacaattctatgacccctggagcctcaaatgtgttgaattattttatataatagctaggcactgatagtatagttttgtagttttaaagtattatctggagttattttatttggggtattatctttataaaatgcaatgtatcttttccattttcctttatcttcagtattatattttgcaatttcatattgtgacttctatataataaggaataattagtgcacattagtgaaactcatctttatttgtgagaatttccatttaagcttggatcaaacatgctggcacatgactgcctttgattttacctgtaaaacaatagatttttgtagtccagtgagcaataaatgcttcctgcctctcctctatatttaccagtagataataatgaaatgtcacagacttgaacattattaaacttatatttgagatgcctttcagaatttttcacgtttcctgctgctgtctgccttttctcctctttgttgtgtctcataaatttttatgacctctttgcgttggaaatctgtaatttttcccagagctctgctaggtaccttctagcagtaataaaactcttgtcactttccattgcagctactttcagagtgaggcttactggcttcactctgcagcatattagataaaataatcaatatgctcaggttgaaaaattaaatgcagcatttgtgtatccatcgaattacagtgctttgagcttggaacagatggccttgcgagacatttgctagcttacttgagagtggctatttttttttcttctttttgtttgtacttgattttgcatttacaataataataataaaagaattgcccaagatgattggtataaaattcatttggctattcttgaaaaacaaagcattgtaagtaccaaaaataatagtagcattaaaaaaaaaaaacaaaaaactttctgttgaatgcagttactttctgagtaaatttacagtattctcttcccttacatttgtgaactttatgtgtgcttgtccctacttacctcacctctgtttcttacccaatgtgaacttatgtgtggatgtaatatttctattataaaactattaaataatagggaatacaaaatttttcaatattgtggagttatgcctatatttctttttacccaaaataaattaatgttaaaattaatctccatctcttctcccatatttctctttcaatctagtcatgatactgtgttctttacataggcaatttggagaggatggttaggtgtttaagaaaatgactgacccattgtttccacatagatctcaggtcactgattattctgtgaaatttggacaacctcaaagactacagagcattgaattaacttacttgttcaacactatttgttaagtatctattatgagtcaggtagacatttgttggagggtcctagatataaagcagtttataagacttgtgatcttaagagtgtggctataatttaaatatgatataagtcacatttatgttttcttgtatccttgttcccaggattgtttcagtaaagatctttaaattataaacattactgaatagaactgatttgtttttccagtcagcatatcatttcaggggccagtagaagcaaacccctgttctgttcctcatcttttatccagtgtctgaggatacaatgagattgtctttgaaggttgcaggtgtttgaagatatgtcctttgcagtttgaaggacatggaaaccaatccagaattgcatttaaataaggaaattagaatagatgcagaaatggaggaaggaaaaaagcaaactgaaacatagcaatgaggcccaaaagatgtagggctacataaatagatttaaaaccttatattccaatttgtttgttttataaactcagtgatcttaatattagacaacaaatccttagaatcatgtaacatgtttcgcactttaagttattgtttttgtttgtttgtttgtttgtttgttttgagacggagttttgctcttgttacccaggctggagtgcaacggcgggatcttggctcactgcaacctctgcctcctgggttcaggtgattctcctacctcagcctcccaagtaggggaatttttttgtatttttagtagtgatgggatttcaccatgttggccaggctgctcttgaactgctggtctcaagtgatctgcctgcctcggcctcccaaagtgctgagattacaggcatgagccaccatgcccaccctatcattgttcttaattcttatattttacaagaaaagctggctctcaattgatgttcaacacatgcaacatatagaactgggaccccaaattgatcaataactcaagttgatgaaaggccatgttttaaaggcaaacaccacacagtctttcacattggtgccaacgaaggcattttggtatattccctggatgcaaccaaatcctgtggtgagaacctggtgaatgagaacctatgctacagtgtatgttggagccagctcacacaggcatatttcccaactctgtttggtgacttcacatcgatagccagccacagtgggagtatttacactacagaaatcaataaattctgcaaacatgtattttttttttctaagaaagctggttgttaaacagccaacacacaactgtccttggaggaataaaaggtttgcctttgcctttctcacaagttctatttcagaattgcagccaaagcatatcatctcagcccttagctctagagacctccctcctctagtgggcagagacatttcttccttctcagtgtatacaaattttatgcttatcagtagaggtgagattattggctcacttttcctcacaagtggatacatctctcttctttattctctctctccctcctctaattctctcctttcatatgtgtcattaaaaatgtgtttgtgcatttgagtggcattgtgggaagatggagtgaggagggagaaaactcaaattatattgcacattggccactggcacacactgtgttagatgctttatatattctctttttaattatttttactatttgaaacccaaaaggatcataccattgtgagaagagctagttttctagaaaaagagatatggaattttaatatatcttgaaaagctaaagaggtgattttaactgaagtgaagtaataaggtagggccttgtataagtaagagtttcacaataccaaaatttatattgtaataataacattgtaatagtaaaaatgtaatagtattaatgtattcagttttttattctctgaactatatatggcattactttgatatcatttcatgtcatctggaaatgactactattgctacagtatgccaaaatatctgggcacaataaacaattatagcattttctctatcttttagacttctcagataatgctacaatatgttaaagtatctgggcttgattaaaaatgcaagcatttctcctatctttttgatttcttggttttggaagacttgatattctactgatcattgctattccatactgtaatgacacctgtcatgattttaaacagtttttttttttctattctaaacatggtaacatagagttatgtcattaaaacattaatcttggccaggcacagtggctcatgcctgtaatcccagcactttgggaggctgaagtgggtggatcacctgaggtcaggagtttgaaatcagcctggccaatgtggtgaaaccctgtctctactagaaatacaaaaattagccaggcatggtagcaggagcctataatcccagcaacttgggaggctgaggcaggggaatggcttgaacctgggaagcagaggttgcagtgagccaagattatgccactgcactacagcctcgttgacagaacaagactctctctctttctaaaaaaaaaaataaaaaaaataaaaaataataatcttatttcgatgtttgctactaaaaggtttttaattatttatttttatcatatcatattatacatatgtttgcccaagcactcacgtgtgtgtatatgcatgtatgtttctttaactcatggctgaaacagtaacacagaagacataaacctcaaatctgtgtctgggtctgtaacatggggaaacaggtcaaccttaacactacagtgtacatttgcattgcattgtacattactgatgtcttcaggagattgatgtgctgaaaatcctcattctacatgttggagatggggaatgagaagtcaggagccggaaaattctaaactcttttagatcactcagattccatctagtaaattacctttctctgagatattttcaaggtctgaaatgatagtgtacttacaagaggtcattatgacttctggcacccgttggagcaggcctaatgtcttgtagcaaatataagagtctaaatgcattgctataagtgtcaggctggcagcaaatgcattatgcttctccagttgaccctttctgctcctgtctctcacactcttaccagatagacagttagcaagcagcctgtcctatccagaggattatctcataacaaatatggctatttaaaagtgaaccatgttgctaaaactctgaaagccttgaaagaggtttatccatcatacgttaggtaccaactgctgtcttgatgattatcaaaaagcatcatcatgtttgacatcttatatctttaaaataatatttctatattcacttcaggtgttttgcctattaataattgagatgtagtaggtgatacagtaggagttatgtggcaacatttaggcttaacactaccacaacaaaatcattatgtgtcaaggctgtgaaagagctagtgtgttaggaagcattatccttgagtgaaaggagttcatgtctactcataatgtgtgagctgaaagtttgatatagtcagaagagtaagatacaggaacccaaggaacctgagctctgatcctaagactctctctaagtctgtgtaaccctatgtgataaaataacttggagtgggagagggttcctcataagatcagagaccctagtgcagcagtccttggagatataaattattaactcatgaaaagcaaggagacacacattattttgttttgatagtgttagaaagaaacagtttcttggaagaaattgttatagcacatccttaacctcaggtagctgagggaagttgaagaggatatggattgtgtctctgctgactgaaatgaaggcagtggtctggcctcacagcagtgaaggcctaatggttttaggaaacactgagaaaataattttatcgctctgattctcagtttcttcttttataaaataatggttttcaagtaatcctataggcttcagagtttgaagtcctgcattgaaattttagctttgtcacttactagttgtgtgataccagcacagcagttaagacccttcatgttgaaaaatatcagaaaatctaactcttagtggctcatggaaaaaattaaaagaacagcaaaacataatgaaatgtatttattactcacatatcgtgaattccaggaaaatttgtcaaatcacatatcagacatatcttatggagtccttcttggtggctcctaaaagctatggctttattttcccttaagttcaaatactttggaataattagactaacttgattcatatactcccctgaaccaatcctatggttatgtagacatttgggttgacagttcatactctactctaaaaactccagaacttgctcccttgaaattaatgaaactaggcaaacattgaaatcatttcttaatttctcataatcaattatttggaatatacattacattgaaatcatttcattattaaaataactatctttccttggttaccttttattggcttacagtattatttatttatgtattttgaactattttcactgatcttaatcaaagaaaattatattctctacatcataatgaaatagaagttctgaacatgttctttctgtgttttcctggattttcaaattaaagtatgagttgcttcgaaatttaattgaggctattgggactacagagttcttgcctttaagaaagttaagtttccaaatgtgtgtggtttcagttaattgcagtgtagtaccacatgcatgagattttatattcagaagggaggaaattgattttctttggcatgtttatagcaaatatattcagtattattgttcaaacaagctgaaattatttacagaatgttatatgtgtatgtgttttctgggaagagggtccatagctcttgtcagatttttttttttcaagagggtccatgactatagaatcattaagaattaatgtatgggataatttctttttcttctaaaacccaataagctcactttttaaaaatttgatggcgttttatttatgttaaagaggatcatttaaaaaaatattatttaactaatattcacattaattgcaatcatttcatggtaaagctatgcttagatttaaaatttcccttctagaatttatttttttggactcagagactgctatggtgatcaataatgatttgtagaaaattatgatatagcttgaggtcttttattttaaaatgttctttgtgacaatattcttggctggtccttattgtattggtgtctcaaactgttgctcaaaatttaagtgtgtttttaatgtactatttttttccataggaaatgaaagctcattgtataaaacttttaatacatagaaaggtaggaaaatagaaaatcatccttaattcttagcctagccactgtcaaaatttgcatgcgttattcttgtgtacttttctatgcagtgcaaacatgtatgacatttgtaattgcaccatgtatagaactttgtcttcatttattaattaatttatcaaacatttgtcagaggcttacaaagtaaagtaaccaattttcccagtttgcctggaactttcctgcttttaacagatttttaacaggatactcaccttctgggaaacctgttagtccttggcaaactgggatagttggtcaccctctgataaagataaagatgaataaaaacagactatagactatcaaggttagtgtgggagtaatatatattctaaagttgctatatcttatattttttacttattagtatttttcaggttactgcataattttattagtccttttataaaagtaaacttcaacaggttgaatgcaaaatgagttataaatctattcctttagcatagattttttgaatcatttcctagttttgctatcataaacaacaaagaaataaaatctctgatcacagcttcttttgaccgttatatatttttttcaagacagccataagatatataattgctgggattaagagcataaatttgttagattgctgatacatgctgtcgaattgctctccaaaaagattttactagtttatattttcattagagatatatttaaaatatgacaggattttattattctcagctagatacgaactttattcatcaggaacagtttgtcctatattggtcaaataatattctcccaggtattctgaaagagaattctaaagaataataaaaaggaaacttgtttgcatttttatatgagaatttcagttaaatgtaacaatctcattggagaaaaataaaaatattttgtatcctcagggctttaagaaaggtgcttccattggccgagatgcttaatgtatagtcttttgtgaaaaattctcgtacttagaagagttaataactcagtaactatttaatttactaacttgggaaataatatatgtattagtgagaatagtaacagtgttttgtttgtttgtttgttttgtcatcaaagacactattagccagggtctttacataattcttaacataataattatatttaaaataatctgacatcagattttcaaaataaatttaagacatgctgagaattattgaataccatgattggagctattagatgaagtttctgatataccttttttgttgttgctgccctcttgccctttctggcagaacttttattttactagaagaaaaatctatagcttattaaaaataatctaaccccaatatgatcaaataaaggtatcatcctttgattcaaagaagcatagtaacttataaaaaattaaaatgttattttgttaatagtgctctagcacagcagaataaccttgtaactattttatatattaaaaactaataatttgatttaatagcaatttacctataatatttttctatatatgtttcatactttgttaaaccataataagtatgtcaagtagtttttattttttatcaattaaatattccattaagggtacacatggacataaagatggaaataatagacactggggactctaaaattggggagggtgggtgggagaagggggttgaaaaactatctattggatgctaagttcactatttgggtgaagtccaaacctcagtaatacacaatacacccatgtaacaaaccatgtaactaaatataccctgtgaatctaaaataaaataaaataattttgagagaagcaaaaaagtaataagtagataaataaaataaatagcagtatttcattaaattagaaaatacaagagtaaaatgattttgctagtaattaaacatctagctcctgatgaaaacatatttatttggcttaataatgttatgtcagcaaatacatgtttaatattacacaatgattacaatttttcctccctatattcagcatacactttaatttcaaattaatatttacatatcatgaaactataatttatttaaaaaataaaaatgttatgtgtaaacacacaagtatataagctgtcttttttgttttatgaaatacaatcacagtaaacttcatttcaacacacgccctccaatttcattagtgatgattatataagcttatgatagaacaaggagagaggaaccaagtgtcacagttaggctacggaattttggttggattaatatgtaaatgaataatatgaattattataggagtcaaagctattgtactatctgctagaacttgctacttataggaataaataagatatcaaatactttgcataatagtgagtgttttacttgttaaatctgcataaaagcaaaattaaaattttcctgtatttagctggtactgtgaaaactatacaaagtatttagagatatttatagtatttgtattgaaacatttaatatccaaatgaatgatggtcatgggttaaaggaaagagagggaagcaaatgtttacagagaatctgccattatcagctgtgtgctgggtcagtaaattcattcaacatttcaatgaactattactagtctcaatgcattaacaagaaaactaaaattcacaggagctaagcaaaattttcaattttccatgctagtgaatggcatgtctgtctcatgagttcatattttattttgtatatcacaaaattataaaggatagacaccagggtaattattttaggccaattctacatttttcaattttttttcaagcagtgatcaaacaaaaaattttacacacttttttgtgcaggtatctaagtaattctgtaagctagtttctaagaaataaaatttttagaacaaggtgaatgttttaacttttcatatacgtggtacagctacattgtttttcccatggtcttaccaatgtacattcacatagtatggaagagtgactattttcctcaatcttacaaataataaataaaaattatgataattttatcctttttttctgctatatgtgaaaaatgacacctcataatttaacattttatggaaaaaattaattttagtatacaaaacaaatccaatattcgatttttattatagctggccaaattaaaattaaccatgatgttctactgtaatacaaaatatacttgctaggccaaattaataatgtagagacaaagaccttgtttaccgtagccaaaaaaaacatagttgatgggccgatgacttcattctggtcatgttttccatctttgttttaagtattgttgacactaaatatttacaggtctaaaccttctcggtgtcatacattcctggaaattagaaaataatttatcccatctgcaaagagtaaatttggtcaaaagagaaaatatcaaattaagtagatgaaaaatgattttctgctttgttttctatttttccccccggtacttgaaagtagtcaaataaaaaatagattcagagttgatttgttcatataaacagagccaatataaaattatgatgattagactatttcctatgatggctgtaacaaattaccacaggctctgtggcataaaacagtgctttattttcttacatttctggagatcagaattccaacatttatgtcaacagggctggcttcttttggaggctgtaggggagaatccatttcttcatcttttctaacttctagaggtcacctgccttccttgtttgctgacacctttcacacacgactacatccttttccttccatcttcacgtctcctaattgtttttatgttgtcagatctctctctgcctctctcttattagaacacttgtgattacattttggatccacctggataatcaaagacaatctccacatcccaagaatcttaatcacattggcagtgtcttttgctatataaaataacatccataggtccaagatgttagcatttaaatatctttgtggttattcagcctaccaaaatgatacaaactgccagtctatagaattatttatttaatctttttattcagtaaagttattctcaaagggcagattttacagggcaattttttgaaaaataaaacttgtaaaaggtttaattgattaattactgtttacagccatgaattcagacatgcatagtcatttaaacattttgatttctttaacatattttacaactggaaacctgtctaacacaaatggtcctactgctttatatctttttctgcctacatctatctaaattgagaaatatatggcatgaataagtatattcagtttccatggctatggctaaacaattactggaagcattttatatgggaataatttacatacatttgtgatattacttttcttatctctcctcactattttgagcaatctttgacttgctcttcaatcctagtttatggaaaaattagtctggccatgttaatagcggtgctggtgtcagggtaccttgaagaaatgtttgtttaggagttagagataaacagctgtgtctttatagaatgcttatgctaatgtgcatcagaaatctccaggaatatgacttagtatgtggtgtttctaaaactctatttaatcagagacacttttgtacttggagtttcaacatcttcagcaactagtgggccaaggaaatactgaacattaaacatccacaggactttacaattgtgaaatttgaaagtttctgaaaactaaaagtgtgttgactttttaaaaataaaagccaaaccaaaatgtaaggcttgtgtgtgggtggatttgtgtgtatttacaatacttagtgtgactattgatatctttgctaaggaaacataagaaaatatgcttgattatgggatgctgccccaagactttcctggtagtgttatataaaatgtggtatatgcaaaatattgccaggatttcaaatattagacatatcacattttaggagaggctgataaaagattatgaacctgtattacaagaagcacctgtattctttccacagtgaccaaaaaaagtcttttttttttcacctttagatttgatcatggtctaatgaccattatctcaagtgggtccacaaccctaatcaacaacgtgcctatagtttcttagagttcttcattttatttggaaaatagaagcaactggtagagtcctgcctccttttcccatcaccagcaccatcagcctagctatatctgtgcctatgcactttatttaccacctatggcaaagcctaaactatcttcatgtacttaaagccttgctgccatttgtacactgttcctgcaattatccccctacaagtgtgtgtgcacacacttatgaatcccgagtttctccttttctacagcatccttcccaatagcaggcaaaagtgttgttctacctcttattttatatcacgacactcttatatcaatgaagaccatgtactcttctaatgagtgtcacatcttccactccccctcagagcagaactcctaaatgagctgtcctgactcatattctctactccttcacttgtgtttctctcttcagccaactctagtccactgaaattgtacttatcaaggttgctaataatctccattgtgacaaattcaatggccagttctctgtccttatattatattagaatttggcccaagcaattcattagtcaatcatgaaagtatttttttcactttgcttcccattttagtttcagtttttggttttgtttctttgtctttgttttttctgtctacctcaaggcctatctcttgcatctctttcttacttctacatgatctagggacctagcctttagggcactcactgcttatgtgattccatctgttccagtgatttgtaaatttaccagtgtttctactgtgctccagattcactcattcaacacccatctcatggggatgtctaacaagaatagacagaatagacagtttcaaaataggaactgttgactttcctttataaacctgttcctctcttaattttttaaattttttatctcaatagataacatggtcattcatcaaaatgttcagtccacaaatttaggagttattcttgaatgataatttatcatatattctcactaactcactcaataagtgctgctggtgctgcctacagactttataccaaattctctgactttccactgtgaatcctgctactgtcctagtccacatctttgtagtatgtcacttagagtactgcaataacctcctgcttccccgtttcccagctttcattctttcagcagcagcaagcatgatcttttcaaaatggatactttcctcggaactctcaaataacttatcactttcaaatagaaacttatactcaaaataattgaaaacaggtatgcaaataaatacttttacatgaatgttcatagtagcactattcaaaatgaccaataaataaaaagaaccccaagtctttcaactgattaatcattaaaaagtcatagtatatacatgcaatggaatagtatttgaccattaaaaggaatgatacactgatacctgctacaatgtggatgaacatcgaaaactaagtgaaagaagtcagccacaaaaggttgcacgttgtacgtttctttttatatgaaatatccagaatggttaaatccatagatacagaaaacaagcctcctacctagcttataaatttcattatctaccactctccatttacatctcccattttaaccacgctggtctctttgcttatttttagtctcagcatattctaacttagtttatttatgattgcttttctatttgcttggatttctcctaaatcaaatcctagagtggcctattctagcatttctttaaagtagcgtcttaaaatatcacctctcacaaacaccttcccttccactctatccaagtctacacagacatctctaaaaaccatgtagattataagcagcataactacccacaaaaacatttttagcataactaaaatacattcaatacaacaaatttaaaattacctcagcaaagtatataaatgacacctgtaacaatagttctggctctggagcccacactgaattagaaagacagacagagactgtgcatcaggaggagagggggagacctagcagcggctgagagtggataaaatcagacccacaaatgagaatcccatagtgatactgagaataggtctaaggaaatattgagcacagatataagaacagatgaaatagaaaagaaggtgtttgaaattatgtgagactaaatataacagtcttgggaagatatggtttctggggcaaattagaagtgtatggaaaattctttggtggctctgtggctaaaggaaaaataaaagaatgaaaaggttaaaattaaaggccctactgaaaaaaaaaagagagtcactatatcagaaaaccgtataatatcaaaatataaaaacacccccaattaaataagtttttttttcattaactacacaagacaatgttcatgaagaagaaatctataaaggcaataaaattttctctgaccttccaccggtggttgcttgtttaggaaaaccttagtacctcaaaatgaacagaaaatcattggcaatacctatacaaatttatagaaagaaaaaaaaacagacagcaaaaattttcaactgatgaaatttctcttccttccaaaagtaagtaaaaaaacagcaaccaagaaacaacaacaacaaaaataaacaaaaaaccctgtcttaaatatatttttaaagaattacctggaaatattaaaaaattatatttctaatcagtgaaacaaaaaatagcaatggagaaagcatacaaagatgtgaaatgaaatctaaaaaggtcagaaaagagaagaaaaagaaaaacaaactcagcagcaaagcatcagccattaggtagctacagaagaatagattctaatgagtattttataaatggcatataagtgccactggggaaggaaatgaagaaaattcaaacaacacaacagaaaaaattataaaggttataactgaagaaagttttttagaaataaggatcttcagccacatgttgaaaagtcacattttggtaattcttaaatatgttctagaaaaatttttagttcttaaggatattttaaaaaaaaacctctggactttcaggcaaacagatcaaattacttacaaaggaaaaaagaaaattaggttgtcgtgagaaatcttcacagcaatagtcaaaataaagcagcagtaaagccttttttaaaaaatgcaaggaaagactatatgagctaaggtacctttctggcatcaagattataaagacatagttttaaacttaaaattattttgtgaatactatactcacaagagaatgagtatatctaacttagggattattaaataaacttgacaaaggaagatagtgaacactgaatatatttaatcgtagatcccaggctaaaacaaaggtgttaaaaggggtagaatgataaatatgttctgacaaattagaattttgcagttcaaactaatggataaagaaaataaaatgaccaggcacagtggctcatgcctgtaatcccagcactttgggaggctgggcccagtggatcacttgaggtcaggagttggagaccatcctggccaacatggtgaaaccccatctctactaaaaatacaaaaattagctggccatcatggtgggcacctataatcccagctactcaggagactgaggcaggagaactgcccaggaagtggaggttgcagtgagccaagatcgtgccattacacttcagcctgggcaacagggtgagactgtcacaaaaaaaaaaaaaaaaaaaaatccttgattttcatgtaggtaatagatggcagtcaatttaaagctcaattagtagcctaaataacggaaacaatggactaaatggactaagagctttgtaaaatcttaactttctctcaaagagctgatggtactctctgcaaaattcttctaaagtggcgtaaaaaatgagggtgactaaattcttgggaggatttctatattaaaatattgaaaattttaccataaatttaggaatctgttgaaattctgagcaagaaaacctatactgtatgtgcaagaactctgctgaaacagtatggtagagttgtaaaatgtatagaaacttgtatatgcctttgcaaatgaagtaacagcctttgaagtctccttagttcaaatcccaatctatatagttgaattttctttctttctgactttctcttcctttccttttctttttcttttcaaaatgaatgtgttttttaaactgttcctgcaagttgtgtctgtttgtaaatatgtggggttttcttcagtttttttgttgttgcttgcgtgttttgatggaagtggtgtttgtgtgttttgatggtagtagacatggcagtattgctggagatagttgatgtaaatcatctacttccaaatgcattttacaatgtggtatatatcaatttttgcttttgtgatcttttgcatcggccatagatagctgtttttcattttttttgcttaatgaagtaaaaagcaatataaataaaatttctccttccaaatgaatctcattcagctgcgttcaactatgaaagagctctcaaaaaagactactcattaattttcatttcaaaaatattttgtaaagtggttcataggcctttgttaatggcttgcctaatgtccttggatcaccatatgttctcttcacaaagtataggcccatagagaaataaatttccctcttagttttttaggttagattgttggaaaaatatcaataattcaaatcagatgattgtatttctaatcaaaattttttgggatttttgatggcatgaaaacaaagaaatgtttttaacttttttactgcattggcaatatatgaataaaagaatggagatgaggaaatgaaggaatctactgaattaactgcatgatcctctctatactttccctactgcaagagaaaacaatatacacatggccttctaatcacttggttggttccccttgaaagcagccctcagtagtttcttactacactgctatcactctgaacataagctggagacaaagggctgctttgtacggagtgaaaaataatcagggtctggtgagaggatagatagaaggatgctcaacaccaacctcaccatcaggaggagaccacagtcattccttttgtaataaaacatacaaagccagaacctgaatggaacgcaaggactctctttggagaaaaatcttccttattctctttaatgtatgacattttcataatcttcttgattttcatttttccttgtggggccaaaatcagtaatttgaattaaatctcctatttattctaacatatgtagttgaagtccattttatcccctctcccacaatatctgaattcaggaattttttattgttgtttgtttgtttgtttgtggtctttttgcccttagcagctagaagtggagaccttggtttctctgattctatttccaagtatttctggaagatcagcattctactctctcttctaagacagtgttgtcttatattaaaatttatgattttggtgagatgcttaagcctttaccccaattcaaggtggtgccctgattcttcaaagtcctcctgcctttactaagatagatcttctcaagtgctttacctttagttttccctagggctccctgctcattattttggcctctttctgtccataagtaatgttaattatgataatactgctaagatattagtaggaagtatcaaggtcctgtcaactaacctttattctacagtatttgaagcagtcagatggaaaggagaagagtcaagccattaagtgccacttttgatatgcgtagtaggaggttattcactttggtttatttgacagtaacttacttaaaaaaattttttttatcattttagatttctgttactggctactaaagagtcgatgatagatgattatatgatacagtttcattccaccatctttacctacatttttcttttaaatatttatatcaatcattaatatttttgagagagatgtgtgtatacatacacatatatatgcatatgtgtatgtgtacacaatcatttgctggaatggctcacagaacttaggaaaaccgtttgcttactagattacgggtttattgcaaaaggatacaactcaggaacagcggaatggaagagctgcactggggaaggtacatggaaaggggagctgagcctccatgttctctccaggcatcccatcctcccagcacttgcacttataatcttgacgccagaaaggtaccttagcacatatagactttccttgcattttttaaaaaaggctttactgctgccttattttgactattgctgtgaagatttctcacaacaacctaattttcttttttcctttgtaagtaattgatctgtttgcctgaaactccagaggattttttttaaaatatccttaagaactaaaaatttttctagaacatatttaagaattaccaaaatgtgacttttcaacatgtggctgaagatccttatttctgaaaaactttcttcagttataacctttataattttttctgttgtgttgtttgagttttcttcatttccttcttcaatggcacttatatgccatttataaaatactcattagaatctattcttctgtagccacctaatggctgatgctttgctgctgagtttgtttttctttttcttctcttttctgacctttttagatttcatttcacatctttgtatgctttctccattgctattttttgtttcactgattagaaatataattttttaatatgtccaggtaattttttaaaaatatatttaagacaggttttttttttgtttcttttttgttgttgtttcttggttgctgttttttttaattacttttggaaggaagagaattttcatcagttgaaaatttttgctgtctgtgttttttctttctataaatttgtataggtattgccaatgattttctgttcattttgaggtactaaggttttcctaaacaagcagaagctctcagaaactcatcttttgggggttttagagaggcctcaatacacaggcctgattcattatatcacctgccagtagtgataaaaaaattcaggccatttcttctccccagaggtgttgtgtgggacactggggtgtctgaaattggtaaagttctaatcacttggttggttcccctggaaaccagcccccatgcttgggctttccaggagcccccagcccccagcaatctcattagcatatgaaaatacttaccatttcagagattgcaagaatttaaaagctgtgtgtcaggaaatgggaaaagagaccaaacatatttcttaccatgtcacattgacaattattttgtatatttaagtttctcaggcatcacatcgagatgtatcatgttccaaacaagaaaacggaacacaataggagctttgagactgggagatggcttagtttttatccacctaaagttaattataacttctggagctgcttctggagttagacatatattgctatccaatagaaagaacagcactggaattctcactagcttgttttgtcatttaagcttcctaaatcggatctgcttctagcttcggttttataatgtacaatgatatgtactatagaacatagacaatacttaagtaccttccctttaccccatccctaaatgagacctgagccataggaatgatgactagcactgaaatagttggtcacctggaaactctgtgaactctgaaatttccccatattgtattatcaggctgaaaaaaaaaaaaaaaaacatgtatagtgacacctgtaagtgtacttcagataagaagagattaaggagtaatagttccctggtgcaggttttaccattattcttccaattttttcattctagatgaaggtaaaccaattggaacaccacttatttttgcacttccctctttgccctctcttcgttttgtctctccttcaaatcagcagaggcagaaatgtgtttttagtcaaaactgcagattcacatacacactcacacacagacatccatttattccttagcatcacccccatatactatacctaaggtctctctttgtctacattttgattatccacaccaaaataaaatctatgaaaacacctgtacaacagaattagtctactgaggcctagggcaacgtggtgtaaatctactgtgcatttgataggtggtggtagcttattgccacatcatgatggatgatgtgtatcatccagagctggactctggagttgtcccttgtgaacattaattagtaaggcaaaatggcttgagtttttggatcaaaagagactgtactaataaaaagagcaaaggatactataaggataaaaaaaaacctgtgctattaaaatctctacaagttatgcaaaaacataagaactgaatgaaattgcctttaaatagttgggttctttgaattgcttacctaaagttattcttactatggagaaataaaaacttactctgcagaaatgagaaatttattatagctgagccagattatacatatgcatgtgtatacgtgggaatatatatgacatatatctatgaatatatatgacatatatatataaaacatttatcattgaacatgacattgaaataattagaatctaaaactcctttaatatttaatatactgatggctttgctaaaattcatatgggatattttatgcataattacttaccaggcaggattaatatgaggattactatttatgtgacagaaacatttgtaaaccaccttgaccttctcaaagaaaggttgcactagtgattacagagtaatgtctgctttccttttaatcacaatctaagatcaggtcttcatttcacagtggtagaggaagttgacataacgaaaaacatctaaataagtaggtggatgatctcgagagatggtatggatgattatttaagagttttatagccttcttttgttggttgagtttttttaatctgtatttattgaggataactttatgtttattgacaccatatgttaatactatgtaaacacaggatgtcttcatatttagttaatattccatgtgcggaacttcttaaagatttcaaataagcctacatacactatccatatgttgctttttagcaagggtgctaaaaattgtaaagattttaacttagcatggggatttatgtatttatatatatatacccacacacacatacatattttagggggttatgtattaaatactattcctgtattagaggttcgtgcttgtcatcagtcagtatttttagtatacatgtatgtattgcctttactgtcaccactaattcatactttgtgactcccccttgcatatatcctacctatgtaaatctgtatttgcacaaagaagttactagaaattttgattacttcttaatcattcttaatcagaattatttaactaatccacttttaatgtttaaaattaaaggatatatatatatctcacatattcatttattttaataaacattatttgaggggcaattatgaactagtattttataaagcatattgtaggattagggaaagaagtggaagggagaaataaaagatgataaaatattgaataatatttacctggttctccagaagatcaaatttcatggtaaagactgaatccaagagatgtacctataaaacaatttatatgataattgaacaagcataaagtaagatatttgagcactttgtggagagaaagggaataaattaattctgctcatgtgtcagttgaaaggcttatagaaatatgggtgttctacatgctaaagtgttttagtttgttcaggctgctatgacaaaataccacagacttggtggcttataaaccaaagaaatttatttctcaagtttctggaaactgcatgcctgatcaccacccagaagccctacctctaatgccatcatcttcaggaatactatttcaaaatatgaatttaagaggaaaacaaacattcagcccacagcacagagataagtgggcattcttagcagagggaaatgtacacagataataatatgaataacacagagttatcttaaggaaaaatcacgtagtttgctggggctggaactacagcataaagaaccagggtggtaaattgaggctggtatatgaagaattattacatagagacaatccaggcccccacagaaaatttcagctggagtagacacatgagaaatttttgtttcagaaaggtcacttttgatgacaatactgaagacatgctgtgagattagcaaggaagataatttatgtagtggccaatataatattaatgagatttccatgacaaatggcttatggtcaaatgtaattgtgaaattctcagtcaatagaagcattttataaaagattgactaatgggtcacttggaattttaatatgttaatatgcactgcgatacacacacgtgcattaatagtgtctacatcattatcctaacttgttttgctgtaagaacaaagaactgtacgttgctcaaggctaatgaaatagtggatctggggggtctattccatatctatttaatacaaaagtgttattcactactctagattcatttcactggaaaaataaaaagatggtgagtgatattcttagtcagtggcagagggatgggaagaaagagaaaacttcaagaggtgattaaaataaatgaccaacagaatttgttaaatgcttaatgtaaggttcttaacagagaggcttcatgaggtaaacgaatctccctatgttgggtgtgaaaccatgcttccatacacattggtgcttcattctgaaaaaaaggtattttaacttttggcagctgtctgtaaccactaaaagattaaaacccattggtaatgggccaaaaatggaactctggcatagactagatagatctaaagaaggggaaaatggaaatgagagagacaatcttgagaaagcaatgttctgaagtcaaagcaacaaggaagctactatacagcaagggaatgaagagcacagatgctggagccacattgtgtgggcacaagtcttggtcctacccatagctaagattttgtttgggaaatttagctcttttatgaaagctatccacatttataatgcaaataaaaatagcagacaacctcatagggttgtagtgatcatcaaatggttttatacatgctaattgcttagataagtgctcaacacataggaaatgaaaatcatgaacaaggaccttcctggtgatttatatatgctattaatcctcacagcaacatcaggtggtgctattatgaattttcatcatggaacacaaaaactgtcatgaaaacttagtagacccacaattctgttttactcctaaactcaagctcctttaagtacactacatggacgtgacagactttcaaaacagggagtttggaacctggataatcttggcaaatcctacagaggaaaaatacaaaaagtagctactagatcagtgtttcttatagcaggcaaacctcaaccccccaaacaaaacaaaacaatttcataagaatggacttgttgatggcagattgcaatacaagataagcacatgtaaataacaaatacaaaccaaagttggatgaattatcacaataaaggggaagaagcagataggtagtatctacaaagagttaagataatgtgtttttttttggggagggggaagtgtgtgtgtgagtgtgtgtgtgtgtgtgtgtgtttaaatgtttacctttatgtgtgtttggaagatgagaggcttgagcatactagcatgttcagggaaaggaaccattgaaaagaaaaaaggtaataatactaaagaaagagggaataatactaacggatgtatcaaaaattggaatagaaaatatcattaaatagggaaggatgtctagcttcctaaaacaggagggaagttaaggaatgaagtgacctctattcacctctgaacccagggattcggtaacatagatcagtaactcttcctgagtgcttacaatgcactgtgcactattttaagcgctttctgtaaattaatttatgttgctttgaggtagctagtataaccaagaggatagtagagtaaagagaggtcctccagtggctgttctgggccatgaatttgacagttagtctttagaatccatgtactttactccatgcactgcctctctgcccatcccctctctgggcagttggaagtgggaggctggatcagcgtctttgaatgtggtggaatgtagaggtgtccaaagaaggagcaagggaaagaatctaacacatacagataggacaaagtgaaaatgggagcagcaagaaacaaaatagaagacagaaaactagcaaaagattatagaaagaggggaggcttagaaaaagaaaagataaatgaagacaaatgcaagccatattagatatcaagtcaagtgcattattaaaattcaactactttagtcattttgagcacacttgtttttagaataagttatcacattattaggtttgaaattttgtctattttttttaaatgactttcttgagtagctaaaaccgttgcttaaaaaaattctcttctatgatgcttctgtcacgttttggggtaattgcacagaaaagatgaattcatgttgagacagaattgggtggaaatgtctagttgaagggataaaaactgaaaattatcaataatgaaatttggaagtcttgtcaataattctttaatcccctaaacagattgtatcttttaaaacttatctacatttcaaaggtaatattttgtttcccatggggattttttaaaaaatttgggcaaaaccaagaataggaatgttattatacaaattactcaatagcaattttgctcatggacattgttaactatgtatgtaggttaaataatttttttcctataagaaaataaaatacagttttagattctaaatagccaatttgttgtatgtagttgacagggtagccttttttagtatagctactttattttcagcctaacctatatttaagtatgaaatttattggagaatgaaaagttaacttttgctgctgctactttcaaaaaaattttgtagaaaagagtattagtgataaaatacttaataatctttttctttctttctccgtacttcacctgagttctatatatatatggccacgcgcagtggctcacacctataaccccagcacttttgggagcccgattctagtggatcacttgaggtcaggagttcgagaccaacacaatgaagccctgtgtctactagaaatacaaaaattaaccaggcatggtgttaggcgcttgtgatcccagctattcaggaggctgaggcttgaacccagaaggtggaggttgcagtgagccaagattgcaccactgcactccagccaggactccagccaggacagagcaaggctccttttcaagaaaaaaaaaaaaaaaagaaaagaaaagaaaaaataaattgcaaataatatgtgcaccaagacataagacagtaagctttttttttttttttttttactcctatgtcagttcctgaacagtttggtagaacatctccttaatcatcaattaaccaacaggttacagaaattgagtgagagaggacttcttggaggattacaatctaattacgtaacaggaagaaaacacaaactgatttttattatgtcctacagtttttcactgttcagtataaattatactttttctcaaggaaagagagatagatataatggataggctatgaaatgttgggagatactgagaacaaaattttgctgcaatttatgaagaataattgttttattttaattttaagttcccagtgtattttgttgaaaaaaaaaaaaaaaacctacaaggaagtttcagttactcagggactaatcagttagctggccacttttttatataaaatggcattttcttctaggtttgcctttagttttcaccataacagtgtcattacttattacaacttcatcctgagtagaaagagaaacagaactagctaatatcagcttgtttggctttatgcttggtgagagatgttggcattgtggtttaaagtggaggttttatttattttgagtcgttattcatccatcactggttttcactaacgaaaagttagctgtgcttatctactgagagatcaattccattttaagagcaatttataaagcttgaagacagccatgaatataaaatagcacaattcaccaggtcttcacaaagaatactcaaaattgagtatatcaatttcaaaattgagtatatcaataatcaaaatctaattttaccactggtgtaaagagaaagtaagttaaaaaatcccaaatcctttctttgttggattaggttcctgcctttcttattattctttgctttcatctattgtatccagcaaagtggtatcatatcaatgaaaagctaaaactcctagtaacttgtaggagcacattgacataggtgtaaaaaagagagacttcaactcaaaacaaaacttttacattaaaagtaaaaggcctactcagaagtggaaataatctagatccacttcccttaaataccagtccttatcagaaaatgcatatttagtagtattttatttcacaatatgtgagttatctagctcaagaaggaataaagggagtctttagttaaatcagaggatgttgtgaaatagcactgcagtgttcataatgaaattctttatattcatcaatgtttttcagactgagttccaatatatattctctaggatctaaaagtctccatgatatttcatttataaattatgtcagtgttcctacacattcatatacacacacatacatgtacacatatacatactagaagaattagatgacagtcttacagccaaataccacaattttttttattacttacatttgcttctatcttggagccaaatgaagaataaatgtttttgttttcttgtcagtttgagtttttcaagctgtcttctaagaccatattcttggggcctgaagtttttcaagtttaagaaaccctgagataggtgactcttatttaaccaattgctgtgatcagttctatgaccttggcattaagacctgggtgaaatgatcaaaaatgatctacattttggttattaacatatcttccatgttcacatccttttcctttcagaattcgtagccttaaaaataataaaaaagggcagaagatagtcagactagtaggactcttgaggaggctctcctaccctcactcacatcacagctgctgctttcctaatggtcaggattacatgcccaaagccttagaaaattatcttaaaaggatgccttcccttcacctttttcctcttattggctccagatgctctcttttttgtataaaattcaaaacttggtcatcgttttaagagagatattaaagggtaacacattgtatgatcgtatcaaagtatcacatgtacctcatgtacagccattatacatccataaaaattacaaattaaaaaaacttttaaaacaatactttaaagaatagtaaatgatagcatagaggtaagagaatgcattgtggaatccgattgcctgtgttcagattcttcattctactacttattaattctgtgacactggacatgatatttgacttcttagtgccacagttcacaatttataaaacgggaatgaaaatagcacttactttgtgtgtattgttgatgaattcacaaaccagtaattaatcatatttgatatttacaagtaacaatctgaaactaaaattaaagttttattgaggtaatatttgagtgcaatgtcatattacaattagtatcatgtcttcatgaaaaaagtaatggtctatgaatttaccaaggataaatggctggtctgttccgacatccctatgaatttttcttttcagcctaatagatgacttttattttaatatttttagctgtaataaaattttaaaattctatgaaaaaatgcaaagaaatcctgctgttcatatacagttattaattaataacatgattgtatcactagattattaaaagttcacatacatatgccactgtggcaaaaggattctcattattgaaaagaacaccaataaatggtaaaaaaacatagttttgcataactttgctgatcatgaatagtcaaagactaatgtgggtttaaaatgtgggtttaaaatggaattatttttagtaatatcaaagaaaatctgaaatcatatggcattcagtctttcatattctggggaaaccttaagaaataaaagacttgtgacaacttttctttattacccaatgtctatatttaaaatgtttgtgtttctttaaaagaaatatatgggctgggtgcggtggcacatgcctgtaatcccagcactttggaaggccgaggcgggcagatcacctgagttcaggagttcgagaccagcccgaccaacatggcaaaaccccgtctctactaaaaatacaaaattagccgggcatggtggcgggcacctgtaatcccagctactccgtagggtgaggcaggagaatcgcttgcactgcaggcagaggttgcagtgagccaagatcatcgtgccattgcattccagcctgggtgacagagcgagaatttgtctcaaaaaaaaaaaaagagaaagaaaaatattttaaaaatcagtaattaataatcctgtcattaagggcaggcccattaataattgataattgatatttcagttatttttccaggtttatggaaattttacatataaaatataaatgcctgaaaaaataagttttgtattattcatgaaaataactggagcatttttagaatgcatcttatatactctttgtaagcattccagaaagcaatcttactggataatttatagataactgtctaaaactactttgctaaacaatggaaaaattaataacttagaagaaaatgaaattctacttcaaagaacatattaagagatctatattataaatgttaatagagttatttaacatatttctattataaaaatgatagatatttaattttaaaaattattaaaggactcagatttacttttgaaatccatctgctaaatataaaaaaataggaaattttgggcttatttttgtaaataaaaaatgaatgaaaacaaattttaaataataaataatatatattatataatttttatcttaatcttatatattatttatatattgtatatattatcactatattataaatataattatttataatatgtatactataaatataattatttataatatgtatattatgaatattataattatttataatatgtatattatgaatattataattatttataatatgaatattataatatttacaatatgtatattatatattatttttataataaattttaatatacttatataataaatattatttttaaataataaatattataacaatattattttgtaaatgataaaatttttaaaaaccaaagcttttatagcttcaactctggagagaggaattttatttacataaacttcatattacattggtgcaaacataattgcagtttttgccattactttcattggcaaaaccagaatacaaaattggcaagccagaaatacagaaaatatattattcaattaaatgaatgccctccaaactcttattcttgaatctaagatatttacaaaaatctttccatagatattctttcataaatacatgtttgtgtatatgtatatgcagatgtatctatctttgattatgtcctttttcatacatacgcatatacacacacacacaaacacacacatatatatatgtttataagtttgcataaatatttatatgtgggcatatataatgagggaaagaatcagctctttttttttaggataccaaaaatgctattttaaaactttctttaataccaactcaaacagattctttccttctatgcattctaattcgttgtgtggaatactgtaatttatttttttagtcatgtattggtatacatttaaattttttcacattgtcttgcaagctcgctattatgaacaatgttgtaatgaatgttttagatcataaatctttgcaatattttctaggaatacatttttagtcaagaaattcctagttaaagaaactacattttgaattttaacaggtattgctgaattatcctctaaaacttttaatcaaaatgttttcacaaaattgcatcttaatttaccctttgtcaacataatagattttaaaattttaatttgtattaatctacctttctttaattataagtatctatttagtcatttatttcctgtttgtgaactactaaagtattatgctcattttttcttattttgttcaacttttacttactaatggtaaaaacttgatataatagtaaatgttttctttgcctgctgcatgttttgtaaatatttccctcatgttcatttaaaaaaaattcacttgtgtcgtttttcaattcagaatttaacatttttaaaacatatattcaatactcttgttattatttcatcccaaatctacagtgatacacaaaggccagtaaagaatgttgacattgtttatgtataaatagtgaaccagtgccattgattttaggacatttaatgagaagattaaattgggtggccacagagaacatttgtgtgtgtgtgtgtgtgtgtgtgtgtgtgtgtatgtatgtgtgtgtgtgtgtgtgtctgtattgggcatgtatctttggataataactattagttaatggtagaaatagctgattttaccatttttaattaatgacatattgctggctgtattttcctgaatgatatgtatgtatgatagaatttctctagatgttaataattattccaagaaaaaaaatctgtagtgaaatatttcaagaaaaaaatatcataagatattcttctgttaaagatacacaatagatcatggaagatttgaagaagctctgcaataaggaaacctgtgtaactttgtttaatcacaatgtttctcaaatcatttacacatatgtccgttttctgtaaaacactttttgacagcacacaggaaattctaaaacagctaatagtgtggtattttctcacaaaggaattaaaatatgtaatttttaaaagagaaataagcaatacctgaaatgaactataatattttacagattatagtgaagcttaaaagtggggtctatgccttgaggacagggctaagacatatatatcacatataacctcaaatatcttaaactgaagctacttttacttttccttaaataagctaaaaacacgtcggaatatgatgggtgttacattttgtttcttgaatatagagaaataaagggtaaaatatttttaagactaaataatgttcacattattctaaacaaagaaataatagagcacctgtagctgtgtttcagcagcacctagaaacacttaactacacagaactttatatagttcactgaagtaggataaaatgttttacaaaacattactctagtgtttttccttggagtatcttccacctagcccattgttgagcaggaaaaagataaaagaaaatctctataaaaacaatttacaagtcatttcaaataagtctcttactttaactatctggtaggtgcaaaataaaaagccagatacggaattatattctgagtcttgttaattcaaaacctggcatttatttttgtaaatgtcataatttcaagtcttactaagatcatttttgctcccttagccctctttaatgaaactccaaaatgtattatgcaaacaggttccaatcaaatgaggcttaaatctttctcggagacaaatgcagagaaatttctgtttatgagtatgcaatagattttaatgttaggaataatattgattctcagaagttgtaggaatagcttatggggcataaattacatatttataccatagaatttattatgagaacttaaaaatttcaatttacttagctgtaaatttattgacttctagagatttaaaattttcttctgaagttaagcaaatttgcctgtaaaatgtgtacaaattttaaaatctttatagtttagcagaaagcatgaagactttcaaaaagacaggttttaaacattgcaaaacctcatgtattttacattattttatatattttaaaggttacattagttctacagtttggtgtgatggtttcactggcaaatgcacttgtcaaaattaatgactgaatacttaagattttcatatattgttgtatgtaaactaaatgtcaattttaaaaagtacttaggtagtattaattccttctttctgttcctaatgctcagcctcccacttatccactatcacactgaaacaaaattataaagattacattaacatggcattatttctttgtcagtggagattaaataacctatattttaatgcaacaaggaggaagagaaagaggagaaaaaagagaagaccagctgttttatctctgtgaagcagagaaatgataactaaaatggcaactggctttaattaatccatataagtgcatattagagtacattgcttaatgaaaaagtggcattcagcacaaacctagcacacagtaagccttcattaatatttgttgatggaagaatgaaggaagatagaaagtaaagaaagaggagggagggaagaagggagggagagaggtaaagagagggagagaaagaggaagggggctagaaggagaaaatttgaatccactccaaatgtgtttggaaacatttaagttctcagcatatttctctaaaagaaaagagacttctccataagtttatgccaaacagcatttcagacagatgtatcatgtttatattcttcaggattcaatattaacttggctaaacagatatttattaatcccatgcaatactagaagctcatgttccctattctgaacttagtaagattagccagtaatgtaggaccctataatattctcctcaacctatgatgtgtaggaatttgtttcatctacttttttctcacaacaaaatcaggtcctctagttgtcaattgatgatggtacagatggttgcttaaaatggatttaagccaggcaatatgagagaatttttatgtagattattattttaagtagtccaatttgtaacatttacctataataatatttaaaaattatacttttaatgttcctaccaccggggcaaacttccttccttgcagtaagtagcttaagaagaataaaaacagtgagaaataggctttaaatataaccattttcacttggtaactggctctaacataatagcttcccatgagataatgtagatgaacaagcatttactgaaatttgaaccatgatagatttatcaagtcattctatatttattttttaatgtgtattcctgggctacctccaagctttctagaataaaagagatgattttgaattttagaaatggaaccaagttaatctggaaaatattaatatctagacatcaatcctagtagttgtgtttgaaaactctgtattatattcattacttagaagagaacaaaaagtagggaaagttgataattttctaattcatttaaagatgtattataatttctttcactgagagaagtagtgtaatatcaagaaaatatttttgactaacaaactgtaaaatgaaggttgttttcttctctttttataatcactatcttccctttcagcagttataatcaattaggatttagcttggaattatggtctcagttataacccatttctgctttattcaaatgttttctgagatttgctttgtagcttaattttttatacattgagctcattataaaatatttatagggcatatttggcctcacacaatactcttagcatagagaaacctatgcatcaccagggaacaatttctgtttgaagataaacatatttctcatcagtacagaatgaattatatcggaaacaattttgtatcctgagcttggctttatttcttattactatgatttttaaaaattattttacaatgtgtgaacaaagaagttatgtatactttaatgcttgaaaatcagttccattttttttctcatccataagtattttcagatttactttgatggtacagaaatagaatcatgtagaagaggatatttttaataatttggagtgcatttgtgaggtgtgcgtgtgtgtgtatttttcagcattataattccttgaaaattttcttttagccatcatttgtccttgcctgatcattgcatcttgagtttttaatgctgggtggagtatatttatgaatacctaaatttaagaatgactactcactaagaacaaatgaaatgcaaatatcattcatttataatttaatacttacacagcatacattttaacctgcttactttttaaaaatacaaaaaaatgataatggcctgaaaaactgcccatttatagtaggtaacaccaagaataggcaatctgtgaagatgagaagaatgtttgtacagatgcgaagcatagatgttactcagaagtgagaggaagaaaggggaagagttagaaaattgcttttccaaatacattggcaaatcaactgtggaatgcgatcaacaccatttttttgtttgttttacatataaaatcattttcttcagttgtttttgaactatatgtgtggaagcagtgtttttttggtagtggtgatttatttgcttctctttggctgctatttatataggattacattattagttatttatcagtagttagaacagtcaaatttttagggtcaatatgcctggtgtgatggtttgtttcactgatgcatagcagttggacatactatttttcacactttattactaacttcaacattctcaaaggaagcattgaagagaaaattgaggcgggacagtacaatttcttagcatgcctagaaaacaaaagattaaagcaagtaatatatatatcacatggacaaaggaagagtgtactcctggttgtatactaagaagccttgtattgctggattttacagagtgtatccacagacaagttttattaatctttgcctacctgtcttgcattttcacagtgagaatattcaataattcaaagcacattcatatgttgttatctttggagatgagaggaagattgaataagtgttaaaatgtgcactgatttttacagtgaaattcagaaattgataaacattttttaacttcaaatttaaattgagatttagataacgatatatttaaacatacatgttagctcatattattttgctaaatgaaatacctaaatacaaatttaatatcttaggatacatttgatatttttccatggcaggttgttaatataaaagttatttctaaaagcaccacacatacctattaatatgaatagtaaatacaaatccaaatttaaataatctaaaatattattttattgataacattaaaatagtaatatttacatgtatttttaagtaatctcaatttttcatgtcatatctaagaaattagaagaacataaatccattatagtatctaattcacacttggaaatgttcctgctgcatactttctattcagtctcttcttgatttattcattcaacaaatactcattttgtgcctgtaatttgccaagtactgttttaggcatgagaacaaaatgaataaattagacgcagtccatgagctcttgaagcttataatgcaatgaggaagacaggatacaccaaaaattgtgtaagtagataaaagctagtcaggcactgacaggtgtactgactttgatagagtgataaagaaggtatctagaacagtaacttgaatgaattgatggtgcaagcctttagagggggtggggatgacaagcaccaagacagtagggtgctaggtgtatccatggaactgcaaaaccaacgctgcttgggagagagagagagtgccagggtagtaagaaatgagaccggaaagagttccaaaaggtaaattacctagcgcctttataaggaagagtgaaataataaatcatgcgtgattaggcagatgatgaaaccatggagtaccacgatagtagtgagtatgcagagcaaatctaatttggaatctttttttttatatatacgtacgacattttgatatgtgtatacaatttttccattagatcatgtgtaatgatcaaaccacagtaattagtaagccctacattcgctttgggtctgccattactgtcttaaaattctcaataatttttgagcaagggagcctatactttcattttactccaggcctagaaaattaggcctagaaaatgaggtagctggtcctgctttctgctcccacttagaggatctgtaagaataataacatttgtaaatgatgtactttaaaaagtgtgacttacaatttctgaagcccagaaaaattatgaagtgattacttaaggaaaattttcatgcacataaatacaagcagagcaggagaataatgagttaacacagtgatcttattttgtgaagagattaactgagataagtggaatttcttacaattttagattaacattatgttattaatcttcataaatatcacatcctgagttcccattacatggagagggaagcatttttagattattaaaatgaggcatagagcaaataaattataaactctccaaggaagtccctattcaagggttttaaagtaagaaatggcaaatagaaataaagaaaaactttatttttctttaaactttagtactgaattcttggtttaccatcttcaaaaaaaatctgtaataaaaccctaccctttcatctatgaattataactttttaaaaatatatttctttaccaacattttaatacagtagattcactaatatttgttaattttgaatttgaagacatatcgatctaatgcatttccaaatgtgagcttcttaaataataattgttgttccttttattgacatgatatagcagtattacattgtaacactacatgtaattgtgattttggtaatattaaactgtgtttgttttaagattttcctctgtagctataaatgatgaaatagaaagtaccagtaaaccggagtattttttcacactaaaaatatcatatttttaaaagttacaatatttacatttcaagatgagaaagtagggttaataaaaactgctattattagagtaatagtaacaaaatatacaatagcatcaggttttttttaatatttaatgaagtcttcctccaattatttatatgacaaaaatttaattcacaaaaagcgaattattggaatgattgctttgaaaaattgcctgattagcttcttctgcccagtctctcaaaagaaaatgtttaggtataactaacttactgggagagtgtgataaaaataaacatgctttattcatgtgccaggctgctctttcttagcatgcaaataaaactgcatgagggctaacagctgctcttagagtactgcatgtcccagtctgctaggggaacacagctggagaaatgtacagagcattttcatcattgaatcaaacacaaactagaaagccatttagtactacatatgtaatactattactattgaaaagtagagtttctgttctctccttttttctgacacccattttaagctgtgccccagtggttctttacaggaaagtttataaaaatacataactatttcatggtatttcatcttgaatttttttggaatacagaaaactgtattttttccttcctctttccttttctcccgctctcctttctttcctttctgtcttcctaaaagtgtttcttttctacctaccaaattttaaaccctgcttgaggcagtgaggaccgtatggtgaacagttgaggttgatgctcgtagagctgcatcttttttttttttttttctgagatggagtctcactctagtgctcaggctggagtgccatggctcaatctcagctcactgcaacctctccctcctgggttcagtcaattcttgtgccccagcctctggagtagcagggattacaggcatgcaccaccacgcccagctaatttttgtatttttagtagagacaggattttgccatgttggccaggctggtctcgaactcctgacctcaagcaatccacccactttggcctcccaaagtgcggggattacaggtgtgagacaccacgcccagctagagctgcatctttcaagaccgtaatagcatctacaaacagacctcttcaaatggaagacaaatgaaaatttataaaatgaaaaaactttaaacagaaacaaggagagggagaggaatggagacagaggaaggggatgagacagagagagaggagaagagtggtgagaaaaaaagagaggaaaggaatgggaaagagagaagaggaagagagaaaacaaatctcaaagctatttggggaagatgaaaaagaggatgtgaaatttcttgttatgagcatttattgtcatgaaattttaatgactattaaaaaatcctgcacccaattgctttacatgatccaatctccattttttttttttttttttttttgacatggagtctcgctctgtcgcccagactggagtgcagtggcatggtcttggctcactgcagcctcggcaacctccaccttccaggttctagtgatcctcctgcctctgtctcccgagtagctgggactataggcacctgccaccacgcccagctaatttttatatttttagtagagactgggtttcaccatattggccaggctgttcttgaattcctgacctagtgatctgcctgcctcggcctcccaaagtgctgggataataggtgtgagccaccgtgcccggccgtatcatccactctcctacggatataattaaaaatccacaatctttagaacttcagctgtcaataattcttcccctgctgcctgacaccacaagcattttgtaaatactttggctctaaataggtgatatggtttggctgtgttcccacccaaatctcacgttgaattgtagctcccataattcctatgtgtcgtgggaggaattgaatcatggggtgggtctttctcttcctgttcttgtggtagtgaataaatctcatgagatctgatggttttataagggggaatttccccacacaaattctctctcttgcttgccaccatgtaagatgatgtcctttgctcttctgccaagattgtgaggcctccccagtcatgtggaactgtgggtcaattaaacctttttttttttttaataaattacccagtcttaggtatgtctttattagcagtgtgagaactgactaaaacagtagggtaaggttgtaccaactttggggaagatagtagtgacctcttgtaactctacaattgttttggaccatttatatagttgtgaaatagttcaacctgaaaatttgccagcagattctgtgtatctcaatctagccatacttcaagagtagcaagcattataaacagactaacctaaaggaatgtgagaaatttcaagggcaccagcaacctataatttaataaagaagtaaggaaagcacaatctcagtgagacaggagaactttctagaatacctggggaaaactatactcaatttcaccatagctcacaagtcttgtcatcctgtagtttatgattatgaatgcaggcctattttcagctctaggacagccctgataatttcatctcaattataagttatatttcaaacatgaaaatagaaagattcagaggtcagggccaaaaccaaaggatgattttgagctgatttacaggagtcatcagagaaaaaagaagatagaactgaactatctaggtttattttgggcaggatcacaaaattgaatcttgaaacattaatgtgaggttccttttctgggggtatttatatgaacagcagattttttttaaagaaataaaaatatgatattgaatttttgcagagcaacctaaaagcatctttacacatttttctgaattaacagtctcttacctcttatattctaaggaataaaatagggatttcttaactcttatcttaattagaaagtatttattgatgttttctgtcaggaagcaaataaactaatgtcacttgagaactatgttcctgcaaagcaatccaatgcatttattgtctactttgtttttgcagatacagtcacagatgccttttctcttgttaagcagatgtctaaagaagaaaacaattatcatatttaggctgaaaagatagaatgtatacttcacataaattgaaaataaaaatcacatttcccagaaatgaccccaaacaatcaagcaatgaaagtagcctaacacccatgggatacaggacagctgagctacactctatgaaagaacagtatctgtcacagttcaaaaactcattcaggtctttctatcctgaaagctactataattcttatttttcttataaagtgtgatgttgctgttaattgacatcaagaaaatccttacaacttgtgtcaaatgacataaagtaacacagatttttgtgtcaaaaatgttatctaacattgaaatattttcacccaagtatatatactcaatatcacacacaacgatagacctatgcatattaatttgtccctgtggagagtttagcaatctgtgaagttagagggagcacagttcacacaagaccaccctcacttctgacaccaactacaaattcagggttatcccaaaactaccctcatgtttggtgatttgctagaaggactcacagaactcattgagagctattatacccatggttatggtttactacagaaaaatgatatggattaaaaaccaccgcaggaagaagtacctaaggcagactccaagaaaataccaaacatagagtttcggttgtcctcccctcgtgaagtcagaacaatatgactttcttagcatcagtgtgagactgtacacatggagtattgtgaatcaggaaagcccactagaacctcgttgtgcagaagttttactaaggcttctttgtggaggcatgattgctctcatgactgatcttaggaggtctagctatattaaccaaaatctttgccctacataatactgttggtctttctggcatggtcaacacagaccctgaatattatctcttccccttcctctctatctccattcctctcctctctctccttgtttctgtttcaactttttttcattttatgaattttcatttgttttccatttgaagaggtctgtttgtggatgcttttatggtcttgaaagatgcagctctatgagcaatgacctcaactgttcaccacattgtccccactatctcaagcaggtcatttatttattcattcattttatattaacttaccaaacagtttggggcctatgtgcctcatcttactttgactgacattggtcatagaaaaacacatagtcatagaatgttgtgattagtaggtaatcacaatatgaaaaaatatacatccaagatgaatcgtcagctctccctgaagggggtgacttccaagagggagaaaactttgaactgcctttgagctgatctgtctgtcaagctacctactgggttgatgttatatgagtgagtctgccgggctacccaggcaggtgaacaacatagggaaagaagaataaagcaacatgacatatttccagtaacatttaacaacaaaccacatttagacagatgggaagaaaactcagacaaaaacaaaaccaaacaataccacagtggttctcaaataatagaaggcaataatgtgggcaaggcagacagtctgtcatctgttgttacagagttgtttgtacataaaccttgtacgtcagcaccttattttttctaaaactaggctttggaactgcaaaacctgagggattaaaaacttggaatagtaggaaacaagccgacaatagtaagaatccaatcaccttgcacaatacaacgatatttcactctgcctgggaatgctttctcaggtgttatactgcccattgaacacgacttctacacggcacgtctgttgatcttgaactgttttctgtcccaactatgctttcttatatactcaccaacatgtcccaacaagtgtgtgacctttatttagtgcaggctagacattatattacatttcttatttcttccctgggcaaactctattcccctgaatatcaaggcacataactcactttgtccaatgtttcaacagaaaaaaatcaccagagaattttatacacagtatattaaacccaacttagaacataatgaaaaatgtaactttattctagtctcagagtctctccataaactttactcagtgggggttaacttccgttcttcctccatgaatacatggctggccccgtgcgtgttcagcatattcttggacagtatacattctttcagtcgttttaagaaacaacatagtcaccattcagcaaataaacttccagtacacgactacattaaaaaatagaagtagctataaaagaaaatatttcttctctctgtagctcaggtccgtgtgttaaagaaagcctaagctctctcccttcttttaatccctatcactgtctgcttttttttttttttttctgaggcagagtcttactctgtcacccaggctgcagtgcagtagtgccatctaggctcactgcaacctccgcctcctgggttcaagtgatcctcctatcacagcctcccaagtagctgggactacaggtgtgcactaccacgagcatgcctggctaatttttcgtatttttatatgaaatgggttttcactatttttgcccaggatggtcttgagctccttggctcaagtgacaggccctcctagacctcccgtactgctgggattgcaggtgtgatccactgcatcctgcctttaactagttttatcttgcattggttatttattgtttgagcaatgagttacccccacatttagtaggttactacaagaaagattaattttctcattgtttctgtgggtcgcctgcaaactgagcatggcttccctttatcctctagttctaggtcagggtctctcacaaggccataatgaagatataacctaggctactatcctctcaagtactggattgacaaggggaggattcacttccatactcactttgtggctgttggcaggcctcaaatcctcactggctattggtcagataaatcagttctttgccatatggacctctttacagggcagatcacaatgtgatatctggcttctctcaccacaaacaggtaagagagcagagcctgaaatgtaagcatggactctttaacctaatctcaggagtgacattccactactctgtagtgttttactccttggtagccagttattaagcccagcagaatctcaaggtgaaggaatatgacagcctgaatactaggagatgaggataaccagggaacatcatagaggctgccagccacaatctctgtggaccaggaagcttttaaaagttgattctttgcctagttttgatcctttatgatctttgggaaattcctgttgctggagacgtctcacctctggttaccttaatcaggcaatgagtctatatttcggtggtcatttagatttctcccttagcctttgggccaaaaggtggcaataatcttcttataacctaaaacaacctctctcctcctagtagtgtatacatggtgcactgaaaaaaatctatatcccttacctttacagatggtaggagtacaaactgatgccagcacagcaactctccaacttatatagtattaaaaatgagcatttacatatgatgccatataatttagtgtttggatctcctactcccctgccacccatttgtgcactctgtgctcttatttcttatggtaaaacaatcctgtatttcaagtaaacaaacttaatcagtttaatatagaaacaaatactctaggaaaattaagttttattataaacatattaatgaaaatcaaaataatttaaaatataataatggctttcagagaaaagtgtttttgctttcctttattatttttgctaatagtcataaaaagataaggaagttagccaataatgttatcagaaaacacagcaaagcttttagatgcccttaaactgtcaccaaaatcaagtgtaatttactttcttttatgtattactagcaatacttatgtcacatttttcagtgttcccatactatcagggaatgtgtatattccactgagctctgattatttggtagtggtgttacattttaacatagtatggccataaagttgtactaaaaaatagcgaattttttttattctgtatgaggaaataagctatttctccattcttttatctaaacacttgataacataggataaacattaacccttcaattaactaaatataacaattggcaaagaattcacgttaggaaaggtacaaagcagtaaatctacagattgttggtcctaggatatatagctcttctggtaattacagaagtctgtagtatttcttaatttttcagcacagttgataaagataatatggatagacactcaaattgtttttattttacttcgaagatcagcacatttttgaacatttagaaaataccagatttctctggcatgtaatttctctatttaaggataaaaaatctgatgaactctcaagtccctattaccttaaattccaaaattgttttaaaaatgttgagctagttacttcttgaggaaggagaaagaacaaaataagtatattcataaaccttctctattaaagttacacagactttaaagaaaacgtcaccctttgtcagatggatagagtgctaaaattttatcccattctataagttgcctgctcactatgataatagttccttttgctgtgcagaagctttttagtttaatcagatcccatttatctattttggcttttgttgctattgcttgtggtgttttcatcaggaagtccttgcccatgcctatgtcctgaatggtattgcctaggttttcttctagggtttttaaggttttaggtctttcgtttaagtctttaatctctcttgagttaatttttgtataaagtgtaatgaagtggtccagttttagctttctgcatatggctagccagttttaccaacatcatttattaaatagggaatcctttccccattgcttgtttttgtcaggtttgtcaaagatcagatggttgtagatgtgtggcattatttctgaggcctctgttctgttctattggtctatatctgttttggtaccagtaccgtgctgtttttgttactgtagccttgtagtatagtttgaagttaggtagcgtgatccctccagctttcttcttttttattaggattgtcttggctatgcagactcttttttggttccatatgaaaccaaatttaaagtatgaaatttaaagtagtttgtttccaattctgtgaagaaagtcaatggtaatttgatggggatagcactgaatctataaattattttgggcagtatggccattttcacagtgttgatttttcctatccatgagcatggaatgtttttccatttgtttgtttcctctcttacttccttgagcagtggtttgtagttctccttgaagaggtccttcacatcccttgtaagttgtatttctaagtattttattctctttgtagcatttgtgaatgagagttcactcataatttggctctctgtttgtctgttattggtgtataggaatgcatgtgatttttgcacattgattttgtattctaaaaaaaacaaccccatcaaaaagtgggcaaaggatatgaacagacacttctcaaaagaagacatttatgtagccaacaaacatatgaaaaagagttcatcatcactggtcattagagaaaagcaaatcaaaaccacaatgagataccatcttatgccagttagaatggcgattattaaaaagtcaggaaacaggccaggtgtggtggctcacgcctgtaatctcagcactttgggaggccgaggcgggtggatcatgaagtcaggagatcgagaccatcctggctaacatggtgaaaccctgtctctactaaaaaatacaaaaaattagccaggcgtggtggtgggcacctgtagtcccagctactcgggaggctgaggcaggagaatggcgtgaacccaggaggcggagcttagagtgagctgagattgtgccactgcactccagcctgggtgacagagtgagactctgtctcaaaagaaaaaaaaaaggtcaggaaacaacagatactggagaggatgtggagaaataggaatgctttcacactcttggtgggagtgtaaatttgttcaaccattgtagaagacagtgtggcgattcctcaaggatctagaactagaaataccatttgacccagcaatcccattactgggtatatacccgaaggattataaatcattctatgataaagacacatgcacacatatgtttattgggttactattcacaatagcaaaaacttggaaccaacccaaatgtccatcaatgatagactggataaagaaaatgtggcacatatacaccatggaatactatgcaactgtaaaaaaggatgagttcatgtcctttgcaggaacatggatgaagatggaaaccatcattctctgcaagctaacacaggaacagaaaaccaaacaccgcatgttgtcactcataagtgggagttgaacaatgagaacacatggacacagggaggggaacatcacacagcggggcctgtctgggggtgggtggctaggggagggatagcattaggagaaatacctaatgtagatgatgggttgatgggtgcagcataccaccatggcacatgtatacctatttaacaaacctgcacattctgcacatgtaccttagaacttaaagtataattatatatatagtatatatacatacatacgtatatacatgtatatatattacatatctgtcctcattagttggaatacagcaggctttactagtgtatctgaagtaaggaggaaccaggaagtgagctgttttgtaatggagaccagttatatctaacagagggcaacagtgtctataagactgtagcctattggatgggaagctatcttatgcaaatatgatgaatcttttaaattctgagttcaatgcagtctacagctaaactcaaatcccggctcatactaaccttggtccttgggcatgtttatgcttcagttttctcatctgtacatgggttaataacaatactcagcttgacagtaaccatactgcacagtgcctaacacatgtaagtgctcaattaacgtccatttctactttctgaaaatatatggtattagtgtgcaaaaagttgggctacataactcaaatctcctttgtatcttaggtaagaccgcttctttctctggattgtttcttctagtcaaatgcacaggaatttagttgatctcccaagttattttggaccttaaattctgttttattcttgttcattttctatgtagtttagatttagttcattggactgatttatgttctgtgttcttttaaaattcaggaagatgtgtataggatagatagagcaaatatataaacactcaatttcatttactttaatataaaaactaacaagtttctcattagttataataaccttaaaattgatgtgtttgggaagcaacctgcatagtcattaaaagcaggagttacagaatcacaaaaaaaaaaaaagaaagaaaacatcactaacaatgaaagcagtaactaataaatataagttgtttttaattgtgcaaacaatttgagatttgaaaagtatttctggaccaagatggtgacagaaattttagggcatcagtttggtcttgaagtttaacaagatttaattgtcagaagtatactgtaaagtgtattctttttcttcttcccctcttccaaaccacaataatgtaaagggtatgtggttattatcagtaagaacaattagaccagaattcatcagaatggatatcatattaattctgtcctggttaactgtgataatttaagtctttgtgtattttcacttgttcaatgagtcactgggtattttaacaatgaaaaatcggtcggaacagtgttacactgagaataagcactcttgaaatgcccaatacttttgaaataatgaatacctgttgttaggtaagaaattaataattattaagttcaataactcatctccttttagaaagtcccactgtatctgttataaaattttaagaaattttcgaggtcggcgaatttacaaggagctgtatttatggcatctttctggatcctacttttgcattctatctttctggttaagttcattagggtttccagcagtggttatcttggatctgaaacattgtcagagatcatatgaaaacctgaaactgtaaaataagggtaaaggaatggtagcgattgtaaaattaagaacaaaaatcagatttcacacaacagaatttgaaagcttgaaataatagagaattttcagtgtttcaataaataaataaaatattattagtgaagggaattaagagtttgatattatcttgatgaattcaaggtagctgaaattagcaaatctgattttgtttgcatactgatagtgtatcatctagtgggagaatcaggtgaactaaattctcagagactgatgtataaatcaaagtataaaaatattgtgttggtaacttacagggcactgcttagatttcttttttctcacaattctctcttaatgagatcttgcagaatggcgaacttctcacattttttgactggcatattccttctttaaacttgttaataccattacttaggttagtgtcaactgtcactggtttcaaggagtcttacaatctctgaaagttgacatttcagatttctaacttaattcattgagttgtagttaaactcatatgaggggaactttaattcttaacatgtagttaaacttatatgaggggagctttaattcttaacattaacctctcaaatgtgggtcactatgtacaaatgatgaaaactaactcatgttttaaatgatagcaatatgaatggcaaaagactaccttagcatatttttaataaaaactgctattgtgctcaaaactcctgaaaaaatcacattttacataatcagtaatgaaatagttaatatttctattatgaaatattctgatgtgtgaagaattgtactgagtagagccctaacttctacttggttggtgcaaaagtaactgtggtttttggcattactttagtgacaaaaatatacacacatatatattttgttgttgttgtttgtttgcttgttttttgagacatagtctctctgtgtcacccaggctggagtgcaatggcgtggtctcgactcactgcaacctctgcctcccaggttcacaccattctcctgcctcagcctcctgagtagctgggactacaggtgcccgccaccatgcctggctaatttttttgtatttttagtagagacggggtttcaccgtgttagccaggatggtctcaatcttctgacctcgtgatctgcctgccttagcctcccaaaatgctgggattacaggcatgagccactgcacccggccgaaatatacatcttaaaatatatattttaaataatatattttaaatctctctctctctctctctctctctctttctctctctctctctctctctctctatatatatatatatatatacacctatttaacaaacctgcacattctgcacatgtaccttagaacttaaagtataattttatatatatgtgtatatatacatacatacatatatacatgtatatatattacatatctgtcctcattagttggaatacagcaggctttactagtgtctctgaagtaaggaggaaccaggaagtgagctgttttgtaatggagaccagttatatctaatagagagaatcagtgtctataagactgtagcctattggatgggaagctatcttatgcaaacatgatgaatcttttctctctctctctctctatatatatatatatatttctatctctatatttctatctctctctctatatatctatatatatatgcatatatatatgcatatatatatagatatatagagagagagatagagagataaaatgagaaattacattcctagcaactattttagctcattaagacctatgtgaataaatcattgatatttttacatgaaagagaccataccataactttacttcactagatattaggccaagtagccactcttgaaaaaagagcaggcaggcaacaaagagaccagtattgcttactattgcagtaatacagtcatgagattatgagggcctatactttagctgccaattaggaggacatattttagaggagtgaaaaaagaaacaatagtttgagtgtctgattatagaagataaatatttttcccagcagataattcctttatctttgctaggcaagatatcaaggtctgttaatgaataagattaactagcataagagacttgagtataatgacaaagtttcttttatacctattgactgaaaatgaattatggatttagcaattaagtgtttgttggtaactttcaagatcattcagaaatcaaactgcagtttataaagcccagagttaagtgattttaacaatttgatacttgctgattgaccttctaccaggttttagataccattaacatatagagtaaaagagataatccttgccctcaataaacttatagatcataaggaagagatacagacacataaatggtgcaatacgtcatataaaacattacacaatggtgaaaatgtaggaaagagtagagagcacaaagtcagtctgcaatggcttcacagactatggccaaaccatctctaaaaggagaaatacaaattcatctctagaataaggggtggaagggagtttatttccgaaagtgtgatagtaggttcacagaacacataggtttatgtaaaagagcatggtgtgttttcttgaagatgaagtttaaaatgaggagtgatgtgatcaaatatcaaacatgtaattggaatctgcttatcataggtatgcaagagatagaacaatgagaacagttggacacaggaaggggaacatcaaacaccggggcctgtcgtggggtggggggagcggggagggaatagcattagaagatatacctaatgtaaatgatgagttaatgggtgcagcacaccaacatggcacatgtatacatatgtaacaaacctgcacgttgtgcacatgtaccctagaacttaaagtataattaaaaatatatatatataaaaataaaaaaagacaaatgtctctacccttaagtagtttatagttataagtgaagaaaaccttacatgaaaaagtaatgaagaaagtgatagtacaacaagcagtatagtagaagactactgtcttctaaatttccaaaattatttagataactgcagaaaaccaacaagtatttctcaatcttaacaaacctcactcatcaagactttaatcccaaaatgatcctttgatttagacatggagaaagcttcgtagagtttatacaaattgttagaatttgacatcttcagtttatttctcattaggcattgcacaatcttcaagaacagaaacttagaaacgttgttatatctttggaagatatttagcaatttatatattacatttgaaaagaatgggatctcgatgaggtaagatacttttagtttaaaaagcatcttttttttttccaaaaacacttagctaaaggacactattgtccattacgtttgcaaaagagatatttcagaaccacgttcaaatataggaaagaagaaatcttttttaaagaatgtagaataagcatttataaggaataaatgttcaaattgatctgcagtaaagttaaagtgatattagttttgcatcagtcatctatattaatgttgaaaaatcaaagagaaaataggagattttgttattgttgcttaagcaaccataagcattctggttatttaagtcactgtttcttgtacatactttctgagagtaacttgaaagtttttacaaggtgcataagtgatcatttaaatgtattcaagtaataatcatgtagatgataacctcatggcctggaagagattatggcaaccttgtgtatgcttcaggacatttgtgatcatggcaaggtatcattagtgtcctggacatttaaaatatgcagtgtatatcctaaagattcacattggaagctttctgggcattgattatgttatggctttaggacactcagaaaagattttaattaaataaatgctaatgaagattgagagaaaatagctcataatttaagctagtgcactcccttatagttatcaagaaactgtttcttgcatctagctccctgtgttatatttttgtgtaggccatgaagatagatgaacagtgatatttctgggatgctgctgctcataaggcactatacgcaagctggagaaaatctggcagagtgcagaatcgactatgtctaattctgtttcatgtatatagatatctcataattcaaaggttctacaggcaaccccgcagatagacagtaaactcttgccttttgtctagttggccttggtctatgttccctctttatcttttgtcttcatctctctttttgctcctaatactgctttggcttcctggtgcatctgctcatgtggtatctgcctagtttccctcagttttatggttttactcctttgtattatgacagcttaatatttctatatatgtatctatgtatgtattaatttatttttgagaccaaaataactttgctttcatccagttaacaaaggagctttagatattatagaagtttttcacattcccttttatagtaaagaaagaaatattgccatgaaacagaagacaaacaacaggggacatttaaatgtttgggaaaaatatgggggtaataattcaaatataaatacaggcttaaaacttacttttattaacctcactttgcccttggcatcttgtactttgaactggggcctgtccagcatctttctcatttcccactccagcgttacagaccaaaataccattctgtaaatgatttctgcctaccaattgataatacgaaactttattctctcacacttacttttcccactgtgtgtgtgtttataaacattctgaagaaatgaagatcattaaaatgaactgtatgccatgagtagttattttctaagccaagtatttatgggggctgtataatgttctaatgtttaaaatacagtatgatagcagtaaaatcaataattgagttgagtgggattaatcccccaaagtctttaaaaaaatgttataattgataagaatgtcaaccaaagatagaaacacttgtagaatgcttggaagtctcctagaatataaggtcattaatagaaaatgaactgaatatttgttgtgtatttgaatccaggtaataaacatttattttcaggaactttatatccataaatcacatcttcctataaccatgaaatgctcttctagtgttttcagtttctcacctgctcctctttccctcatgatattacattttttgcacatttaagccatgaccagtgatgaccaataacaatctctgtcggtcgttcttcaggcatctggcatctagcttttggaataaaaatgccaggattcccccactgaatttcttttaaagttcacattcttcttttacctaaagggcaatgtagagaaaaatagtgtaagatttcaagataaaagtgaaagctgaaggaatttcaacagagaagattctcataaccatcttagccaccttgttgtatgtatataaaaagtttagaaagtttacagaaacaaatttaattacatttcaaattctttttagtatctgaaagaatattctcatatattattctgtactcgtattttaatcagagtagttttcagtcaacaatccactgatcctcttttctcttcctgtaaggaaacacttccccatcttgccaactctaccttgtattggcaagtgttgtttctaaatcagattctttttgaatgcactaagcaaccattttcatactaagttgccatttagctttgcttttatgccttatgtcttgtatggaagctattaaaatttagttgacttcataagaaatatatgcccatactgatacaaataaatgaataataaacaggaaagaagagacacatttcccaagcagaagaatcccaaataatttatgtggctactcctatctcaaagaaaaggggcacttgacatcagccatgtaatcaatgtggacattagtagtaataaatcatgttgatagtatggacacttaatatgataatgtgatgtgatgaaaatggcacatctcttatgtggtcttccttctaataacccataactccagtcctgtcatgagaaaaataccagattaataccaaaatgaaacatcctacaaaacagctaaccagtactcctcaaaactgacaaggttataaaaaaataaggaatgtgtgggaaactgccacatccaagaggagcataaagagatattccagctaaatggagtatggtagcctggttggaattctggcacagaaaaaagacattaagtaaaagctatggagaccaaaataaactgtgaactttagttaacaataatgtgtcaatattggttcatcaattataacaaatgtattatactgatataagatgttaataatagcagaaactgactataggatatatgggatttttctactgtcctcttgatttttctataaatctaaactaaatatttagttgctgatgtactgttatatttggactgcagtgccattataccatcctttttttttactgtattcttacaagaaactggcattgctggcaataattcacttaatctctccacacatatatacacatacctcaaaaatcagaattattgtacttatcatagaattgtgaataaatttaatcagttcaaaatgatatttaacaacattagtccagtgttcctggaagcaagcattcacttcttcccacatggccaaatctttgttcattttctctagatggctagagaaactatctcttccattgattcctaacaccaagcacatgttacagttgaccccaggtagatgaatactctaatttctcccctaggtcactctgatgacttaaaaaacaaacaaacaaacaaaaaaaacactcatctaaggaaaaaaataagactctgagacctaagattgttttctaagccagttcaaaggtgaagttctgggtgttgaaggctccagggagagaaatggagtatatttttggaaactggaaattaaaatcacaaagtatattgatggcccataggctaacaggtcaaacagtgtgggttttccagtaaagggtctttgctgaatatgttagttgccccactcaggatgacggtgcccctgttgtcatttttagtaagtcacgtgtgccccactgtcagctggctagcagctcatgtcagatttcagcatctgggtgccagccagtctctattgttctgaatttttggcgcatacaggaagcactcattgtcatttcatgaggaggagtgcagtttttatcctttctctggttttcagctcttttctgctttatagcatacctatgcctttctaatttctttagttttccctccgtttttcagtgagggtcctagtctgcctggagagtcaggtacctgattctcttctcaggataccttctcaggtatctggttccctctctgtgggacttctgaacaaacttccgtctgtggcaaatcactgacttctgaaaatcacagttatttgacctaatgcttaaaagtgaatgaggaacttttcccttttcaaaaatgcttccttcgccccaaacccccataaaaattatttgtgtgaaagtaaagctgcagaaaatgttcctgtccacttattataaaattttcatctggataggtacataggataaaggagatacaaattacagcaagataggctagggaagagaaagcaaatccctaatttttttcttaatggagacttagactctatactttttgttaaagggaaagacagtagttgtaagttttatggtccaggcagccttgacatttccttttccggagcatgattttatctgaatatagttaagaatgtaataggaagaaggtttcaattcactaggacctagtatggcaaggaaaacacagagttattgagacaaatgttaaatatggcccctgggtttattaaaaggctttgatttccttggtggcctctgcttcagagcaagctctagcattctaaagtagaattcatctgggtgaatatgtccatattagaaggacaagttaaacagaataacatctctaataatactaaattattaaagcaataaaataatgggaattaagggctccacaaagcattatagaatgatatgtttcttcagattctgcactcttttattatagcatgtaaattattattctgttttaaaataagttatgaatttcaaaataatacattaacagtatggttttgccacctaacagcattctcatttatttatgtaacaaataaaaatgcaagaccctcataaacataattaaatatcaaattttctaggatatgtgcacgcagattcagttatgtccaaaataatgaaacattataatttttatgtattcacttttgactctctgttttctttgttcttttactaattacaattcaaaatattatttcattgatttgaacttcattagtttaaacttaacaaatgtgagtctgaaattatcccccccccaaaaaaattaatgcattaacacaaactttaggccacaatttttgtccaaagggaaaagtttccagcagaataaaataattaaatatatatttattgctattttaagaaaacagtgtttttttggaagtatatcaagggaacccagggaaatgaaaaatatttgttacttataaatggtataattaaaaatatttttcttccaattttttttgctcactaatataaatatatgtgattatcatagttattttacattttcttagcaaataatgctacacataaccaaaggtagtatttcaaaatgctacagtcttactcaatagagttccatgtttccaacccagagttcttatctttctatttatgctctgttaatcactagtaattactgcactttcttttcctatgttattattggtagaataaatttctgtgcatttaaaaaggccaagtacaagtgacattttatattaaagagcattcttcctgaaggtacaatgcatgatttcaacaaattatactgtagtaaatatttttaagttgttttatcttaatccagtcctagaaatatgtgtttattgttttctgaaagcaaagagaccattactggaaaacaaaaattgtctacatggtcttagtagctaacaatgtatagccctgcaaattgcagaagttcagtttggtagtggcatcttcatttaatattgttgcaatagccagtcaaccattaaataaaagttcctgaaatcctggtatctcctcttattcttttatttttaattaaagctgcagagagtcattgactgaaatgtcttctatcctcgttgcttttttaaaaaaatttacctcagtcttttatactcctccttaatcatgaatgcaaataaaattcaaagtgtaatcagcagctgctgaaagagagcactgagcaaactgggttgccgtggaaaccatgaagtcagtccttgaccagacaaagaataatacctggtgtgtgtgtgtgtgtgtgtgtgtgtgtgtgtgtgtgtgtgtgtggtgtatgtgtgtgcacatgcttaccaacaatttgcaaagaacaactaaaaatgtttcaaggtttattttccccaaactaaattgttcatttttagatatttacattacagatgaatgaatacattcgactattaaatttgtaagcaattgcctctcatttgagactggatagtcctgtcctagatgaagctacaggtatgacaaaagtactatcaaattgaactgagcacaataaatattgaaagccttccactgcaaacaaataaataattaacacaattatttggtctattatagctgtcattatccttgctttcacttctccaacaggcgttgcagcattttaattgtattttctcctgggaaagaattatctcctgctttaagctgctgggggaaagtattgttaagctttttaaatgctgaatataaaggtcataccactgagggattttcagctgtgagtaaacaaattcagaggaaatagtgctccacatcactcttattcaacacaaatgtagttttagactgactgcctcaatgtttgaggatcttaatttggcatgtgtaatgaccattgctagtaatagtatgatcggagcccaaaattattaaaactcattaataggcacatataaaaataaggaatcgttcaattctgcagctgtagttttattctacattgtaaataccttgggggagaaacgcattactgattaagaagaaataaaagcagttgcttttgctggtagagactctgaatttaagtttgggacatatggacagatcatataccaaatgccaaagcactgaaaaagtgtttcatctttccctctgtccccctttgccaagaggcaaagatggtagcattctttttgcacatgtcacctcagacctagacaatggctctttttttgtttcctttttatcagatgctctcttcatcaagtgtgcaagataggtcattgtgattccctcaactttacagctgagaaaaaacataagcattgaaaagttcggtaacttgtctgagatcgctgaagaagctattgatggggaagaatttagaatttaattctgaaaggagtatctttccatggttttacatttttcctgacttaatgaatctggaattatgtggggttgggaagaagatcactaattgattgaagttagcatatagaaatactattcttactgagctgtaacctgaaatgtttcgttaaaactgtacatgctgccacaactaacaaagagcaagagagaatgtggtcagcaatttctttgcctttttttcccgagttttcttttgcttgtttgtccagtttttttttctatctcattattttgtaggtagtgtttttgctttcatatctgtactttattgttatatcagtcactttccctgatctgtcttgaacaatcattgcaaattcattttgttctaatttgctttacttggcaattacgttaaaaatggcaaagtattatttttgtcagtctagaatataatcaacttattttatctgagtttttaaacagattatgaatatttctggagctttattgtttatatcacaagtcaatttctttggacttacatcattataataaaatataaaaatagttaaaaacatgaaaaattactgtgatgatggaacttatatcagattggccaagtttctcatctaagtacacttctactgtattcatcactatctgcttcatggagagggcagctgtttgtagcacacttacgcaactttaattgataggcagtcatgtatcacttaatgatgggatatgttctgagacgtgcatctttaggtgattttgtagttgtaggaacagtataaagtctatttacacaaacctacgtggtatagcccattattgccagggttatatggtggagactattattcctaggctaaaaacctatacagcacattactgtgctgaatactgaataatgtaggcaattgtaacacaatgataagcacttgtgtatctaaacatatctatatgtagaaaagtaaaatacagtaaaaatacagtattacaatgttacgggtcaaccactatcagaaatgtcactggttgagatgttagtggcatgactgtatatggcaatatacaatgacaattcttttaatatttaagttactatgattctgagcctgattctctgaattttaaaaagtttactcttctccttggcagccctcatcagatactccagaggaactccaaggcagtttcttcattccaaagggattagtctcagtttctattctggagtgtcccatcagtcatcctaagcgttttattcttaattttgcagttaatcagtgctgcatagggccacacaaaatttagggctgtcttagcagtgtggcaaagaagtttatttacctttactgtttccactgtcctagcagtgtctcacatatgtcagaggatatagcatcaggtaccatcggtggaagaaatgtactcccctaccaaatttttataggtagtggcacactcgcctcccactctactattactgaagcaagttctacagcaataagcaatcacagtagtcaatatcaatggttcttaaagcgttgtcccagagcagcagcatcacctggagatttgtcgaaactattaataccgggcaccttcccagatatgttatgtgagaaacactagtggtcaacaccaagaatatgtgtattactgagccctttagatgattctgatgcatgccaaagtttgggaatgatttgtctatgttgcattttttgaagtcttgttttgtgattattcataataagtgtgtatgtgtatgcatgtgaatttaagtgtgtgttctcgtgtgcacatgttggtgttcgtaggctgtggtcaccaacagttctgtctagttttttctggatacctaccttttctctccttcgaaggcacagacttatcaaagtctcattgaatactgaagggaataaatgaagacttagcttcccactgtgcactggcatgcattttaaagaaaaggttactttttcttagaaaaattggtgttaagagtcatatttgcatagctaaagagaacctcaaggtgacttaaccaaaacaaagataatgatgacttgacctcaaataacgaaatgccagcaatttaatctgctatagcacattaacttaatgtgagttagagagctatagctgtataaaaaggagtagaggagactggataatactgggaaaggagcaaagtcatggatgcttacacaacaaacacatggatgcttaccaagatcaattaacaatatgttatattccttttttgtgccacactctgcccatgtggatttctttttgaagttttgcatctcaatctattcaaaatatctcataactcttcactgccagataattccacaatttcatcctgcagtataggacctaattgctactactgtccaacagacccccaaggcagtgttagccatatattaaaagcattttttgtttgttttatgttatacagaataaatttttattaatggcctcaaattgttacctgaaagaggcagatggcaaactaaaccattttttcaaaattcctcatagaaatgctaaatgaaacaaacaagcaaagtatggatttttattaaaactatgaaaaaaattttaataactgaattatagcattcgcaaaaattaagatatgttaaaacaatggaaatttgaacttatttgtaattttattttatagaacttttggtagtatttttatattattgtaatattgtttaaagaaaaaaaaaactagcacagtaggaaataagtttaagggattattttgccagtctttctctgttagattgaataataaacttgccattcaggaaagtcattgtatatttgtataccatttgtgtccagcctggtttatatttgctgatttgttgacaaatttggagcatgtggtaaacttttctatcccaagacaaggactgcacacttcaatttaaatctcagattcaaataagtggcactctttatatttaaatgtaagcacatgctataccagttttataatgttaccacctcttccctgctttggtagagtctcttcaatattagctgattttatccattgttaagatggtgttttcaaagaagataaaaatgcattttgaatatggaaatataatttttcacattcctttgaaatctggaagagaaatgtagtaaggaatcaagttgattgaaaaaaaatcaaaagaaaataacaagtttaaaaatccaggatcataagaagaaaaaagacatttaatcttacaactagatattttaaaaatagataaaacaatgccttattttcaccttcattctatcattttcagccttttttacacacatggggacaagtactatgtcactgactattatctaatattgtgataatttttcttatcacaatgccaagttatcatccacatagtgaaaaacagatataaccttcttatggtttgatatgttaatgagttttaatatatactttaatcctttatttacatgtaagatggtaaagatgcagtttcatagtatcttttgttcctctttttcaattatttctgcaaagtaaagtgtaggttttttgaactatacccagaagagtaggctggaatcatgagaccttactgcacaaagttccacccctctctctgtggtctagcagtgatgaggttgctaggttgacaaagcagtgctgggttttccacactattatgtttcattcataggttcttcacttgcccacagaggttaaaaactaactttaaaaatgataatagatatacctaatgctagatgacgagttactgggtgcagtgcaccagcatggcacatgtatacatatgtaactaacctgcacattgtgcacatgtaccctaaaacttaaagtataattaaacaacaacaacaacaacaaaaacatataaaaaatgataataaattggatagcctaccaaatcaaaacttagtatttcttgtaagttttttcctcatgaagaaaaatataatacatttgacttaaaacaacctgaaagccttgaataattcactctaaattccaaattattttattgaacaaattgatttctactgttatatttgtctctggaagtaaaaaaacaaaaagcataaagtgtgttcttttgggtagcatgatcttaggacttttatatttaatttgcttacaaatacaagaatatgtatccgctgaaatttcttgctactatttagctacagtctgtccttgtaactcatttacaaactaaactcctttccaatagtattatgaaagaaccccctttatgctcccctcatctccaaaagtcaccttttgaattcacactcttagtttacgacatgctgcttttctgaattctttgctgccttaatgatgccatcatcttctgaactcattaaggtcccacataggtttctgtgtgttgcagtgacatctttatctcttagagcagtttggaaacctgcaggggtgtagaattgctacatatggactgttatgcaaactgagtatatcaagcctcacccaaactgaaaaggaaaagtattttgaaacataaaagaaacatatgttcgagttatagatgttgtttaatggaggtcagatctgcacattgattgttttctatcagcagcttagaggtagctgaccatggggatttatttatgagcttaagaggtctggaggaagaaccacactgatcattcacttgattataaagctcctgttctcaaaggaaataatagtgatcagaatcagccactgcgtgattgaagtaggaatataaatgaaggaacatggatttcactttaatgctgcatagactagaaaaaaaaataaatgaaagagtagcatatctgaagattccactaagcctgaaacaaggtcttctaatgcaataatctgaactttctaagtaaacaatgaggagaacccagattctaccaccctcaatttctaactaccctttttcaattataattaccttttttatttctaacttattgttcattaataagagtattaatttccagttatattcgtgcatgataaatatatgtttctcattgatttcaaactattgggtaaattacttttctaaggccaaatacagtgacagtgaagaaagcacagaatttcttgccctcaagtttctcacctattgcttagctactgaatcttgctgtgtttgcaatagttttaattcatgcattctacaggtaagataattagaatcaggtcattcctttcttttaaattttgccagattaaacacaagtatctgccacgaggatcattataatagaaaattgttctgagtttaatattctggacagaattttataaatccgaagtaaaaatgtttttcaattttataaaatattggtaatgagaataagcatgcaaataaaaacaagaaggaattaaaggacatacagctctatataattgaagagaaacttgcgaagagaccaaaagaaactggaaaagtgactgaagtgtgtgagtgtgtatgtgtgtctgtgtgtgtgtgtgtgtgtgtgtgttagaaagacagagatttcttagacatcttagtatatttggtcaatgtcaattacgacttcccaatatagaaatgggattacttatgcttgacaggtacatatttcagtgtccctgtttcagttagtaaagcttttaacaaaaagaaacataatgtgacctacagtcacataaaatgtaagagcatgtattatttagaagaaaaagtcgagagacacttggttccagaattctttgaattttttgttgttgttgttcattccctgatggtcacaaaatggctgcagcagcatcataactcacatgctaacatgactatgtttcaaagcaagaagaagatgagggtggccaggaaaaataaaaaagacataaagtaaaacatctctacgtatgcgttattgattttatcaggactgctaaccttgaggagggcttccttaagtctcattgactacaactgtgtcaatgaactcccctagcctcaaactagtctgggaagaagagtatttgtttattttagcctcagaagtgggaaacgggcaagggaaaagaatggaaggggaaaacattataatattcaatgaacagcacccgccagaattcttatctgcatttaatattaagtttatatttcaggtatgcagtgagctcaggtaggattgctaggcaattccgtcaaagtttcatttcttgtcaagatgagtgtgttcaaagatgatttttactcaattcgtcattcccctccatttttaggaagtaaaatgacattaaaagttgatgcaaatagtcatgctgtaaaattcagactttactgactttttttcattgtatatgttataccttcagttttattcttcaattttccccaaaataaagaaggatgttagtgtgcttcagtgaatcttgtgcattgaattgccagattcagtgaagtttacttaaaaccctgtgtggattattaaaatttaataatatgaataactggaataataaactaacaacaaaagctagatttaacttcatcttttctcaagcactcttaatacagtgtgcattaatttaaagaatcttcaagaagccaatttttctgaatatttgctgaccagtatgaataaattactaggggtcatagctatactttacagtaaagtgactatatttattaaactttgctcagcaattgcttttatgagaaattttaaatatttttctattttttcactattttcctactcattcactttagaattgggaatgtctatattcatcaccatttgtttttatttggacttagttcaactactaagaggcaatgagtttgccaaagaaatcgtggcttttttttagttgtccttccacaccattgaaattggtaatcagtaagctctctgctatgtgtgccgttattgcttaaatcactgtttaaggtagaatacttgttctacttcaggaaatagaaaagttctccaaactctcaatttttaagttgaactaacttttcttcctattacatactgaattttcttaaggcatcatatatgtacatttttaatgtttaaaaatatttttaagttatataattctaaaattattttaaatatcctaattaaaagtatctttcatttggctcattccaaataaatgcttttctttacccagtaaatttaatgcaatttcagtatattaaaataactgcattataaaagaaattgttactacttggttgcctttgtatcagaatgctagtaatacttcagcaaaacaggtgtgtattcaatctgttctgacgctgtataaccatttgcattgcacttgatcacatagtagaaagaagccaccttgcaaaatttcaccaaaaagtaaattctatctctagaaacaccaggagctcttagtaatttgagcttgctgaggggcaagtatgtataatgtaaatgtatcaatcaggttaatgcaaggagcactcttccatttgataacatttgaaatgcatggcagaaatacagaaacataattaaggcaaatgagtataaaatgttaatattccaatctggaagagaaaaaggtttcaagatttctccaacttttattgaagtctgaaatgagaaattcaaattatttggacaaatgagttgtttcatttcagacaaagggagagttcctaaattcaacatgactgacattttggactggatgcttctttgttgtgtgggcatcctatgcattgtaagatgtttgacagcaattccatcatgctcactagtggccagtaacatgcttctcagtcctgatgcattaaaaaatgtatgcagatattgtcaagtgtcacctgggggagcaaaattgctcctagttaagagccactggactaattgttgaatcaaattattttcaattttatgatgattgatttggacactttatgtattgttatgaaatatgttaacagtactatgtttttcattctatggatatgccaaatattagtttaacgtttttctgttaagaaagacattctaattaaacatatgttctatgccatatacaaagataaatgaaacataattctattactcaaaaagctttaaactttcctcactgtattttccaaatacagtgatctttaaaaaaaaaaaagtattctgagaagtatgtttttaaactatcaccttattactggataaaacaaggtcattaaatatataatcctgataccaattatattgatagtttctttttcaaattatctagaccactatcatctttactattttttacctgagttcattgtgcccacagactattttttttaatgtactcctttctcagagattttttttgtctgcttatagtttaaattaagatcaacaaaaagtttatgtttagtcaaagctcagctagatattttcatggagagagtttgctttggcatgaaatgctgtcgtttactggaaaacctccctgcgtgtgtaatttgacagcattttagactccccagttaatgaggttagcagcagcctctatcctctgggtctagtcaaactgaagctgtctcaatgtagattgtcatagctatgttgattcatttgcttttttggaaaaataaaaaattggacttttcaaatggtaaggaaatattctcctccgggtcctcccacatgtgcagatagtaggtttctgactgcctgctatattctgataaagtatttgtgtttccatggaaggaaatgctaattagtatttccttgtcaattttctagatatttggaatgatatgtttttccaaaagtcacatattttaaatgctagtatcagcttctgtaggaaaacataattatataatgaaatggaatagcatttatgttaacttgatgataattgtaatttcacggggccataagtgctcatagaaatagccaaagaaggcaggaaggattagatcattcttaattctacaatatgtgacttttcaacacatatatttttacttttgctaacttttttcctaatgactttgttttagtttgtttttcaaaaataaatttacaaaattttgcagaagccaatttggctagttaatttaaatgcaagtttgaaagtatgttatgcaacaggtgaaataaaatgctattaaaggctgggtgtggtggctcccacctataatcccattactctgggaggccaaggcaggtggatcacctgaggtcaggagttcgagaccagactggccaaaatggtgaaaccccacttcacttagaaatataaaaatcagccagacgtggtggcatgtgcctgtaatcccagctactcaggaggctgaggcaggagaattgcttgaccctgagaggcggacgttgcagtgagccaaaattgcaccactgcactccaaccagggcaacagagcaagactccatctcaaaataaataaataaataaataaataaataaataaataaatagccattgtagaaatatctcttttaattttatatattcatcaggtttttcttgttttttttttttttttaatgcctaacaaataccttgaaatttcagggggttacaataaaattatttttcttatctgtgagtgggctgggatttttctgattcaggctatgaagggccagctcagatgggcttcacatgtctcttatttggggaccagcggctagatagaacatgcttttctgatagatagtagacgtaccagagacaaggccaaatcctggctactagcattccattgactatagtaagtcatatggccaagcttaaaatcaatggatagaaaaataaactccaacaattctagtgatgggcattgcaacataatatgccaaagggtattgacgtacaattctatgaaagaagaaagtgaaggctgggaactgcttgtaccataaagggctgaattatcaaagcagactagcaactcacaatactaaacagtggcatttagtaatgatgggtaaaaggcacaagtgaaaactaagcagagatacagcagtcttctctagaatattccccatcctgtctggtgcagctaccaaaagtatctttttccacactagaacacattttgctttttaaatgacagctaagcacccagaaagtgtatgacttcttagacacttggctaccacattgaggtagacactacctgacagcttctattctccagtcaagtgctttcgaggaatccgtaaatgccaggttaattcacaaatagggcttacttacactaagcaatctagttagactaagaatagcctcaacctcaaaaacattcttagataagagcacctgtcctgtggctcagctaggtaatacattagaatatttataagaggtctgattaaggtggacattgacccctcccaggaggaaatgaggcagttacagacttgctgttaattcttttattcccaggagctatataattcattctaacaaatatcacttttaaagggatttgagcttaaggttttctcatttacataacctctaaatcttatacatctaaatataaaatatgctgtatctttaacttgggaatataatttgataatatatttttagtggtaagaatttcagttattattttcttttcacattttatatttaccaaaatttcaaaataagatggagaatgaggaagaagaggaagagaagtaatctagcaattataaagttgtcctcatatccatacaaagatatgaagagaatcatatttgcttatctcttatataatgtcttttctggctagatggtaaagatagttgttgatacattcaccaaagagcgtcattagacatgtgttgtgcactagttatactccctgtgataatgtgaatacaacagtaagaaaatatcaaacattttctttgactctgattcctcctgattttttttgtcttaatcttttcattcatactcaagaaagtgaaactagagtttgtcaaagtcacttcagggctaaaaagagagatcatttccattatgtattattaaaataaacctttagatagttttaaagtcaattcaacatttttaaactcttgaaagggaacgaagttgaccttgactctataaaagtattttctgtattcaggaaaggaggcagtttccatgtcagtgccacttactaaaatagtataagaattgtttctgatttaattattctcatttagatcttcactatctttaaaagacaatttaaaattgcatatatctatgaataaaacaagttgcctgaaaatattttatcctaatataaaattatctgttgtgttgaagacattactatttaaagagagcaaacttattttagtgaggtattaattgtagtgagatggctgcattctgtttcaagactcttatctggtaacagtgatgtttgggctttcttacactctctttattttgaaatacaaaactttctcgggcgaaaggagaaattgaataaatagtactatgaaattcaacatatgggaagcatttgcagtttagaattataatgatatcattttaaccttaaataaaagagattgacactaagaggtgtgcatgttttcactcacatctgataattctgtatatgaaggattctgtttcacttaacaatttgatcatctttagcacaatccttaatgggttttgcatagggaattgtgtgcagaagatacatactttataacaatcaagttttacaataaactttaggagtatttactcagggcagcaaatctgcaattaatttctcctaactccttgtgaaccaatctcattttcctcccacttacacagcctatacatggatatactcaaatgtatagagtaaaacataagaaatgatcttggctgatacttaggatgtgactaatggttagctgtcaagtgtaaaaattgtggatgatagtgttgatttttctaataagcattttcatctttgggactaaatattttattttatatagttttgaattttgaaatgaaaaagtaactgtcttttaataactggaatcagagcttacatctttcaaaaattttaatgtttctaagtagacctgtaagcattaatatctcctttttgcagacaaataaactgaattgtacaagtattatttaggaagttatatatccaggctgaatttccgtattgattaaaaaatatttaaattcaagaattgtattttattcaccaaagcctaccgtgtagtttctaaatatattttgtttaaagttaaaggaattatcttttctcaatgtcccacaatatcagaaatttaagtaacataagaaatatatgtatgtgtatatattatatttaataatattccatgtttaacatattacgctgttaatgttacatttacatgttacaatgttaatggtatacactatataacagtaaaacttataacattaatttattaaaatataatatatataataacataatattaagttggtgcaaaagtaattgcagattttgctagttttgcaccaacctaatactatctatttatatatttttcttcttgtattttttccatcactacttacagataataaaatcaagaatgcctttttttgtgtgtaactctctcctatgcattttctttttctgctttgaaatagtaatgtgacctactgcttggagctttggaaataagatctaattttataattttatgaattacaatagaattataattttagaaatgtaaaataaatttataacagcatttactagctccttgccaggacatatactaaattcaagagcttctaccagtgtggattgtttctctctccacatttaccagcttttgtctaggctttttcttccatgttgtttctccttaataggcaagcacaaagtcaggacagagtaggtgacactgcatgggtttcatcaaggtagaaagcatccttgtgaattactaactaaaagattgggtttaaccaaatttccagatctttttgcttgaaccagagattattgtgtttcacatctaaaacttgaaaggaaatgaaattggccttattttccaataattttctactgcatcccaaatagttggtgtcagtcttctacgtatattagcatatgtttaatgacatttcatgttaatgctttagttaagtttgttttcagtctaatcatccttgtcttaaaaatttctataatgaattgattgaagaatgtgcttattccaagtagattgttacttgtttccattatagatttggcgaatcattctgttgttttataaatggaaatgatactcttcaaaacttattcgtcattttaagaagagttactaaataagattgaggctatcgtgtttttgtgtttttcaatacaaagtaaaaacgggggaaatatagggaggaaaatgtgttaaaatttaaaaaatatttttgagatcatactagtaaattttgtttgcattttttacttattggtgagtagagaaaaaaacccaagtgagttctgtaaatcatgagatgatcataacctagttttaaaatttcagaaactgagagattatatttaaaagttatctcatttaaattctgattaaaaaaccagactgtcattgtgtgtcattgacattggtttcatcacagtgtcttagcaagatgtttcagggacatacacaatttgcacaagtttatttactcacagtaagagaaaatttcaagctgatagctttaattattttagctgattcctctgattgcactcatggaaaagccaaaagaagtgactgtttttactttatctctcccagtcataacttatgtgtagctctaaaggcatccccaggttggaaaacaagtttgatctctttctgaaaatgctactaaaagaagatatgcaagagatgtgagataggaacattgtaagaacagttaaaaacctaaaattcagaactaaagcttgggatgcaagaaggaattttcatggaattcattattttcttgaattacagcaccaaacacgggtttgcatgaagcaggtagctggtagtcatttgttgtatcaatagtgattcaaaattttatctacaactgttaacagttcatttttccttatggttctttaagctcctgtttagctgtatcccatctgcccttgctaaatacactagcttacacacagtctttctggattccgttgacttgaaaattcaaatctaaaaacaatggctaacatttactgagtgttcactatgtatcagtcactgctctaagatatactaactcattcagttcccatagtgatacttagtggtgtgtggtgtataatgataccatttccactttagaggtgaggaaaatgaaactcagggaggttaagtaacttccctgaagttacactgctaaaaagcatagaaccagagttaatactcaggcattctagtttcagagcatacacatgtaaccagcacaccggagtttagattatacactgaccaaatgtcattatcaaaatggtatttgttctccctttttataaagatttcatagaaaattaacatgtgatggtactaagatatatagagaaaagtaacacagtaatttcactacatctgttcatctcattactattaaacctttggtcactaaatagaccattatttgatgaggataagagggactataattactattcctggataaagatttgcctggacaaattaatattcaatcagcagttctctctgcctgacacagaaatgactacttttccatgctatttataattcctggtactctatgaaattcctcctcttaaattaatacattggtcctccctcgtttacagggaatacatccgagacttctggtagacgactgaaactatagataatactgtagcctatatgtactatgtacaaatttctttttctttttgtataatttcagaattatgtagaaatatttttatcttataataagataaaatactttttcttatcatagatcttagcaacctaagcatatgattttttttcattccttattaagtcaagaatttgccttttcacttaaaggaagcaccttacagtttgtctttggcatattcaaattgccagcattgctcttgcactttggggccactatgacgtaaaataagagttacttgaatacaagctctacttattttacttaataatggagacagtctgtcttataacccagatggctactatgtggctaatgggtaggtagcatgtacagtgtggatgattcacatcctgggagggaagaagcagcatggtgtgaggtttcattatgctactcagaatggtatgcaatttaaagcttatgaattgcttattcctagaattttctatttagtattttcagaccatggttgactccaggtaactaaaggcatggaaagcaaaattgtaaataagggatgattactgaattatgacaagcctttctctgatgactgcattacaagttgagctatttgcagtgaggttgcccagaaacctagaggtagtacatgttttttgagatggtatttccattaattcttaaattatctcttttgccaagcacccttatcatcttagttaattcaggcagctctaataaaatacctttgattgtgtaatttataaacaaaagaaatgtacctctcacagttctggaggctgagaagtccaacatcaaagtgccagcagatttggtgtcttgtaagggcccatgttctgttatggtggaaggagaaggaagctccatcaggcctctattataaggttacttatcccattgaagttatttcatcaggttataaggctctgccttcatgacttaatcacctcccaaagaccctacatcttaatatcatcaccttgagagagattttattatacgaatttggggggaacacatacattcagaccatagcacttatgattaccctattttagctcaagctaagatcaagaaaaagagattttcctcttcagttagaaaaaaaaactttcaagagccaccttattatttgtttaacaaatatttattaagcagggacactgtgcctgtaaaaaaaaataattaaaaactggtaccctttttaaaggacttaagagttaatgtgcctcttaagcaaagattatccaactagtttaggctaaattagttccaatcatattacagcatgtgtcctctttgaacctaagtaatatttacatatttaattatatgcctttttaaaatatttcacctgtatttgattaatgttgaatagcctagaatcttcaatgcaactgtaagcttctaaagagtgagaagacctggtattaccttttcttttttattcatttgggcatatccttaatagttgattgaatcactggttatagactttaatctcaaagtgattatgatcttcagtaatcaataactccaaataaattcaaatgcattttatgctaagctatactttagaatccttcagtttaaaaaatgtgaataatggtaatgcaaattatagtaaagtataactttgctgttgaaaggactttctgatacatgttttaatttgtgactagcaaaaaccttacgaggcaagcagagtacaatggtcactgtgtacaagtatgtgtaaagtaaagagtgatcatagtactgtatttgcctcatttgtgggggtgaaaggagattaaaaaggctttgaaatgaaattttcagaattatggaaaatatcattatgttattactgcagacagaacatttctttgcaattggaacatctaactctcgttaaaacaatttctatggatatcacttgtgaaaagagttcagggaactatgtcatagtagatgtaatcaattatacaagattactgtgtttcctgtaaagatatagggaagagaatgtcttcatcagaaatgttatttctagagactgcttctttgatatatatccacaagaaacataatttcctactcaaagtagcctttcctatttacaaaaaaaaaaattcagtaatctcgtgttagagctttacctcttttctattctgcggggaggtgtgggggaagagaaggtgttaaatgtgattttatatacatccatgtattatttcattattgcattgctataaagaaatacctgatattgggtaattgatagagaaaagggatttaattggctcatggttctgcaggctatacaggaagcatgatgttggcttctacttggcttctggggatgtctcaggaaacttataatcactgtgtaaggtgaagggggagcaggcacatcacatggccagagcagaaacaagagagagaggagggaggtgctacacactttatgtgaccagatctcccaaaactgactcactatcacaaggacagtatcggggggctggtactaacccattcatgagaagccaccaccatgaaccaatcacctctcacaagacaccacctccaacattcgagattacatttcaacattagttttgggtggggacaacatccaaactatatcaatccatgtaatattaatatataattatatattatatatgtgtgtgtgtataatatatatgtgcgtgtatgtatatatatatgcatgtgtgtatatatatacttagaagaaattggtttcattgtaaatggaaagcatttctctgaaaaatccataaacccttacacagtggggggaaaaatatccaaaataccaggacattatttaaaaggcatattataaatagatttcatcatactgctatcactgtaagcttacaagggtgtactgactctagtagcacccaacccccaacatagaaacagtaaagtaaaaatgtctgataatgaatcctgagtatgtaaagccgctttgaagaaacagaattttctcaggtcaaaaggtaaccaattaagttagaatgtgccaactggaggaaggactggtcagtaattgaagcaaggagaagagaataagagagaaatgtcgttatgttttctcctgagagaggtgcctgaaaaccatcttgtcggtcaatcactgcctttaatgcctgaagaaactgaaacccaaagagaaaaatgacttttgcccaagcacaacactgattcacatctaaactggaactaaaaatcaagattcctcacttacacttaggcctctagattatagagcgagcacatttactcatgccttttctctgaaagcaacagattctaggcaatagtaggaaaaatgggggcttacttggttgttggttgtttcagtttttaattttttcatgctgatgtcaatggttagaaagatttttctgttagcctagtgttttgattttatgtcttcacttagaagaaacattacctttttatatttaagttgcacacaaaaagtattagtgtcaaatatttaaatacagtccttttaaacttgcacaatactacttataaaaacatatcagagaaaggagtccacatgactgagtgaaaagctgtcttttgccacaaattttatactatatttttcaggaattatctcctttcacttcataattgctgctagcaggggccaagctaaccattaaatagtgtttctgacctcatgcactgttccatagctttgtaaagtgcatagacagttttttttccccagaaatagaaatgcttctgctactaagttgaaaggcattattagtgaaattagaatatgataacaaactgcagatggtaaaagattacttcctggcagagaataaatccaaatgcattttatgctaagtgaaatgtgattatcaaaaaattgtaataataatgattgattcatgaatggataactgtgatccagctcctgctgccaactatatgtcttaatcagatcaagatagaatcactgattaaagatagaagaaaaaagagaaaccataatgaattagaatgaatatactatattaccaaggtcatatgagttttgatagttgctataaaataaatagaatagccatttaagttcattttaaaccaaaatacattcttctgccaattttaaaattatctaaaatatatcttattacaagatcattttagtcaaataaaactttaggcacttttgaaatgaatgtttacagaataaacaggcaacagactgtacttgatatatcactactataaaagcttttgtggagtatgctagctatgaatttctagctatgaattaaatgttctaatttattacgttatactcacagtttaagaaatatttactgaactcttctatacgccaagcatatctgagtttttaaaaatgtgtatctttcctctcatagagcttatatattctagtcttattacaaaagaatatcaatattttcaaatagtgtgcatagggaatgccaaacaacacttttcttatgaagggcagattctttccactctcttcctcatactattgttgactccatttagggatcttctttatcagcaggagtggattatttctgtaaaaaaagtaaaatctgagtaacataaaatgagctactagggctaacaggacatgtatagtatatctaacctactttacaccatgtctgccctaatgattagaccacacctttcctgtttactcaattattcattcacgacatgttcattaggtgcctaaaacagaccaatctgtgttctaggtttagggcataaggcattgagcaaaacacataaagctcctgctcttatgtagcttatattttagtgaggaagaaagagtaaaaatagagaaatagatatataaaatacaatcaaatgatgataactattaaggaaaatattaagtaaggtcaggacataaagaataacagggatgctaatgagtggggctgcaggaactgaggatttgcatgaagaaataagatgaaggaatatctaggtgaggagtactccacacagaagaaatagaaggaaaagtgaattcacaaaacagggtaaccaatgagtgagccaaaatagagtgagaaaggctgatggaaacaggagtttgggttatattcatggccaggcagaagcttataaagggcctatgggccatgataagagagttctcatgaagagttatgatttttctttatgtagtgtgtgtgcctgaatgacaaagctgtcaatatataaaatattcataaaagaaaaaaaattatccatggagctattcagaagcagtgcactctttctaatcaaaactactacttgaagtctgtttaaatgtaattaaaaacagtgactgagtttataagcactggaaaacacaatgtcaaaaaaaagcactggaaaacacaatgtcaaatccagaagactgacacataaaggtaattacaatgcaacaagcacttaagtatgttataggaataatcaaggagcaaacttcctcctctgctttgaatgtaaaaagatacaaagcactttttcccacctgcacaatgagaaaaagccaaaaatctattaaactctaatttttttcaagctgtaacttttctcaaagtaaccaaataacccaacatccaaagagggacaagtactttcaaagagagacagaacacaaaacagtctgtccttagagataatctaggagtaagaggttactgtcttccacacaggctaggaagaatcacttgcaatttttatgaactcataaaggctaagtgtgaactactgtatttatttggaatagcagacacaaggggagtttgtacttatttgcaggctattgaagtactcttccagcaagtgctcttgagaaagttggtatcagaaggatatgaaacagagctctcctgagtggaactatggctgcaggggaccaggcatagtactcttgggctttaagcaataggagtttgaactctgcaggcccatttttatgtggattttttcaataaatatattggaaattttcttggaggtttgcaactatttgaaaaaaaaaaagactcacatatgaatggtatagcctagaaatatttttaaacaataagaaatggttaggtaggtcattaattcataaggtaaactggatactagtctattttatgactagatactagtctatcatttaccactataaaatttacacaaatctattatgggaagttaaaatgtatcaaaacttacacacacacttacagaccttacatggcaccatgcccagtctaaagaaatataaacaaatgtctaaatgtggcattaaattataactgcataaaattaactgtagtacatattgtactactgtgataatttcacagccaactccagttgcaactgtggtgaggtcaaatgttgcaagtaacatagtgtgagcagtttgtctctccagtaaattgtatcatgcagtaaaaagtaacctctcacagttcttgcatagttttcaccaagtttagtgcaatactgcaaaccttggataataccatgggacccataaaaagtgcgactagtgatgctggaagtgtttccaagaggcagaaaaaagaagccatgacattacaagaaatgtttaattgcttgatgtgtaccgtggactgagctctgcagctgagtttgactggcatttcagacagacaatttatcttataaacagataatgtaaacttatggtattgaagatatagtacagtactgtaaatgcatgttcccttgtgattgtcataataatattttcttttctctagtttactgtattataagatacagtatatattagtgtatgaaatatgtgttaataatctgttcacattattagtaggacttccaggcaacagtaggctattgatcgttaagttttggggtagtcaaaaattataggtggattttttactgtgggggttgacacttctaaactctgcattgttcaagggttgactatgtttttcccatctattcaccctttatccctagaaagtaaaagccttaagatcttggggaagggggaaaaatcctcttatctatggggtacatgcaaagacctattgctactggtaaagactcctgggagctggtcaggaaactgtcttggttccaggatctttcacagatataagccaaggttggcacattctgggaggcaggaaactctccagagaccaatcacaaatgaaaggtggtgtttcaaagatgaggggcagtaacagtgacaacacccttaggcccaagttgcacatgacctgtgtgaaacggaggctggaccaggtccgcgataaccttgtgcaaagtaacacacaacagatgtctaccacaggggaaggacccaagactcacagaggacagaggcacctccacttggtgcagctgtgaagggacaactaaaacctgagggagaaaaagaaacactgaggaaaaatctctggcaacacaggccctattctaaatactacaaagtaatagcagcctgctgctagaggaatccaaagcctgtggtgcactggacatagtgagggcaacaacaagacacatatccatatcaattcctgactagattgctacagccatacaccaacagcctggtaggaggagagtctgtatcaatatattctatttacctcagtctgcagtctcttacagcaatatgtctaaaattataagaaacattagaaaaaacaatccattgtcaagatgtaaagcaacaaaaatagattgagctatatcctagatgttagaattatcacagtgactataaaagtaactagggttaatatgttagcaggaaaggtgaatataacatacatgaataataggggaaattcagcagaaagaaggtaaactaaagcagtacatagagggaaatttataggactaaatgtctattttagaaaagaagaatggtctaaaattgacaatcacagcttctacctcagaaaaagaaaatcaaactaaactgaaattaagcaaaataaaggaaattgtgaagatcagagccgaaatcaatgagatagagaacagaagcaacaaagaaaaatcaatgaaaccaaaagctgtttctttgagaaaattaataaaagtgataaacctttagccagactggttgggatcaaagaagataccatataaattatcagtatcgtataaagagagctgacatcacttcaaatttcaggggaatattacaaacacctttatttcagtaaatttgacaacttagatgaagaaggcaaattccttgaaatataaacgttaccaaagctcacctgaagaaacagataacctgaatatgcctgtatatgtttttaagactgattttataaactctctcactactgaaactccgggcccagaaagtttcactggtgagttctaccagacttttcaggaaaaatgacattaattatacacaaactcttccagaaaattcaaaatgtgtgactatattctaacccatttactgaagccagcattatccttgcaaggataatttaacattcagaaatcaatcaatgcaattgcccatattagcagactaaaaaagaaaaaccatatggttatctcaatagatgcagaaaaaacttccaataaaatctaacatccattcctgataactctgaacagctctattcctgagcaaactctgttctcagcaataaaaggagactttctcaaactcataaagagcatagtccaaaaaccttcaggttatattattttcaattgtgaaaaactgaatatttttccctaaaaatcaggaaaaggggaagggtggctgctattactacatctattcaaaattggactggtggtaccagctggtgcaataaggcatggaaaagaaataaaaggcatacagattggaaagaaagaagtaaaattgcctttatttgcagatgacatgattctctctgtagaaaatcctacagaaaaggaaactagaagaagtgagtttaagaaagtttcatgatatgagattaatacacaaaatcttatgtatttccatattttctggcaatgaaatttggaaattaaaataaaagtaccacttaaaatagaatataaaagtataaaatacttaagaataaattgacaaaggtgcaagacatgtacactgaatactacaaaatattgcttaaataaattatttgaaaagctaaataaatgaagttatgtataatgcttatgaattggaatactcagtaagtattgggatgtcgaagttacctctcttttttttttttttttttttttttttttttttttttttgagatggagtctcgctctgtcacccaggctgaagtgcagtggcgcgatctcggctcactgcaagctccgcctcctgggttcacgccattctcctgcctcagcctcccaagtagctgggactacaggcacccgccaccacgccagctaattttttgtatttttagtagagacgggtttcaccgtgttagccaggatggtctcgatctgacctagtgatcagcctgcctcagcctcccaaagtgctgggattacaggcgtgagcaactatctctttttataagcacatagactgctgaagaaataaggtaattaaaatagcatggcggtgggagagtgtgtggaatggcaggaagatacaatagcaaggaataggaactagagatgagcatgaaaatgtaaatcagtgtcaggtcataaagaattctgcatgccatgctaagagtttgattttcacttgcagaagttgtatgatgacattggaagttttatgtttttaaatttttattttaaattggttttagattttcagaaaaatgcgacaatggtaaaaagaattctcttatattctttacacttttcctaatgttaacatcttatataatgaaagtgaaattatcaagaatagtcattggatattgatgcagtattactaactgagccgcagaccttcttcaaaattcaccaacctcttttttttttttttttttttttttaatgacagagtctctctctgtcacccaggctggagtgcaatggcgcaatctcggttcactgcaacctcagcctcccgggttcaagcaattctcctgcctcaacctcccaagtagctgggattacaggcaggagctaccattcccggctaatttttgtatttttagtagagacggggtatcaccatgttggtcaggctggtctcgaactcctgacctcaagtgatccacctgcttcggcccaacctctttattaatgacttttctatctgtttcaggatttttgcctaagatcccatatttcattaaattgtcattcctgcttagtctcttctagtatgtagcagtccctcagtcttttattgatgacctttaaaacatgggaatgacataatgcgattcaaaaatagatatgattgcttacagtatagatgattggagaaagtgctgtaaaatcaagccagcttaaagacagttttggtaattgagtgtgtggtgatatcatttgaattaaagaactggcagtagatatttcaaaaaagaatagttttgagaaacattaggagtaaaattaacattatgtgataaccaagttgagatggaggagcatgggaaacaaaagtgaagaaataatcgaagatgacttctgagattgggttgtgatattctaggtagatagcagtaactgagaaagcaatgtaaaatattattttgtcattctctatctttctcttacacaaacataaacacactgttccccacatctttctcaagatattattcttacttttatgggatataattttctggactatattaaatattctgtcattcatccagaaataatcagtttcaaatccaagaagttttataaggaacaataattttaataaatagaatttctataaaatgattaaaaagttttaaagacagacatataatatgatctgattatcattcttgccacaattatgtttaatcctcactctttgcttgttatgtttatgattatgtaggtgaagattaaattttacctataatgaccaaatatgacattctgcactcaccgagtttcctaaagtgcaattgctatatcttctatcagctgccaatcagttattaagtataggacagataaggtgttgttttagataaactgataattttataaatttgcaggctattgggaaaaggcctttctaaacacagtgttaagcaaaacagtcttaaaagactgacaatttcattgtatataattttaaaatttctgaaaagctacataactcataaataaatttaaaatacaagactaaaggcagttaaataaatgtggataaatagtggtgctaaggcatgtaaaggtctccttcatattaataacaaaaagacaaactccatcataggtcatatttcttgcctctcccgccattctaaccttgcaccactctctaccatgctctttgcactccagccacttggctcctctttctgcctttctggtatttcattgtctctgtgtcacaggatctttgcacattctatttcttcttttggaaacattttctttactctttttcgtcaaggtaacctccatccacttaattagttcctacttacccttcaaattgcagctctatagtcacttctgtagcaaaggcttccccaatctctagttgaggaaaaatgtttttgggctatcatagaataacgttctcttttggcctggaacctactcagtatgtcattaaacattcatatgaatatcttctgtctcacccattatactcttgcctattttgggccattttgcaccctgagtacctggtacttgcctgatatagaaatacattttatatatataatatacaggtatatatatgcacatatatatgtgttctttgaagaattgttactaaaataaaaagataaaaagataggagattgatctgaatttccttaaatcgggagctatgaaatctatcattgaaaaattataaagtaaatatgctaaatataattatattagtaaatatctgtatatttagtaaatatactaaatataattatatttatatactgtatatactaaatataattatatttatatactgtatatactaaatataattatattatatttatatactgtatatactaaatataattatatttatgtactatatatactaaatataattatatttagtatatttactaatttttgtaattatatcatataattgtattttgtatatttactaatttttgtcttgtattttaaattttatatataaattttataaaacttatgaaaatatataaattatatataaatatacatagtaaatatcaaaaaatatgtgttccagccttgtctctactacttaatagcaatgtaaacataagcctcaatttagttttgaaaaggggaataggaaaatattcaatttagccatgctgatcaaatgataaaatgtatgtgaaaccattttttaaactccaaacaaaataaaaataaagtaatatttcatcattatcatttttattacatcaatgatggtagaatcactttaggtctgattaaaagtgtactcaatactttctaggttcttctcagtaccattttgcagccttgttgaaattttcctttataaacacatggagctgaaattatttggagctaaaactatagagaatcaatgttttaataccaaactaaaaattttttaaaagagaatactattagggattcttcttctttcttttctttttttcttttttatatctaggaggctgaatttttctgaattttgtaataagggagagttaaaaaccctcctaatttttcatatgggcctttctgtttaaaaacaatgatttattttgtagttcttcatggcccagacattctaatctaagtcaggtttgaaccccaactctgccatttactagtgttacagattcactagtggtatgatggacaatgcatttaatgtcactgagtcagaattttcttacttgaaagttggaataataatagcttttctgcacacggttgttatgagatataaattgaaaaataaggtgacttataatatgtgccaggttaaatgtttaattcttctcaggtttggatcactaattataattaaaggttcacgttggctttagatgagtgaaaaaatagttgactgaaaattactcaactgagttcatttgatggctggtgatcaaccatttaagcacttctattttgtaagaaggaataaaatcttaacaatttttaattaaaatattttttctgtattttcacttcctaagtagataattatgattaacttggaccttgtaacactatttacatattaaggcaagctttatttggaagaatttgttccagatgattttatttctggcaaactacattgatgaggtcccaaatatagaccatcttctaaatgtcacatctcagatggttgctaaaaatcatatttgcaaagaattctaaatgtctgggtaagctgaaattgttttgtgttactgtattcctagaagtataaaagcaaatgtctggagctttttggtggaatattaaaaaagcaatcataaatagtatatttgtgatttgttaataaacagaaaaaaagtaattagattatatttagtcatcatagaaagaatacacaagtagtgaagttccactgcccagttatggtcattgttgagtatgactgaagattattgaaaaaataataaaaagtcaacaaatattagatgttctgcaacaattacttgaaagagcattgaagttacaatccgccaggctactgtttctcagaaagggttacacatcagaactattcaggtaacatttcataatgcaaatacatgactaccacactggactgaataaactagaaactctaggagtagacttagtcatctctctctctatttttaatctccacttttgattgtgatgcagggcagattttggaaagactatggtggacaaactgggagcactttgaggatagaacctgtcatatacattctctgatctccagggaagttccttggacgtggttgaaagttgattatttatattgatgaataagtatgtcttaatcccttctgtgctgctataacagaatacttgagactgggtaatttataataaacagaaacttattttctcacagtttaagaggctgggaagtcaagatcaatacactggcgtctggagaaggtcttcttgcttgctgtgtcatcctatggaggaagggcaaagagagggcaagagaaagccaaggggaggccaaacctgtcttttgataaggagcccactcttgctataatagcattaattcattcagaaaggtagtgcccccatgacccaaacacatcacattaggttccacctcccaacaccaacacattggggatcgagttttcaatatttcaactttgggggacacattccaaccacagcagtgtatgatgtaatgtgctaaagtcctgatgtgtcttaaaatcaccggaggaagttatatcgggacaaattggtaaatataaataagtcagaaaaaaaagatcacaaagaagatatatgttcaaaaaggatgatgctaccaaaaaatatttcactgagttctcattttcagtaagaggtaataaattttttaactctttatgcattttatttttaatcttgttttacttagtaagaaaacaaagactcaaaatatttagcttaagaaatgaaaatgttagtgtacatgaatatatcttagcttaaatggatacatttatagagcagaattaaattccataactgcagagtgaccacaaagggcaaaagtgttgcaattgctattaaaaataataaaaataatagttgtgcttttggcagttagtgcaggctccaaacatctttggtagtgacagaatctcaaacaactggagtcataaaaccagcaagcttttcaatatgatctgtatgtatagatgtttacgtatatgtgcatatatagtataaataaatcacaaggcttgaaataataataaagaactatgccattgagatgtcataggtttagattattttaatttaaaatagttgataaatacacgttctgatctttcaaattcagttctcatactatatcaaatgaactgactatgcattctatgaaactgcaactcataataatagtctcttaattgtcaagacatgaaattcttgcaaaaggtagtctgcgttgctaagctttgcttctgttcttactgcagccttttatttcctgaaatctcccttcagctgccatgagttatagcctatttttatactaaccttcatctagggccctgtagatccaaagcaaatcaatttctatctgccatgcttcaaccgacattttgttttggtaaaatagggccaaatgggcatcaaatacagccttgaaggggaaatggcaggttgctgtggaggcccgttcttatatgtgcacaactgcggctttgttttgagtcatccagtcccaattcattttacttgtgtgagctcttcctttcctcttcagtgggactacctcctttcaacaaacttgacaataaaacaatctcaaattgagctttcccctatttagagctttatctttacttcgctatgcaaaattttaaggatacaactacaagactccattgtttgcttgttgtggtgaaaaggatgattggttagagagctgggtcatctattttgttttttaagtgggtgcatttgtgatttcttgacaataaaggattgggccctctcagagggatgcgcatttataacttgcaggccaccactctcccactctctatgagaaacctgacaaaatgattttggtactttttcttattgagtctcaaactctcaaaatagtgttccaggatgccaatttaccaacaagtcatcaaaagcacagcaggtaaagccaatttcccatccttggactgcacgatctctaaattatcttttaggcctgacattatatgctttctggctgcaatttttgattattccgattttgattttgtaggaaaatttcagttattcttgctaatatgaatagcacgataggcaataccaaacagtaatccaaaaacaaagtttttgtatacaaaattaactggttttagtatctgcttagttcgtgtttaataggaagtaacagtgggttggaagaaacaagattttatgctaaagcaaatgtatctactaagcaagattaatatatgacttttcattttggaatatatccttctaaatctgaagactaaaacagacaattttcctgtcatgttacatgtgacagaatataatattgaaagtaaatttttccccaaatttcaatgtttataactgtataaattttgtggtagaagtatgtaaaatattatatttacttaatttcctgtaattagtgtaatctaaagattgactccaactgtgtaccccttaaggcactttcttattttgattttaaatgctacaaaccaaaatctcttctaaaaagtgacttactacttactatttgcttatataaatcattaatggtcatatataccaaaataatgaaataaaaatttgactactctttttgcattaattcattgaaattataagtatacacttatattattttctatgaaaattgaattcatgaacatgactagaacatatgatttttgctaaaattagacctcacaatgttatggtctaagaagcatccatccaggccaggcacggtggctcacacctgtaatctcatcactttggaggccgaggcaggtggatcacaacatcaggagttccagaccagcctgaccaacatggtgaaactccgtctctactaaaaacacacaaaaaaatcagctgggcttggtggcacaggcctgtaatcccacctactcaggaggctgaggcaggagaatcacttgaacccaggatgcggaagttgctgtgagccaagatcacaccactgcactccagtctgggcaacagagggagactccatctcaaaaaaaaaaaaaaaaaaaaaaatacatccttgatgctttcacatttattggaaatcagtataatctctttcatgaggcaatgcttgaaaaatatgtctcaaataattattcattattttgcatgtattggttggcttagcattaataaattaataataataaatttatttgatgatgatatgcttatcattagtacagcacttttaagcttgcactttaaatcagccttcattaactggccagttaattatatacaagaacttaccattaagttttcctttaagtttttaaagaactatgtaaaacaatttataataaattttgaatcttaagaatgttatacctagaatgcctaaaatctaaaataaggctgaaccagttataaaatgaaaataattttttcattgatttcttcactgatttttgaacttatttttaattttttatcttcaaagtttgccattatgaaacattacctcttcactcttttttctgtgtatacaatttctttacatttacttataatttatatttgatctagttttaagtacattttgaggtatgcacatagaagagttaaagtgaaataaaaatagattgtaaccatataataggaattataaattgttgatctaggaaccagaatgagacactggctacaatgtagtatttgaaattatttgatttgaccataagctttcttactgtcaaggaaaataacaaaaacatttttgtttctccagtttatggaaaggggcaatgtcatcaagtttttagatatcagaatcattctgttttcagtggccagaaatgcttttctccaaaccttcatctttctgtttattcaccggtttacatattatctactttttgaaaccttgtattatgccttcagtagggaattatcttttctctgaattataaattgataattacaaaagtttatctaccactaattgaatatctatcatgtgagaggcaaataacagacactgttttctctaatccttgcaataatcctgcgagattcatgctattttaccctctttacagatgatgaaaccgagccaagagaagccaagtgatttgcacaaggtcgcatagataataagagcagaattcttggaataccaatagtgctttgtaatttgaggatctcctcatatcgaatgttcctttctaaaacattttcatagctatataaaaaatctgtaagctttatccatccagtgcttctcaaaaagggaaaactatgtgaaacccactgacattttgaatattactgtgctttcttgcagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacggtaagtgtttataatttgtttaggttttgtaagctgatatttgcatgagaagcaaattcattaaatcttaaaagtttcaagggtcttactcattgttatttgtggttttcttgtcttgtcatatttttcttataaacatagcaacaactgaaaattgtgttaatgtatttaagtccaacattttggtataaagtcaactttaaatataaatacctgtacctacttaatgcttagtttacaaatgtttctagagagaatctgattccaatacatcttgatttttcaactaatgggaatttagtcataaaaacaacaccgtctttcttccctttcaaaaaaatgtatacctctctataatgcagaagatcatattggataaccctagaacactgaaaatttacctctttctattatttggctaaatgaaatctgaaaaatcttgcttacacccttgtgtagactttaatacctactcagtacttaactccttggagtcactaaaattatatcaccatacagttcatattatatgttgtctacagtaggaagtctcacaaaagtactaagtagtaaaaaaaaaattctttaatcttccaaggtaaaacacaaagcattgtccctaaatttatcataatttgagaataaaatgctttgtctcagtatatttactggtacttcattaacaactaaacaaaataatatttttgtttacatttattttttctgaatttatctaccttttttctaactgaccgatccccaatatcttaatctatagattccctcttatttgtggcagaaataaaatagagatgagtatgatcaaatgaggggaaatgaacagatcttgataaagaatgcctattttgaaacatgtgttttcttagaggttatgtcttgagaaggagtcttggaaaaatttcctgttcagtaggaatgggttcagtttttacagttttctgaaaagaaagtcagagaggatttcactctctgtagcataacttatttttctttgcaaataagtaaataaacatcttaaaaaatgctttcttgtcctaagctacccagcaatgtgaacgatattggagaacagttacacaagagtcgtccagaaagtgccatcaatagaattgagaacaaacaagttggcagaaatctaggaatcaacaaataagaaagagctcctgtggactctcagggagggagagcaagtggcagttacatttagccctaaatattcaatggttgcatggggttttggcagccagagtcttattaaacttggtgggtaggcttcagccaaagtctgtggcactctctggaaacacactcctttgtctccaagacggaaatccttatttttgttgcttaattcacgttattaaggggtcacagaacaaagtctaagagactgaaatgaataaaataaacaaaaaggatattaaaaataattggctcatcagttaaagtaaggattgaactcaacacaagcctgaaattccctgataggattatttagtgaacataataaactctttggaatcaacatgctgaataagactgttgattttcttacagtcagattatttgtggcctttataacttaaatggtattttctttttttacttaaatgatattcttatgacctctgatcaaacatatattgaaataataaatttaaaaacagtaactttatttaagcggggagaacaattttcagttagtactatgaaagtgatttatttatttatttatttatttatttattttttgagatggagtcttcctctgttgcccaggctggagtgcagtgtcacaatctcggctcactgcaacctccacctcctgggttcaagagagtcttctgcctcagcctcccaagtagctgggactacaggcacgtgccaacacgcctagctattgttttttttttgtatttttagtagagatggggtttcaacgtgttagccaggatggtctcgatctcctgacatcgtgatccacccacctcggcctcccaaagtgctgggatttagaacagaaaaggaacttttgattaaggcattttctcaacattaaaacaagaatattactctttcattataaatgaccatgaagaaagaaaattccttgttagtttgtttccaagtcctacatatattatagtcaggtaatttgtataaaagaagacatttttattacgggtgagataactatattttgaaaatatatactaaataaatatatagtcacagaatcatttatgcatatttgaaatttcttattcttttctcctgagtttttatttgagtaaataagatggaataattatgtaatatatgactgggtcatttgttagatctgaggtttgctttaggaattttatttttgggataaacttgctttttcacttatttagcttaataatttatgaaaaatatttctgcttctatcactaacattatctccagtaatgcccttgtttaatgaaagaaaatttccctttaatacttacaattaatcttgcaagtaaagcattggactagagtccaaaataaacatcaagctatccaaataccttgtactttgaagagggctacttgtatttacttatccattcatcagtgtcatcattttaagttcaaacattggaattgtatgtgacttttatcttggttatgaagaattgctttcattaagaaatggattaactatggatggaatctatggatggaattaggcagcttcctggggccaaatgttattgaaaatgtattttgtatagaaaaaaatatatactttttaaaaagatttagacttctatatcaagttaattagagaaacctccttttcaaaagcagttaattataattaagggcaaaatataaatgtctactttaaattccttaacaaagaaaactgatatctttgcttctaagtcaacagatgaaaagatgaaaaaaatgtggaaactttatttgaatggattgattcaagacacattttaaaatgcttgaaaataggttaggaagtgttcagcttttaaaaatatgtccttctggaaatattcattgctcacttgctcagtgcaatgcaaactatgagataaaaagtattacaaaacatagtcttagtctttaataagcttacagttaacaacagatgtgtctttcttaatagagaaaatagtggattaagtgttatgaatgatgtaaactcagttctactggtgtgtaaagaagtatttaattttggcaccagtgattgaagaaggctttatggaatgacttcactcttgattatggaagttaatagtatttcaagaggcaaaaatatgtgagaaacagcccccctaccaatagacagtgtgatcaaatattgcagcaattaagatattaaaaataatatctctgagcattttaatttgtcagacactagaatgagatatcatgtcatttgatcttctcagtagctctgtgaagtaagaactttactgtcacaattttacaaatagggagacaggaacaagtgataggtaacttgttcacaaaaaacataactaggaagtatcagatcagagatttaacgtctgacagagcctatgatcttaatcatttatcagtataaaggggttgcaataaactatcacccaagaatgtaataataagggctaatctaatagagaacatttactatatccagcctctgttctaagtgttttacatgtattatctcgtttactcctcataatagccctttgtagtagttattattttattattattatttttacaaatgaaaaagctgaagtagtgggaggtcaggtaacttccagtaagtggagaagccccaattcaaatatgaatgatctcttcctgtccttgctttcagccatgaaggtattttaacattatagatataagaataagattaatttccaacagattgtgaaataaaaagtaagtgtataaattacatagaatcattttcagtaaagtgacttcaagccctcagaattccaacatactaatgccaagggaaaatactatatgtcaattaggaaggtttacttattattgaaagcatggaaatgagaaagtcattgggacaaaacaggctgacctatctgtaacagaaatagctgccttctccttgtgggcaaaagtagaaatattgcaacctcaaataaatcatttttttgtcggattaatgcttctggcccagtaaaggtttatgcagaaatttgagaaagccacctggctttttaaggtaaactctgatggctctcaaactttgtttacctgcctggctcaataactgttcttttttctttgcaaatagaataccaaatttgagagtgcaatattcctggctgaaaatctgtagtcccgggatatcttacagctaacttttgtgatgtaatgctgtcagaaattgtaaaaggttgggaattttatcctatttgcaagctagcaagttagcctgcatcactttcatggatgctggtggaaaatactaggcttttagattgtatagagagactttattactcatggtacagcaagcagcatgaccctcatagtaatgtctgtttctgttgccctcaagttccacaaaacaatgtggagcagttcaagtgaataccctatgtgtaatgggcttgtatggcagctgagaaaccctgagcttggggaatccatgtgtcttgttccctaataagaattcctgttttcaaaatgtgtagtaacacaggagacctatggagaattgtctcccaataatgtaatagtcacattctttctacaacgttgttggctaatagtaaatttcccccgtgagattgccactcctctagttaatctgaatggtggggattgcgatcaaatccattcagtttttctcatctgtatttatttaaagagactataaacaggactttaatgagcaggattgatctcaaccatgcccaccagggtcctggacccagtcagctgaacaaatactatgaaccactgaagtttactttaaaaagccaggcggctctctccttaagtttctgcataaacctttccacttggcgagaagcattaatttagatacaaaaggatttatttgtggttacaaagattccaccattgcccataggcaaaacctatcacctataaataccctggccagtgagttgaagctgacctgaatgaattccagagctgaagtggtgccattgattgcttcagtgaaattcagggaaaaaatttataatggatgaatcccatagtaggataaactgcccacaggattcacagatattgctccatgtagctcccataaataaataaaggtagcctcactttggagagatctcattagtgtactatattatcttctgctgatctttacttaaacagttgaaaatttcttatggctaccctaatgttcaaatcatgtgtcttcagaagggtggtaatcttcatacaaaagttatagtactggaagtgggcctggtttgcctgagttggtggagggaagggttaggcccaatttcaggaacccgctgggtggaagacaaacaaatattacctcctatgtgacctcctcgccctctggtaacgccaggtgttctcaattactagaataattcagtccagttcttgtttaagagagactttgtgagagtagttgattaggtccgtcctcattgtctactccaggggtcagcaaactactgttgggcttgaaatctctttttgtaaataaaattccattggaactcagccatgttcatttatttgccttttgtttggctgcttttaagctacagtagcagagtcctgcacttgtaacaaaagcaatataacctaaataaccctgacatattattatctagccctttaaggattgtttaccaatccttgttttatgccatcagtttagtggctttattaccacccgatgtaatgagtgagaatagtggcagagaaggtatttagaggtattgacaagcattctgcataggagtggcagatgcatcctgtgctattttcagtagacttatttctaagaataaaagaatggcgatcaagtcgtgaatagagccatctggtaagaaaaggcaagtccaacagtcagtgaagtttaagacacttatcctagtttggatgttctgtaccagagagttttctttcatggagaatactccagaagtcattttgaaagacaaatatcattaacatctgtcctttccccataattgtaggggtctgtgaatgttcccttcttatttggtgctctccctctacctccagcaaattggtgtatttcatcctaataactgtgatgtcatcttttttctcaattatttcctgtttgcacatagactttttataaaaaatggtgcaagagctacaaggacatttttataaaacttacagagactgattgtgtcccccactttggcctgcatgaacaagctgtgtcctcacaaagtgctcattatccttatgatccagaatcatatcaataaaacaagaaactccaggagactgaaacataattgagtccaaatcccataagctccgtttaggcaaggctgccacacaggctgctctggggaaaaagaaagaagtgttttgcccagaaaaggtcagaatgaaattttgaaattaaaagtaggtgtaggtaatcccacacgactttcatgttgatcattgcacagaaatcacccaagatgatattatttctttcttggaacatattcataaagtgaacaagcagcctcactaaggtatatgagccaggaaaaggtgaagaagataaagctggacatcttttgaagtcaacatttgaggagattgtttcaacactcaacaacactggaagtctgttgatggtagagagcgaggaagatacgctgagttccttgactaccaggccattgttgagcatcttttgcatacatttgtcaggctgaaaatggtccagtgagctgaaaacatgacgcagattaattttaagagcttctaaagtagtgtctacatcagctgatcagactggaacaataataacacgacctaaaaaagtatctacaacactttcaggcagtcctaagaagtgatcagaggccaaaatagtcaatgtgcttgcagtgggagtggacaaccctctttggctttccctactaggatacaaggggtcaactttcagcaggaatcacaagtattgcatacagtgcaggccctggtaacagaagttatttgctttgtgtcccatctgtgaatggtagacacggtaaatggtagatcatgtcaggcagcaatggtggcaatctgtgtgtctgtctcaataatcagcttgagtccagttgatctgatcagttaatggactttcactatgggtttctccatgagtaaccctgatgtaatcttgatatacttccacaattcacagctccaaagagtggtatctttaatgttactactctgtagttctctaagtggcataccaaaccactaagctgttgacaacagatcagcagtcataatgtgtatatatacatatatacatacacacacaaacacacacacacacatatatatgtgtaccatggaggagagtattgtacagagctatgagaacaggcttcagttctgcccacttagcagagtaagcatgtccattttcagtactgcatagcaggtgctgagcttgaatgacctaagcaaactacaacgaacactttcagatttcaggtcagcaaagtcatcaccatttgtttatggaacttctgcatctcacggccctttagagtcagcacttagcttcaggaggtaaagtcttctaaaggaagaatttgattttgatgtgcatgcttgttggcccctgcacatattactagttgctgaattcgaagtgaccctcctcaagataggaatgtcaggtcattcatagatcaggctttcggtttcagttaagagtccattagaaagctaatagctgcttttcaaaatggatgtacctggtagccatatttggggagcaccaagtccataatcccaaagtgagtctctaggaggggcttcttctcttcagcagaggtcccaactggcatagtcattagtcagagtcagaaatgcccagagtccaacatagcgatagggatctctttctggggagagaagaagcatgtctctatgtgacattattcccaataaggaaaatctccttgaatatttgtgaagtaggaaattagaagcatataacacatgaattccaattatatactcaatgtaggaagcaacaacagtatattaagttggtataaaggaacccagctacatgtcacgtgcctttccctctcccactgaaacccccaccaaatagttgaatctgagcattttcccctcttcccccagggctggataggtgctatatccgacaaagccatagaagtctgagtccctcccttccccaagatttctcagaatattgatacgtgcctagggtgtttagtctctcttatggcaagaatccttcttttaaggcagctaatgccagggaaaaggggaaaggaggggaagggattgtggatccagagacctattgtacagcaataagcaaggcactttctgtttcaagtagctactatcaagttcaaccaagcaaatctggttttggtctactccaagctctatatcttcatgggtaacaccatttatttcagctcagactgattctttcactttttatttttttaactttgatagttgaaggaatatctctgtatgaatattatagaaaaaaggccttccaatatttccaagcgttgaagaatgattgtgtttgtgttaaaaccttgagtggcacttgcttcaggaaaaaaagggtgtttatttgctttctattaaggttctttaaaaattggttggaataaatgctagttgaatttatacttcatgacttgaaaagcaagctgattttcattctgccttctcaaggagtgcagtatgtttaaaatactacttttgcctgctttttgatttgctatgaaaaagataaatattttaaggacacctggaaaattttgaaatacattttatatgcatatggagattaaagctaagagactaaaaaaaagtcattctttattttggttaattttgttttgttttgtttactatggcactcagtccagtattctctctgcatagttataatgcagccttgctaatgtaaccagaataactcttcattgataatgagaaattaacagctgaaaaaaatcaataccataaataggtaatataattttaatgaaaggcgacaatctgaaggctggatattgaattagtatctggagagtgtgtgcatagatgattgggggaaggaatcctaaacatcagtcttcctcacagttacatttacatgcatgagaaacaggactcctacttacactaagattaaacctaattagtatctatgtagaaaagagtgaagatgggaaaacaaagataaatgtgaagagaaaatgactgataattagccaaaattgaattaaagacatcaattcactgagccccaagcataagtaactacaaataaataaataagcaaattaattaattaattaatcaagttgatgttggtatttgaaaaaagaaaagcttaaatagcaagaaattaaacttctacctttagaatataacaaaataagactatattaaacacaaagtgtaagaaaataaaaataaatggaaataaaacagaaaacaaaatgagaaagttaacaaagtctaaaattattaatttttaggaaatattttgataaaacactagcaagaccatttttaatttttttttaagattatacttcaagttctgggacacatgtgcagaatgtgcaggtttgttacataggtatacatgtatcatggtggtttgttgcgcccatcgacccatcatctacattaggtatttctcctaatgctatccctcccctagccctccacgccctgacaggccccggtttatgatgttcccctccttgtgtccatgtattctcattgttcaactccagcaagaccatttttaaaaaatacacacagaaaacaaaatttgccagtatcagaaattaaaaagaatacatatcctccacacacaaaaaatattctactggaaattctaacactgaaataaagcaaagaataaaacacaaagaatttgaaaaggaagaagcaaatatgtctttatttctcaatacataataatgcacatagaaaatcctatgaaatctaaaacttataatttaattagtaagcttatagcctatattcgcaagtaattgtatttctttctaatagcaataaaaaattaaacctgaaataaaacataatatcaaatacccagaaataaatctgcaaaattttgcaagacatttacgctaaaaattatgaaacattgaccaagagtatttaaagaagaactaaataatggagagatatatgttcatgattttcaaattttagtcttaagatatccatttttcataaattgatttatagatttaataatcaaaaatcttaaatttttaaattgtttttagagccttttgaagaaattgataagctgatcctaacattgtgtaaagatcttatatagccgcaacaattgaaagagcaaagaaaaagattggatgaaatattttacctgacttcaaggcttttttgatattggcataaggattgacaaatagattcatgggacataattaggagtccagaaatcaacccacaggcatagagtggggttgattgttaaccaacatgccaatcaattcagtggtgaaatgtttaagcaacattgctgaaccaattgggtccctgtatggaatcaaaacaaaaataaattttactctcatctctcactacacacaaaaattaattcaagatttatcacatactaaaactaaaaccttagaattagaactcttttagaggaaaacataagacattatcttcataacttcaggatatataaagatttcttaggtaccaaaaagaacattttggactttctcaaaattaaaacgttctgctcattaacatacaacattaagaaatagacaaactatgaactgtgcaataaattctaaaacatagatccgaaaaacgtataaatatgtgaaatatgtaaagtgttcaaagaatacacatatttaaaaactcttaaaaagcaccagtatgaaaccaaaaacaattttaaatgggtgaaagccttgtccagaccattcacataagaagatatataaatggcaaataaactgtgcaactttattagtccacagaaaaatgcaaatttaaattacaaggagatgccaatctgcatccactagattggctgaaggcaaagactgacaatccaattgcacctctgatactttgctggttggaatgtaaaacatacagccacttaggagagctgtttggcaattttttaccaagttaaatatctacttaccttgtatacctcacctatttcactccagaaaaatgagaatgtatagccacacgaattcttgtacaagaatattcatagcagcattattcctcatatccaaaactggaagcaactctaatgcccatcattttgagaatggttaaattaattttcatacagtagaatactattgagcaaaataagtaatgaactattgaaatatgaagaaacactgagttaagtgagaaaagactcacatttataaatgagtaatactgtatgattccatatattttaagtccagtaaatacaaaactaagctatcgtggtcaaaatcagacagtggtcacatctatgtgtctggggtagattgtctggaaagcgacacaaaataacttttagtggtaatggaaatatccattatcttgttttgagtgatagtaacagtggaatacaataaacaatctgttaagcatttaagatctgtttattatatgtaaattaaacttcaataaaaaattacaatatagaacaacccatcaaatatttgaagacaaaaaaggtaaaggaaaggaaaaaggaaaaaaaaacaatttacagaaatatcataattttaaactaaacacataattgaatcatgatgatttagagattactgagtcataaaaaaaaggtgagaatttaatttggtggccactgggaacccaaatttgaaagtatattagaatctctagaagagctttttagtaattggaatgcctgggcctcattccaaaaccattcaatcaaaattttgcagggtgcatagcaacatatatatatatttaaaactccacaggtgcttctgataagccagctttgttccttgatgaggcatctggaaacagcaaatttcaacaggtctcttcttccacatctttgattgacagttctgtttcccctgccagaaagactccaagcgatgcagaattcgttactttttgatgcagcttttttcatttttagacattggacatttctagttgtcaaaaagtacatatgaaactgaaaacacacacattgatcaaaatgagccattttctggaataatattaaataagtagtctgttttgcttatagtcgtttatcaataagtaaataaaatgatacctctctaaacttaccctagatgtctactgcataagcaccacaagcagtttaccatttttgaatttgatgttaatttcagatatctcacctttctaagtggctttatcccttgctattctagtttttccatctctctgtatgagaagataagacctgacatatttactgattacaaaatatgccacgtgttgtcttgttgctgtagagagatgtgagatatttacctctttttaaaatacaaagcacttgtactgtgttttctttatcataatttttgcttttcaattttatgttttaccttcattgtgttaatgatattgaccaacccttccaattttgcattgttctcaattggcttaacatgctagtcatgatttcaaccaaatgccttccaagaggaggcattgtcaaacaggtggattatggtattgaaagaggctcattaaaggcaattggcagtcgttccaggcagactcaccatcagagaggtctaagcaaagaattaagacagatatatctgacaatggctagatgccataataaaagagtcttgcaactgaaataatacagaaaccagaaagttataagaggaggtgctcgtcagaatagaaaaatagtaggtaaattgttttaatggaattattctcttttgagagtactgatgagagaaacattaaatttcagggctggaaaagctgggtagaactgatttactagaatgaagcaaacagtaaggttgataatgtgctcttcatcaaatgagctacttgagttatttaagtttccttgcctagtaacaataacaacccaatattgggatggatatattggtagatctattagaatggattcagctgtagagattggagggctacttcaatgacagggagctaaacagtttattatgataatgatgcaggtacatgaacttaatgaaaatagttattctcttaccatatcctcacctctacttctattcatgtgttggcttcattctcagtcaagttagcagactctggtgacctaaagcatatcctgacagatgattgtattaaagaaagatcatttcctgtgtgtgtgtgtgtgtgtgtgtgtgtgtgtgtgtgtgtatgatacacatagggatttttatccatacatcaaatactacatgttgtttgggtccttttccattcttaaaccaaataatttggtcaagtatatggagggctctgagttaccaccctgagttacatgatgactctttggtagaagggtgaagggtaggcatacatatacacatgtacctccttttttggtttgaaagcaatcttacttataagaaaaattaaggaaactataattgttttattataattcattattttaaaatcccttttagaacataccctttgaaagtttagtttatatttatttgtttcattttgttttggtcagctaaaaattattttatggtcttaacctttctgttatttttcttatagtttcaggatagcctttactattctgcaacaaggttggtggtaaccttatataaatctccactgtaatttgttaaactaattttgaaaatcagagacctagatatgcataataagtattgacaaaatatcttagcatggaaatggctgtatccagtatgctgggtagatatgtacactttttgttacccatatgcacaaaaacaaagaaaaaaatcaactttatggatgaatcagagggttatttatgggctccactgcatactgaaaacattgatttaatgttttcaaactagagtcagtacatagtctagtgatctaaactacttaagcaccactcttcaccgtatcactctttacttacaatttaattgccatgtgttcttttgaaatgagcattgaaggaccatcctcatgaatgcattcctaagaatcacaatgtttattctgtgtagtcttgatgtaggtttaatcaagacccttgaaatggacacattcctcttaattgattgcaaatgtttatgattacccagagagtgttttcaaatgtctgatgactataatattactgactttctctctagacagtcttaaagctgtttattgctcatttggctactttccagctttcagttgtctcatttacttccatgtgcatcaataagcatataattaatccaaacatcttattgaaccatttcctttgcattagtatatatgatgttaagtaggtaaaatttatatattctactgctttggatttattcataagtaaaatgttcttaacaaatattgatcagcatcaatgtaaagatgcctcttatactgaaatattatgatctcatgctcagatcacaagctattatcaaatagaaattcaatctcagtgatgggccactgttgccagatcgtgtcacctcagaaatctagtatagcatataattatctttattttttaaatacaaagtaaaaatgcagcacaaatgccaacaaaataataaatgactcaaattctttttgaagtgaagttttttctaagcaagattttttaaatggcttatggttaaaagttttattttctcaggaagcaagccatttataaagtatgttttgctattcacgtgttgggaaaagtctcttcagctcaatgatgtatctcatatatccagcagtatgacatactccttcctatttttaaaaaaagcccaaggtttcaaatattaattttaatgcttggcattctgccataatttcagaaacaccaagactggctgaatacagtactgaagcctttttctactccaagtgaggtcttaaaatgtattacatgattaaaaagattaaatgtgcctaatctacacagaggaggaagaaatgagtagaggaaaaaaataagacacaaaaacttagtgacatatctcttttcctattgaattcaatattttaaaagtgatatttcaaaacaataatcagactgagaattactattttatgtattccagagaatgccactaaattttgttaaattgcaactgtagtttggaaaatgagtagtattgcaggatacctctatctgtaatacagtctgtggtatcatcagatggtatagataatatactccatgagggcaagaactgttttttgttttgctcaacattctcttccaagtacctctcacagtgcttggcacatggtaagcaaagacttgaaacagatttatttgtttatgtttcttaaatttttaacattgatacatatgacatgtacatatcatattttcagggtacatatgataatttgataaattcatgtaatcaaatcagggtagttgagatatccatcaccttaaatatttatctttgcaatagcagcatttgaattattttcttttagctattttgaaatgtacaatcaattgatcttaactatagtcatcctactgatttattgaacaccaggtcttatttcttccaagggtatatttttacccattaataaacctctttccattcccttaacccctctacccttcttggcccctggtcatcaccagtctgctctctatcttcatgaatttcacttttatatgttgagaaatatctgcttagatgctgaccactggtatggaatgagcaataccgtgtcatatttctgattaaaagccttttttggggtcagtttagaaatatacattaaattctaatatttcctaggattttttcctaccctaatctactttaatataaaccattttagtagagagattaaaattaatcttactttacagatgatagtaaagtcattattttacgtgatttaataaaatgaatcattaagcttcaatcagccactacctcttggaggattgttgtgggaaactggcctaaataagtaacacaatacagatatctgagaaattgatggttgctagaatgttatagacatcaacttttagttcctatcaatattttattccattttcctattaaacaatggcagaataaaatcaagataaatgttgttattagcattatcacattaaaatatcatttcctgtttaaatgttaatttcttccactaaactggaagcacctcaaagacaggaactgagccttcatcttccttatcaaagtatcagatgtttgctttaaaaaaaaatgtattaatcaagaccctttctcttacaaatagcagaagtttacttcaaaatagcttttttaaaattgactcatgtagtttgaaagtctagggaacagctgccttgcctctgtttcactttagttactttcacactagacatgttggctcctgcaatcgcaaaactactgcattgggacaacttgtgatacacaagaaagaccacttcttctgattatccatatttcacatttcagtcttcactgtaatttgttaaactgtttctgaaaattagagacctagatatgcataataagtattgacaaaatatcttagcatggaaatgactaaatccagtatgctaggtagatatgtacacatttgttacccatattcacaaaaacaaagaaaaaatcaactttagggatgaatcagagggttatttatgggctccactgcatactgaaaacattgatttaatgttttcaaagtagagtcagtactatcccttaaaaaattacttaggccagaggacatggagagttcgaactaaccagcccaggacacatgaccatccagcaatgcaacctagagagttgggcacatgtagaaaacaagggaggcatccagatttatttcttaaatgaaaagtggcatcttgttgtttgaataaaggaaaagaaatattgggaagattaaaaataaaagacatcaactacttagccaccagtataaccctgttaacttagaactatgattctaagttaacagggttatactggtggctaagtaagaatccaaacctagttttcttacaccaaatgcagtgtgttttcccctagataaagttgttttctaaatgaaagatggaaatgttgactgcaaatgatttataaaggctttacatatcatcaaagcaccctgaaaaccaaaacagtaacttttgacttgataaatgtaaggaaacattcaggatgaactctgtcctgtgccaccaaaatcccccttcaaaactgaagactgtcttctcccaaatgctgagagggcttgccgctgactaccttccttatgaattaccctccgcttaggggaaccacctcaccaaaggacacacaggggtgtaaaattcctccttccaccagcgctaacttgggataactctgaagaccatcccacttccagagctccctgcaggtcttcgctgagactgcatcgtagcctccctctgctggctctttcttgttcccttcccttggggcacagtgttattcccgagagcagtccctgatagcctctctagtctccaatctctaccccagagtcggcttcctgggaacctaaccttctacagttaatctgcttttcttaggcctgaaggacaattaaatagtaactaaaacaatgaaaggttttcaagggaaagtatttatgtgtttgctatctttttatctaaaattttcctctatttttaaacaaaacctcacattactttttagcatggaaatgtttataccttaccctcttatacagtctggataagaaaaaaaatcactaacatcagggacgatatgcttatccaggttctccaataactacttttaagggaggcaagcagagttgactaagagattataatcttggcagtgtgcagaatgttttcagtatgtgcatttactgagaggagagagaattcataatctttgattttctcaaaagagtctgtaacacaaagaaggttaagaaattggagcactggttcccaaatagtctcttaagaagcatcaagtgagagaaaatcccttgttttttttttttgtttgtttttttcctgagcgtttctgatcccatagaaatgggattgagcaaaaatcttcatttttttttttttttaagtttcagcttttactttaggtacaaggggagtgtgtgtaggtatgttacatgggtatattgcacccaggaagtaagcatagtacccaattcatttttcagcccccaactttctctccccggctagtagtctttggtgtctattgttcccatgtttatctccaagtgtagtgtaatgtttagcttccgcttattagtgagaacaagtggtatttggacaagttttccagatgactccaaaataaaactcagtggattacaatttggaaaaatacagacttatggatgaaaatatagttctatgttagtttctattgctggtgtatcaaattaccacaaatttagaggcttaaacaacacaagttattaatagtattttttattttattatgattatactttaagttttagggtacatgtgcacaatgtgcaggttagttacatatgtatacacgtgccatgctggtgtgctgcacccattaactcgtcatttagcattaggtatatctcctaatgctatccctccccactccccccaccccacaacagtccccagagtgtgatatttcccttcctgtgtccatgtgttctcattgttcaattcccacctatgagtgagaacatgcggtgtttggttttttgtccttgcaatagtttactgagaatgatgatttccaatttcatccatgtccctacagaggacatgaactcttcattttttatggctgcatagtattccgtggtgtatatgtgtcacattttcttaatccagtctatcattgttggacatttgggttggttccaagtctttgctattgtgaatagtgccgtgataaacatacgtgtgcatgtgtctttatagctacatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtcctttgcccatttttgatggcgttgtttgtttttttcttgtaaatttgtttgagttcattgtagattctgcatattagccctttgtcagatgagtaggttgcgaaaattttctcccattttgtaggttgcctgttcactctgatggtagtttcttttgttgtgcagaagctctttagtttacttagaccccatttgtcaattttggcttttgttgccattgcttttggtgttttagacatgaagtccttgcccatgcctatgtcctgaacggtaatgcctaggttttcttctagggtttttatggttttaggtctaacgtttaagtctttaatccatcttgaattaatttttgtataaggtgtaaggaagggatccagtttcagctttctacatatggctagccagtattttttagatcacaagtctgaaatggaatctcagtgggctataatcagtgtcagcaatgctgtgttctctggtggctctagggaagagtcaatttccttgccttttccaccttctagaaacaacccacctttcttcactcaagatctctttcccccatcttcaaagccagcagtctttcatctctctgaagatgctgagtctcaacacattcttcaggagttagacctccctttgatgctcctgttctgtctccctcttccaattttaaagactgtgattacactagagccacccaaataatatgggataatctccctattttaagatcagacaattaacagctttaattctatctgcagccttaatttgtctttgttgtgtaatctagtatattcacagattacagggattaacatgtgagcattttggggagaccaatattctgcctaccacaagttcctttatagtgtcatggaaaaaacatcttcctcctcccccagtcttatgtttaataactcaattaatgagccttccaccacctgttgttatgtaattatctggtcagtagaagaaattactggaaactacagaaacttcttttagctttctgttatccataaatagcacctagtcacacccactcacctggaagcaccttgaggtcaggaaccatatattctttattttggaaacacagataactcatctcattggctgccagctaatcagcatacagataatgtggctgaatgattgtgatgtgtgatgatgtttgtgttcattgaacaaaaccaaaggcttactctcttttattttttatttttttgacatggagtccccctctgttgcccaggctggaatgcagtggtgccatctcggctcactgcaacctccgcctcctgggttcaagcgattctcctgtttcagcctcctaagtagctgggacgacgagcatgcaccaccacacccagctaattttttgtatttttagccaggctggtctgaaactcctgacctcaggcaatccacctgccttggcctcccaaagtgctgggattacaggcatgagccactgcacccagagtactctcttttttaatgactcttacacacagcagctcataaagagcatggctctgaatcttctctcattgaacttaccagttgccacatatcatgggtatttggtgtcatttcctcaaataagcaaaactatttatgcttaactcctgcattccatgagtctgccttgtaatttatgcttgccattttgggtagctagccatcagtaaaatttaggcaatctggcctgttggtgggaagagtggtggtctcttaacaaatagtcatgttctttactaacaataaaggaattacaatatgttagaccctacactagattttgtatatacacagcaaacacacatagacacttttgcaaaatcaatctttgaagacttctataagataaatatttttttctgggagtggtggcttatgcctgtaatccaagcactttgggaggccgaggcaggtggatcgcctgagctcagcagttcaaatcagcctggccaacatggcaaaaccctgtctctaccgaaaatacaaaagttagcctggcatggaggtgtgcacctgcagtctcagctgctcaggaggctgaggtgggaggatcgcttaagcctgggaggtggaggttgcaatgagctgatgtcatgccactacactccaacctgggtaatagagtgggaccctgtctcaaaaataaatataaacaaataaattcttcatttacagttgaggagaaattttcaaaaaatgttacagtcacatatctaagaagtgacaaccaggattccagtgttaggaaacagaggggttatagtggtcttttgtcacatcacttttcagtatgcatatcactctgatcaaaaattaaagctaaaaaacgttatatagtttcaaattaaggataattaatttactagatcaatttatttattaaaaaaattttttttgagggggcatctcactctgtcacccatgttggagtgcagtgacacaatctcagctcactgcaacctccacttcccaggttcaagcgattttcttgcctcagcctgggtatgtatttttagtagagacgaggtttaccatgttggccaggctggtctcgaactcctggcctcaagtaattcacccacctcagcctcccaaagtgctggggtttcagacatgagccagcacgcccagccccaatttaaaacatgcaatcaaacacgtcacttccagacttaaactgcttttcattctgctcacatatccagtcatccacttaaggcagatcctctacttgaaactttcaatagattaaagctgtattttgaataaaattaaaacctcttcctgtgtctcacagagatctacataacctgactcttcctctccatccagcttcatgtctcactagctaggctgcaaccacagtggtctcctatagatttttgatccacaggctctttaatgtcctggacattttctgagctgttgccttttctccttatctatttgcttggataatgtcttcttatactttacctcagagtttaaatactagttttgcagagaaaccttcctctaagtaaaatatatcctcctcctcaccctattatcatctaccaatgcattcattgttttcttccaaacacttagtgtgctttgtggttttagtttgtttacttgtttattgtctgttttaatgtttgaatgggtattcattgatgtgctcctagctcctagtattgtgtctaatattcaacaaatgtttttggagaacaagttttttctcaaagtgaaaatgtaaactagtactggtattttatttttgtaatcagaagatttcacagagaataagtaatctgaaactttattctctagtcatgctctgttttctgagcatcttggatctatttcagtgttacttttgttttgtttgccttgtattcagatgtacaatttaagtaactcaaataaagaacaacttacaatttgaaatcaataatctgctctgtctgctctgacatgtattttttttttctttttttttttttgagatggagtctcactctgtcacccaggctggagtgcagtggcatgatctcggttcactgcaacctccacctcccgggttcaagcgattcttctgcctcagcctcccaagtggctgggactacaggcgtgtgccaccacgcctgactaattttcgtatttttagtagagatggggtttcaccatattggccaggctggtctcaagctcctgacctcatgatctgcccccctcggtctcccaaagtcctgggattacaggtgtgagccaccacactgggcctctgacatgtattctaaaggtatattggttctggggtgaggcccaagcttgtgtatttttgataagtttctcagatgattctgattcacatcaaagtttaagaacatctgcttagtatgtacatagtcttgttattgtacctctaccagtgtcaaccaaagtccatcaaatttaaccctttgcttaattcatggttcagagtcttacacctttatgtacattctgacttggatattgaatgaatacataacacctttattattccacctcttttatctcatcctctgccctagctgaggattttattcttttaacctgctttgatggtaacatcctgagtttaccacataattaatgataagaaatgtaagatagaatttatacagtatatatgttgtaaagatttttaaagtcatcagataagtaaacatataatatttacaactattttgaaatgaaagaattcagaagaagaaagcaaaattgttgttttagtcaatttgtaaccttgcaaatgtaaatgtttataagagtaaatgtagtttctaaatttttggctatttgttttcctgttctgtggttttacttactgctttttctggtttgtatgttgaaaaatacataaattaactattaccactgagaggcaaattttacttgcagggaagcacacactattaaggattttgagatctagtctattcataagttccctacaatcccatttacttgtttctctagtatttgccctttaaatattttattctttggatatataatgaaaaatatagttcatgatatagtaaaagaaaatctactatattaagattatagcataatctatattaagcttgtattgtgccagatacttatttcagatatcttcttctataaacaagcaatctgatactaagaagaaatatttgtgatatttcagacatttattgttacttaaatacacatcaaagtacaaatgataaactctttagattgaattttacttttcttatttaagtgtgacgtggacactggacattttaatttgataaatttctagaactttgcttattttggaataagtatgtaaatattttgctgatcatcatgcaatcaaaaatgttacttaatattttctaaaatgctgaaatatgttttgaaaaaatatgttttgcacattaagtattttctccttactaaggcaaacttggtatctcctaccaacttttccaaatttagctaaggaggtaatactaattaaatagattaaaatgcagcttttatttgtggtctaagttacctgaggccctttgaagataaccttttgaaactttctgtttaactgataaaagtcaagtttagtgatactgttgcctattttaagaaacattcataatcttgattcagattcatcagtcatcaatgatattcatgcttacatgaggttaatattactctttaaaatgctaaggaaaatagggaatgtctttcccttcttcttgttttgctctagagaaatggggcatctctccaaccatctccgtgcaccctcacccaacatttctaggattgacatcatttaggttccatgtagatagaaagaaatccatttaaaaaataacaattcctacatttttcatgtgaacatttcaaaatgtaccaaaccttaaacatacttgagagttccgtcagctactcagttggtaattttagacagcctacagtgtggaacaataatctattctgatataggtgaaatagcttatgccttccttctgtacaataattcacaggtattttgatgggcttttgatgtttccagatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggtaagtgaaaattgtcttggggtgagagttgtacaaaacaattaaaagctttggaatagaccctacagaggagatgaaaattaagagcagtgcgagggaattaactacacaattcttgttaacactaatggaggtagcatagtgaatgcctcacttatctcatttaccccttactgtccagttagttgctgagagtatttgtgtttatatatatttaggcacatagacagaacaattttaagaagtcttatagaagtttaaaagtgctgttgacctgaatgaatctggcaagatcaagaataaattcacaagtgcacagctctctaactaatccttagtaatttttgtaagttaaaattttacttctgaaaaaataattacttgaatcaggacattattgcctaaacatgattactgttacaaaacatatacagatttatatcttctctgtgaactttgtaccaacacaaataattaagtgtctgaaactctgtaaagtgatgactagtgtacattttatgatgctgcatcctcaaatttttaattgtatctgttcatttagttagaagctctgaaacttagtaaaaatacaattaagactttctagtgataggtataacatctctatgttctaaaatgcctgctattgccttgtaaaagtttattgtcatgtctttttgccccacttcaagtttttaatgttacatagtgatagaactgttcatgactttacaaactttcacatggaatttttaaaaatattttaaatttgaggacgggaatttatttgtttaatactttttttttttttttgcctcatttcactattatgcttctgttagctcctgaagtactgctataaagattccaaattaggaacatgttagaagttctttgacactcacaatatagttggtatcaaaaaacataaggcagaatataaatcactaggaagggtaaaacttgtggaaaactgtcagtaatataaaatttttcattttaataggaaacttcattatgcagtttaaagacaaattatacacattttactttttgagttcagcaaatgacttagagaatcttattgaactactacattttttcataatataaaatatttccaattttaaagaagttgggtctttccttcaagaaacacaaatctggaagatgggagtgagtacacagaggatgtaatataaattaggatgttaaaattgcaatagaggcggttgaagcatctatggtcatttttgttggaggagatcagagaaaacctcactgagcaggtatatttgaactggacttcgtgtcatgggttaggaatttataaaacagaagtggtaatgatatggtttcgctctgtgcctccacccaaatctcatcttgaatggtaattcccacgtgttgagggagggacctggtgggaggtgagtggatcatgggggcggtttcccccatgctgttctcatgatagtgagggagttctcatgagatctgattgtttaaatgtggcagtttctgctgcgctctgactctctcctgcctccttgtgaagaaggtgcttgcttctccttccaccatgactgtaagtttcctgaagcctcctcagccatgtggaactgtgagaaaattaaactgttttcatttataaatgacccatcttgggtagttcattatagcagagataatgctagtgtattcctttgctagagctgccattggcttaaacaacagaaagtttgcatctcacagttctggaggctagaaatctaaaatcaagatgttggcaaggttgattccttctgaggggtgtgagggaaggaactgttctaagcctccctccttggcttgtagatgaattctttttccaatgtctattcacattttcttctcttcgtgtttgtttgtgtatccaaatttcctttttctataaggacatcagtcgtttggatgagggttcaccctaatgacctaattttaatttgattacctctgtaaagaccttatctccaataaggtcatattctaaggtaccggatattaggaattcaacatataaatttgagaaggaggtagtgatggcacaactttacccataacagttaccattagctgttatgagcaaataaggcagaggagtatgtttgagagttcaatttggatcctgtaaaatttgagctagcagtggattcttcaggtggtcttaactatgttttaacacctttatagtacttactatcttcttactacttactgctttcttttctaacacctttttaaaaaatgaactcatataatcttcataaaaagcctttgagttggtactaacatcatccttgttttgtagataagaaaactgaggtgtacagggtttaagttgtcaagatgacacaactaggaagaggcagatctgggattaattccaataagtttgtctctagagtttgtgcacttaaccttggttcccagacaggttggttataaatgcatgactggagaccaggaaaaagatcagtgctcgagatgtagtttatttgtttttcatcagtttaatatgcattgatttactagttcactggttttccagttcatcgtagaaactatgctaggcactagcgatacaatgacaacaaagatcccattccttttctcaagtttatagcctggtgttggagaaggaaaatgaaagagtatcagcattacaagatgcatgtaatggcagaacacatacatctacgctgatctccagagccagccatgtctggttgtagaggtaaagtatacagtcatgaaatgttgaggaaggagcttgttatagatggtatcttgaaggaggtgcttcttgagttgagcgttaaaggacatgtggattggatcaggcagaaaagggtgggaagaacattctaagcagcaggaagaccataaataaaaccacggaggcggggcatgcagcaagaaggcaaagggctagggaaggaatgggtagaggtgggtgtgttgaccaccctgttgagacgtttggtgacgaaagtaagggtaaattatggtttaaaatttttaaaaatcccatgagactgatatcagaaccagggatatctgtttcatttttaggataaaacaagctgagccttttcacacaggtgttgggaaagcaaccagtgatgaagaggagattgtagaatggaaaaagaatattgatgagctaagaccccagagtgttagaattcatgaagctctgccaggggactactactcattaccaataacctacaattgttgcttcaaaggtagacagaattagttcagacttcattaaaggaattttcattgataatccttgtctttctgataatcaatttcaactgatatgatcttaacttctcaccttgtcccccaaccttgaccctgaactttatacttataataatgtatcccttccatcttggtccccaaacacataaaatctattatctttccttaaagacttttctgtctttccccactcatccaccatttttttaagtaacttatcttttataatcactgattttatgtctccaaactgtggaccagttattccacaggcatcttaagcaatgatgtaggaatggcagacagaatgtgaactaccaccacctctatcctagcctaagctcaccctattgtactgttctctgacctgcaagatggttcctgtttctcaattagttgttctcagacacatcccacctcctcgatgggttctaggattgtttcttttgagtagggaataggctgaccctattagtgctgggagcagttcattcaaaagacaggcagaactaaatttgaaagagtacactgaaattctgaagacacaaagagaaattatttctgtgtgacctagagtttcactcagtctagtggaagaggcagcatataattaaatattactatgtgaaagaaaattctataataatgatggatcaatgatgttctggaataccgtaggagaactgactcatgctacagagagcttagccagagtcagaacaaatttcacagataagttgtgtcaccagactcttgaaaaataaataagaattaatcaggtaaacagtggtgggcaaacaattcagaatgtgtctgtgtgtgcttgtgtgtgtgtgtgtgtgtgtgtgtgtgtgtatgatatatgaacagaattaaaaaatcaaattctactgaggcttttaaaattacaaaacaagagtctatttatttctacctccagttattcttttcagaagtatttattttttattttaaaatttaatttgtatttacttttagcatatcctgtgtatttgcattgttcaaaatttaaaaggttcaacaaggtaatatcctgccactgttcctcaaacacctgagttccttttcatgaggcaaatagtgtttcttatgtggcattccaagtatatacagacacacacacacacacacacatttttattatttttcttacataaatagttatgtactatgtttaaattctgagcttggaattttaaacttagtaacttctagatcattctattgagacatacgatgtgttcctaataatatctaatggttatataatattcccttggtaaatgtattagtccattctcatgctgctgataaggccatacctgagactgggtaatttataaagaaaaagaggtttaatggactcacagttccacaggactggggaggcctcagaatcatggtggaaggtgaaaggtatgtcttacatggtggcaggcaagagagaatgagagccaatccaaaggggaaaccccttataaaaccaacagatcttataagacttattcactaccaagagaacagtatgagggaaactgctcccatgattcaattacctcccccaggtccctcctacaacacatgggaactacaggagctacagtttaagatgagatttgggtggggacaaagccaaccatatcagtagattaaatgactcttagctctttaacttttttgttttaatttttacttactctagtaaatattactggttgatttattagtttgtcatctcttacctaccttttcttatataataagtgatgatttacttcatgtccttcacctacacctgcacatcctctcaatatattactagttatagcacaattttaaataactttatataacacagttacacttctatttccataccaactactgttgacagtatagtaattgtaaagacaatatactagttgtaaaagttcgttcactatttttccactcttctacctctcagcttccatgtcccacagatttacttttatattgagtgtgttggaagcacgtattttctattctgttactagaaataaattattcatgcttgactaaaagttggctttataagatgaaaatctgtaatttgcttatgttttatcactataaatattgttcactgtacaacaaagtattaagatatgattatatttagttttttatcactcagcttcaggtttcttgtttgaattattacttttcttacttttttcttcatctttgggtatgaaaattctaaattgctgttttcaataacaaatctccaaaatccccatttcctgactgcaccctttcctcccagagaccccctttcctgctctgtttctggtgcatccttaaaatcagataaattctagtgggtcagatccacaaattcctggttcctgtgtcttaacaatttcttagtttccggccttgctgggaaatatcttgaagtaacttctgaaggaagagggttttttttttttcttacagagaaaacatctgtgttagataagctgtgtagaggcaagagttatagtgctgttggccacaagttcaatgataatgaatcaacaatgaatattaaataaagtgcctttaaatagaaatgcataaaaccagaggctggcagggaccaaactctgtatttcccctaggagcagtgattcaatattcacaaatgcagtgttcataggaattttatagaacctaactactgtgaatgacaagcatccacaatcattgttattatattcacttatgaaaatgtattcattctaacttcatccttgatgaataatgtggctaattgtaaatttctaagttaaaaaattatttacctcagaacatcaatagcattaatttattacataatggtaatttgatcatttagattgagtagatagaagatggatatggttattttactggaggtagtgctagcttttgcatgtgtatttatgttgccttgctcttggataataatggcgacattagttgccccaattcacctagaaaattcacctatttatttagaagagaatcctatgcttcttactttttttttcaagggataaatatcagctttcaggaacattttgcatgtgacagcatgtgagaatcaacatacatttacgtacaatcagtctgctttattaactgattttgttttttgcaaattcacctattcattaagctttatttgtaattccaaaatcaatactcagtgcactttcatgatcatatatttgcatagctcaaaaacttgagttgttagtaattaaggtcaaataaagctgctctctgcattcttgttttagctcctctatgacaagcaagtgttcttttctctatctatttatttagtgcctttttcaattttttgtgctttcatcagtgatttccctgtttaaaatatctcccaaacatagtgctaaagtgctggtctagtgtccctaagcacaagaaagctgtgatgtgcatcacacagaaaatacttgtgttagataagctatgtataggcaagagttatagtgctgttggccacgagttcaatgttaaagaatcagcaatgcatattaaataaagtgcttttaaatataaatacaaaaaaggcagaggcttacaaagaaccaaaccattcccctagaagcaatgattcagtattcataaacacagcattcataggattttatagaacctcgctactgtgaatgacaagaatcctctatgttcccatattttgagctctccatctcacacctaccttttatttggccttttcaactatcaagacttctatgactctgcaggtagaggtcttgatgcttaattgctgcccttatgacagtctgtagtctacggcttctgccaccctgcttcaccagatatcattgctacctctgatcaagcgtcactgcttcatttttatttttcagtaatttaggcaaaacacttttctgatggcctctgttccttttctcatggttgttggctcatatacgtattcaattcttcatattttcatgagactctgggagtcatctcctttaactttcttgagttgaaaggtccagaatattctttcagatttttagagattaaagctcaacaatgataagggacgtttaagaccagtttttatagattttatgaaacaatattaaatcatggcatttcagatttgaaaaatataatatgtaatattttgttgaattccaaatatatagttgaataaattaaaggcctctctagatctaactcacattcttctctaacttcctccagctatgttctgcacctctgcagattgtagaggacacccagagtttgaaactggtcaaataggttgttagcaggtcaaaggggtgcagaatttttgcatctgaaaagaatttattgaaaacggcttaccatggattatatgatagaaaggcaaatgaagctggaaagaaactgatggattgagaaattaggaaagacagagaaactaaaggttatgatgaggtcagagacacaaccaagttcagcaagtgccttaaacagagagaagttgaggggagaaattctggtaaaaggggaatagcagaactttcaaccctactgttttctatactttataagttagcatgcaaagttattgaaatattcaagagaaatattaactttaaagtcagaagaatgagttttatcaaagaaattgctcacttagcattgtcatgtaattgctaaggggaaaaataagcatatcaattctgtttgcatctttttcttttttttctgtccctggagaaattatgtagcattgagttaattatgctccctttgaagtcttagaaatttaatacattaaatgtctacacttagtgctccacctctcattcaagagtatcaaagctttaagaaaaatactgcagttatgtgcagctgagtatataaacctgctgtgatattggcagaaaattgttacacaatatatctgtaagtgtccttgaaatgaatatagtgaaacagcagtgctcacttggttttatttaaatatagattggaatgatattttgaaaaaaatgtttttatataggaataatgttgcatttgttgctgtgtacattatagtctttccagaaacaatacaaaaaaattctatataaattagacattttggccatggtctttagtgtttgggtttgagaagatacgccaattctttgaaaggaggaagttttactatttatacagcaatagatattgtctccaatttacattttttcttcaaattttcagaaaggaaccctactgttccatgacatccttttatttcacagtaagaaaaggttattattatcttgtattccttaaacatactttatgaaatagttttcattgtattgtactataccctaggttcattgaaaaaaagaactttgaggctgtcaaacaacaaaaaggcaaagttacatatttcaaatatgtatgcagcttcccaaaaataagcctttggaaagatttaggaaacaagggaaggtagcttatctcagtagatacagaatgactcccactcatcaaaagggtgcccttttaagaagtgtctgttcatagcctttacccactttttgatggggttgtttttttcttgtaaatttggtcaagttccttgtagattctgggtattagaactttgtcagatggacagatcgcaaaaatgttctcccattctgtagctcatcatcactggtcgtaagagaaatgcaaattgaaaccacagtgtgataccatctcatgccagttagaatggcgatcattaaaaggcaggaaacaacagatgctggagaggatgtggagaaataggaacacttttacactgtttgtgggagtgtaaattagttcaaccattgtggaagacagtgtggtgattcctcaaggatctagaaccagaaataccatttgacccagcaatcccattattgagtgtatacccaaaggattataaatcatcctactataatgacacatgcacacggatgtttcttgcagcactattcacaatagcaaagacttagaaccaacccacatgcccatcaatgatagactggataaagaaagtgtggcacatatacaccatggaatactatgcagccataaaaaagaatgaattcatgccctttgcagcgagatggatgaaaccagaaaccatcattctcagcaaactaacacaggaacagaaaaccaaataccccatgttctcactcataagtgggagttgaataatgagcacacatgggcacagggaggggagcatcacacacttgggcctgtcagggagtgaggagcaaggggagggagagcattaggacaaatacctaatgcatgcagagcttaaaacatagatgatggggactgggcgcggtggctcaggcctgtaatcccagcactttgggaggctgaggcgggtggatcatgaggtcagtagatcgagaccatcctggctaacatggtgaaaccccatctctactaaaaacacaaaaaattagccgggcatggtggcgggcacctgtagtcccagctactcaggaggctgaggcaagagaatggtgtgaacccgggaggtggagcttgtagtgagccgagattgcgccactgcactccagcctgggcgacagtgcgagactctgtctcaaaaaatataaataaaataaattaaaataaatttaaaaacctagatgatgggttgataagtgcagcaaaccaccatggcacatatatacctctgtaacaaacctgcacgttctgcacatgtatcccagaacttaaagtataataataataaaaagggtgccctgagtactcaaattgctgtgatagttatttaaatgacacatttttttctaaaataaattatttggagacattatacaatgcacaattttaaagatgaagcaattataatatagtgcatataagtttacaactcaacaaatttccgtgtgaccatcatccagatcaagaaacagaacataactagcatgcccagatttctcattcatgcacgctccagttaagatctccccaaaggtatcctgacttttaacactattcaactagttctgattaattttaaactgtatataaatagaatcatacggtgtgtactgttttgtctttctttcgttcagcattatatctgtgagattcatccatgttgaagtttgtagaaaaaattcattcattttgattgcctcaaaatattttgttatatgaataagacagaatttatatacttctgttgatgatttttttacagttttgctcattacagataggggttctatatacatctttttggatatgtctgtagttttgttgagtatatacttaggaatgaaattgctagctcaaggagtacgcataaggcatgttacatattaatgctagctgatgctgccagtttcccaaagtgtttataccaattttactatttgaagtagtaactgaaagcattccaattttccgtttcttcaccaacacttgttattttctgtcgtcatcattttattttaactgctggacatatattagattcagattttaatttgcatttttctgatggatgatttattttgtatatttatttgcttcgaggatatttttcttttatggagtgcctgttgaagttatagtccccccttctttcccctcatgatttgtagaagccctttgaatataatggataaaagtctcttgtcaagtgaatgtattttgaaaatcttctcttctgtctgtcttttcaccctgtaaatagtgatgaacagaagttcttatttgtaatgtagtccaaattattacattttttgtagttagtactttttgtcttttttaaaagaatgcttcttactccaaaatcatgaagatctacatacaaggtttttctagaaacttgttttatcatttacatttaaatctgaagttcatctgaaattaattgttttgcataatgtaaagtggaggtaaagatacattttattttccatatggtgaacacttcattttaacacaagatcagtgtgtctaaatggaaagaataatagaagcttccaatacccattaataaagtgggagttgattagtgtatttgaaagtattatctctgtactgcatcctattgctatgacctatatattattttctaatatgaagcacatgactttagaagaaaaggaaaggttatactggtgaattaattgaaataagaatcttcctgtgatcccaggatcacaaaagttcgtgatgctggattctatggtaaaagttgtaactctttccatgggcccaatagttatgggtcatcaagtagcagatagtggccaatcactcaaaaacaaactgctccatataaatatagtttttacaattgcatggaattgtaagaaaaaaaataactggcttaaaaaaaaacaaatctctaacaggcactgattcatccctgatttagtttatatttccttgtatcgtatttatcaattattattaaactgctctcaaatctgagttttaactttagctttataagcttgtattgaaaggcagctctgttactagtcaatccacagatgtgggttttttttttttttttttttttgatgagaaagtcttaaatttattttactttgcgtttgacctaaattgtatatgatagttcttgcttctgttaatgaggcctgagacagcatcaagtttttcttttctgattggagagctgtttaacttgcagaaggtttctctgaacatggaaactaagcaaagaacgggtttccaatgagtctaaacttccaaataaaacagacccaaattaccgctcttgtgaccactgacttgggacactgatattggtggacagtttgctactaacttctcctaacagcctatagtctatttaataatttttgactgcaacatctactgctggtttttactttatactaagttcttaaataagtcaatcatttttattccattccatttgaattattatccaagcaataatttgaataattgtggaaaaacaagaaaatatctgaatatttgtgacaattgtaccattattttaaatataaaatcacagttgcttcaaccttcaagacaagaaaattgaaatccttctctaatccatttttcacttattcaattattcaaacaatatatttaaagctattctatgcaagtcagtgtgggaagagctgtaagaatacaataatgaatggtatatgattccataccccaagggatatagactcataaggaaaatgctgtaaacacgaagtgtgcaaaataataaaaccataagaacagacacagttaaattactcctctctactcctaaagggacttgagaataaagaaaacaaagttgctacctgaaacctaatcaaataaagtctattggcaatgtatgagttacacatccctaggttattcatatcaaaactttattgttctgctgtaagtgagaattcttgaccatttcaaaaattcttaccataacctgctgtagtcttctcaaagcaagtctagaatgtaaatgaatccaaaaataattaaatttttattgagttttccctccatgaaattatacaggtgattcaaaaacaaacggagtagttagactggacctaatgataaatttgaggttgggggaggggggagggatagcattgggagatatacctaatgctagatgacacgttagtgggtgcagcgcaccagcatggcacatgtatacatatgtaactaacctgcacaatgtgcacatgtaccctaaaacttaaagtataataaaaaaaaaagaaaaaaaaaaaagataaatttgaaaatgggaatttggcagtgtttgtctattgctgcttagagaagacaccagtcatggaaggcaaggacaggctaacatatgaaggtattctctgtggtatgtcaggcacaattcatcagatttaattaaaatgattttcaaaattatgcacctctttgagctctgctcctactctatgacataagaagccaggagaatagtgagctcatgcattctaagcactagagagatgtatttattgcaaataaataaattagcaatttatatgctgatttctatttaatttgcttagtacataaatggcaaatacatgctacaagtgctattaattccatttccagaccaaaaccatagattaccactatctgccctgctgtactgagcagctatagcaaatggatcttagttagcactggagtccgaacctatttgccaatctgggttagtatgagtcagtctcccagaacttaatcaattccttaaatacttactgacaaaatcaatattttagttttgtagagaaccagattttacggtaatgccaccccatgaagctttgttgaaaaattagatagtctctctagattacaattctatccagactttttctcactataatacaaataggagggaaaaaactgtcttgacagagcaaattaaggtcaatttgcttttcctaacaaaacccattgttattagaatgaaaaaaataccctgtagcatataagaaggttaaaaaattaaacttatatgtgtctatccaatagtaaaatttcatgaacatagaggtcctttaatgttctggctaattaaatttttagtgccttgtagactataccaaaatttctttttggtttctacttgtagaaaagtgttagaaatactttagtctgggtttttttgttttgttttgttttttgaggtaagagctagagtatagccaagatacctaaatctttcacattgatatatcagtatgttgctggatattcagattatcaatgcttattacattaaaattcacgttagacctgggtcctgaaatcatatttcacttttttcatatgtcttttttagtaagctatctgagatcctccttataaagttaaatataaatgtacccatgtctatgcaaagttttgcatattggcatgaaagagtatatatatgaaaacatacatttatacacaaataaatgtagaagttttgaaaaagcaaattcattaactctgattctctgatatatatacataatatttatatatgttataaaataatatctgctattcagtattttattctgttaaaactaaaagctattaattgatggctagttgaaacataataagttgttacttccaatattgcttgatcaaactcaagtcagattattagccctctctaatcggccaaaaacttcactttgaaagatatcatgagaaacttgcaaaagtaaattgccatttaaaatttattgtgtagaaattacttttttttaaccgtgattcttgttttgttccttaatagcctaaatatcctgtaaagaacactggtattaaatgtaagaagtaggtgaacactttaattttgaaaaattattgtaatgaataagcaaatccttattaaaaaggaaaagtgaaagatgaagggtgggtttagaactgaccagaattcttaagtttaatatccataaattcttacatataggattgatatccagcaggtgtgcacctataaagctctcttcactgcttatgacaggcatcctttctcatggaagatgtcctatttgattgctgagtggctgttttacagagttttaaaaatattttgaataacattcccaatcacatgagtcctctaggaatgtagaattgtgagacgtacatctactgatccaagtaggtaacttcttcaatccacatctcttcatatatcattctgtttttagtcttcttagtgaataaaaataatgtcaattttaaatgtttaatacctaataaatatttgcattttaaatttcactcactattatttaattagcattagtatattatagttagactacatgttctctaatttggaaatgtttccagtgataatttttaattttttttcaaattgccagttttaatgaggggaaaaacctaactttctctttattttgtttatatattcataatagtctacagagttcaaaagaaggcataattggcataatactttagagataaacaaaaatgtgtttacctaaaacaaagtttcttgggcttggcactattgacaatttgaaccagataatttttgttgtgggcagatgtcctgtgcattataacatgtttagcagcatctgcctgtacctagtagatgtcaataatacctaccccagctgtggtagaagataaaattatccctggttgacagtcattgataactatttaattctttttttttttttttttttttttttttttttgagacggagtctcgctctgtcacccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccagataactatttaattctgaaacagtaaatttttgttctcatgaagtttttattgctgtcctatgataattacttttcactttaccactaataatagctagctagcatttattaggttctttcagttgtgtgacactgctaatcactctgtaagttaacacttataatcctcaaaaaacccaatggcatagatagaacagtatcttaatttcacaaataaaaattttgtaaaatgatgtataagcatttgtctatcttaattaggtagatcgtttgcattttattttttgtttgcttagtgatcacttgcgaagttattatactattttttaacatgttcatcatgaaatgcattttttttggagttacttggtttccaagtgacatttaactccctaaaatagcatttaatcagtaagtttgtgttgtggtctttgaacatgccatctgagggacaagagtgtgctagattgccttttgacttacgatttttagaacaaaataaatgaaaaagaaaaagaaatgaacatatacataaactgagaagcataactaattgacagcaagaaatgacttgattctcaacactgtaaagtagttgctaaaggcagtagctaatatttattgtgttttccttacgtgccagacactgctgtatgtgtattttacatatgtacacatgtatttatcacactaaacctaggggatagatgcaagtttagcctcattttacagctgaggagattgatacacagaggttgtaaaagtagtttcaggtcacacagtgagtaatagcaaaaccaagtttagattactagtacggagtgtgctaggctgggcatggtggctcatgcctgtaattctagttcttgggaggctgaggcaggaggatcaattgaggttgggagtttgaactcagcctgggcaattgaagccagcctgggcaacatagggagaccctatctctacaaaaaaattaaaagttataatagctgggtatggtggtacatgcctgtagtcctagctactctggaggctgatgtgggaggatagtttgatccccagggttcaaggttatagtgagctatgattgagccactgcactccagcttgggcagcagagtaagaccttgtcccccgcaacaaaaaaaaaaaaaaaaaaaaaaaaaaaaaaaacaacagtacgtgctatattggttttacagctctacagtgaaagtgaaaaagtcaacttaaccttttattcatgacataagaggtagtcagtatgcctaactcccactaaattatttgtaaggcgagcttgtactgtgaactttatcagtaaaatctattacatggtatcataatataatggaggaattggtcaggattatggatttttgtcatatttcgcccttaagcatagagaagaacagaacttttggattaaatggattaattttagtgtatgtgcttatactagagagagaaaaagagagaggaagaaagaaatctaggttgaataaatactttctgacataaagaaattttgaaatatggaaattattattggaactccagtggctcacaagatagtatttaattattgatatgataagatcactcaatatgctgaatgtgaattttcagaacaaaagagaaatgttaatggtggtttaatctaagagatccaatttgtcaatcaatctcccattggacttgtagagaaaacagatggcaacgatgattccctcattgctaaactgtcctaatcagggctaagaagaggagcaggaatggaaacttgggaaacctgaggtacagaaagcggcatgagcctatttcttagcaaacacaagtttgccttttctgggagacctgaaataaatgttcatcctggttcaaactcccatggtgatcctgacctgagcttagagttgctacaaaaaaattcacaaattttcagcagaaatgaaataagaatttcaaaagagactccgaatttgatgagtagaacttacgctttgcatttctgtaactgttttgggaattgcaaacctcatggtattactaaattatccattccctattctaccagtgttggtttgtattctcaagatatattgattgccatgaaagcaaactaaagccacaaacaaacctatcaacctagcagtccaaccttctctggacattaaatttatatttttaaaaaactatctaaaattcagaataactgccactaggagagtggagaaatttggcaacaaatatagcttaaccacacaccacacaaataacttttttattataagtaactgagaagtttagcaattagtacatctacttaattgcattttaaactgtaacgtgtttcttggcccacctttctgagacatgtttgttgttgaaaataataataagaatagggttatttatttcctggcaatgtcctccaactagcttaatgttgaaatactgttttttttgtttgtttgtttgtttgtttttgttgttgttttctaaactaatagtgcaggatcccccaggtctttcagaatctagcatttcttttcccctttccgcaaggattctggcatcgagatttttatgttgatgatccacctgctccaaatgtggcctggagactagtgctactaggggaaaattcatcctcacactctgctgttgccaatatcacaatccagggcctacttaatacagtaaaatgtctcttgcaacccaacaacactcccaggcatctcaacactaaaccttacttcaccatcattgcaccctttgtcaagtcagtttccctttagaaaagctgatgatcttgtatttattttacctattcttttttgcagcccttgtctccatgatgtttggcactcagacacatggaacctggcagggtgtatctcaaagtcatgtctccatttagaccttaaattagaacttacaacaaatttggggtgttccatttcagatggtacccagtgaggttgaaggttggatcgtattgttcagagatggagtggatctaactagggcaattagctgtcaggccccaaatgtccaggtatatttccttatgattaagctctttaagcaaattgaccaatcttttcccaccctgccagcccttcaggctgccagacatagaatgacatagctgagatggctgaaaacatgagcatatgtatttatttgtaatactgttgttttaattatccaggttgagaattagacaggcgggagacccaaatgcaaaatgaaattttaccttaaaagatcggtgtggtggctcacgcctgtaatcccaccactttgggaggctgatgtgggtggatcacttgagcccaggaatttgagaccagcctgggcaacatgatgagatcctgtctccaaaaaaagttttaaaaattagccagttgtggtgacacctgcctgtggcccttcctgcttaggaggctaaggcaagaggattactggagcccaggatgtcaaggctgcagtgagccatgttcgcaccaccacagcaatccagcctggagtacagagcaaaaccctgtctcagggggaaaaaaactggtaatacattctgaattaaataattactttatatttactatgaaagagaaaatttcagataattaccagagaaacaaaaactaaggaaaaaaaagaaaagtggctctttaaatttccctacagactaattaaatttatttttctagctttgcttaatggacggatacctttgtgaattttggatctttaaaatctatcaccagtattcccataatttattgttctccgtcattagattgtaaacttcatgaggtcgagctctttattttttcaagtccaaatcccacaccatatatagcctaatatattgcagacaacaatctctaaataaatggtaaatttttgaggtgaaatttattctggagattgatgattgcagctacttgattttgagagttgtagacatcttataactggtttaaatgagaactaaacgatatattccagaacgactgaaacagttctctcttatccaattgcatcctttctgcctttcatctttctatgagagtgtctcacattgcatttaatctttacattggctaaattctaactaaacaaaaatttcttaaaacataaatgaaagtaaagatttttttcttagcaatgaccaaccctctccctagacagcctacttttggtattttgggactgattgctagaacttccatgaaaagattaaataattttttttttttttttttttttttggtgagatggagtctcgctgtgtcaccaggctggagtgcagtggcaccatcttggctcactgcaacctccacctcccaggttaaagcgattctcctaccccagccttctgagttgctgggactacaggcactcgcttccatgcccagctaatttttgtatttttaggagagacagggtttcaccattttggccaggatggtctcgatatcttgacctcatgatctgcctaccttggcttcccaaagtgctgggattacaagcttgagccaccacgcctgcccaattaaaacaacatttttaaaatccagtctaatctctttattttttaaattaagaggaggttaaaataactagtaaattatatttatttatttgtaatattgttgttttcattatccaggttgaaatttttaaaaattaaaaattaaaaattttatttaaatttttttatttttatttttaatttttatagatgcatactagttgcatatatttatggggtacatatggtattttgttataaggatacaatctgtaatgattaaatctgggtaactgggatattcattacctcaaacattaatcatttcttcatgttggaaacattcctggttcttacaagatataaaatttgagacattcagttctcatctctgcacaaatggatctgttttttctttttcctatgtatacaactagcactatagagccgttatctaggaacatctgttagttgcttaaaccgggtctcctagaatagtgtctctcagtattgttatatctgtgatctgattttaggaacttgttctttagtcatttattcccacctcaatccataagcaaaaaacacaaacaacaaaaatggactataaacaattatctgcaataaaaaattataagtataatttaaatatctggactaaggaaaggataaattagaagaacattagaaattaacatagcacagtataggccgggatgttgcactatttttcccaatacaacagtaatcaccttgaggtcaggggctattgtaaatttcacattctcctcagtatttgacatagaacctacatataatttggcactcaatacctacttgtttgtttcacttaggcaaaaagtagagcagaaagaaaatgtttgccttatgtagcatgaaacactttctttttatgggtgagatcatgcccatttaagaaccttgacacaattgcaaagatctagggaactgtaccattctcaggttgcttcacttcctggctgattttaaacacctggaggaatgaactattgaaaatcctttgtgctgtccacaattaagtttgggggcagcctcacaactctcagcatggatgctaatttccaaattttaacctgggcccttaagggatggaattggcttacctgatatctctttagaagaaatgaacttcaacgtgacatatattcactaattattattatttcttaattctgttaaaacataaaagatgaaaggctaaaatgtaattctaattggcaaaggaatttcataccgggaaggcatctcttgattagcagctgtgtaggcagagggagggttgggggtatggaaatttggctaagaattcacacagaaaagtgctcgatgtgcttcgaaatagctcaatcagtactcagcgtgctgtgaaagcgctcaactggtgctcaacttccagcatatttaaatgagtggaacgcttactttttaaaagtgctcaattgggagtgctcaagttgtggtacctattagttgaatgctaattaacttttccttttcatatggttcacttctctgttaagcaaacagatagttttgctgttcatgttttgaggttaaacctggactttccatgagacattaagggatttgtatttattttcgagaaggaaattataccatcaactattccatcaactatagcttttcctttgcatgctcttgcatgcacgttctcgctctctctcggtctctctctctctcagatttttatattatactcctcactatttctgagctttattgttttgtttgaagccattttgagaaaactaaaagagcagagctagatgtgttatttgatctgatatcttttattcctgatacataggtttggtttttcccaagtgtcttttcaatcattttgataacactgctcttcagaaatagttttgagctttaatttgagtttaagaaactgcatagttttgtgctatgtttctaaatgtccactttcacctttgttgaactcattactatcttacttttttaagttggaaagatgaatcctgtaatttggtacataataaagacttcattaactaatctgtttaagattgaatttgagctatatgttttgagaatgcactttgggaaaaaattactatgactttcaattatctcactattgccatgaattaagatgaagatttaaatggatttttttttctgtaacttcagaatttctttcctaggcagatgctgggcacattgtacagcattgcacaacatggcagttgtgtcctatttcccctaattaccaacagaaagctatgcacgggtgaagaaagccttaggaacatgctcctataaatggagaaaaaagaatgccaaagctttacctgtcaaaatacaaactgtcaaagactgtatttcagtttaattcttgatcttctataatgatgtggcaagctgttgttcaaagtaaaggttaaggaatatttaggcaaatagaaaagtagaattccatttgcttcacatagcaactgaaaaagaagaatgcatagtctcacttttagggtgaataaaatgtaattttaattagcatctaatgcaggattaatgcattagcctcctaactcatctcccagttaaacacattctaagacagaaatgcctttcaatatatgtcattgaaaggccacattaggacttcttaggctggaagtcattgaaaatgtgggtcatctaatgcccctgttctgatttaggttctccaaaaaccttctgattttaattggcttccatataggtctactgtggagaaagaataagtgggtcagatgaatattgtttagaaaataagttagtcatatttcagtatatatgaaagacttacaaatctcactgaaaatgaagaaatttgtaccatggctttgaattgcgatctgaattttgtaaatgtgaatctgaactgagtaatgggatggtgcttagtgttctcctaatagcaattttctgagtctacagtcctaatggcctgaccttggatggtggtgaattcactaaggtaataactatcacaacatgaaacctctttaaagaaaacttgctggatatcaaaattctgttttaaatttttctctttgagtttaaattgaatttctgtggtgttttcacaaaagtgctatgctcagttttatgaacataatgaacatcatttttttttacctttatgcaaatattctcagccactattaaggcattttaatgaaaattaaaatttgattttttagcaacttgcagtagcttataatgataatattgaatcaggaatatattttttgcagaacaaaatgaaggaagttgggtagtagaggtcccttcaccaattctacccagtggctataagaagcaatactgggttattgctttgctgtaaaataagagagaaatgtatgcctcgttgcccctcgctgtttggcgtattgaaacttgcctattaaattaccctttactgagtttcaccgtgctctctctgaaaataaaagctaattcagctttcctatatttatgataatgaaaagtaatatctaaagtgggggtttactgtgcaatcatacattcaagtgatgtatttactttcataaactaaagaaggtatttaagtggtttgcattagttttaaacaattatctttttgtattcacttgacctagttagataatgatgtgcaaacagatttgatttaataacacattagtaaaatgttcggtgaagtcttaaaacaactgcttttaatattcctgaacaataggaggctttgggttcagtctcctgtgaggtgtgtggtgcttgtttgcaatcagctctgacattttcagagtcttctactacaaagagattctattttgaaaacaattattagggagcagctgaatgtgtatcctccattgagcactaagtttttgttgttttcagttgttggtggccaagattaagaaatgattgagaaagcttccgtgtgtgccatttgatagttatacaagataatactttttcactttttaaaaatatctttcccaaattgggattttgtaatgtattaatatgctaatgactgctatgactgtttgtgtccttcctctactgtatgatctgctttctagttgaaaattaataaaggctcccaactggtccaaagttttcatcaatatgagcagatgttgctattgtttgtttggctggagcatttactttgaaagatatgatctgagtttgaaaataaactaagccctagtcctatttttgtacagtggcatcaggaaaatattttgttttgtttttatttcagtagaaaaccaagaagagttaccttatcaattttaggatgtgaatttcagaaagaagtcatgatggtgttttgattttattcttatatcaaaatcctgccaacaataacaacaaaatacttattatatgtggatcaaatgacaatgaacttaccactgctttttataaactgtgtggtatgctaaaatttccatcattttatccattttgtaaaaatttaacaatcttgtaatacaaactatatgccactattcaaattaattacaggttcatttaaacatcataataaccccacaggataattactttactattattatgcccattgtatagataaataagctaatgtccaggcggttgtatagcctttccaacgtcacaccacagatttttaactcaggcaatctgcctccgcaggctgttcttgtatctgctaaactatcctgtgttaaaaattccaacagttattgtgtgtgtgtgtgtgtgtgtgtgtgtgtgtgtgtgtgtgtgtgtgtttaattatcctaagaatgctaacctcttggatatttttaataagtccttgctttaatggtaagacagtggactttctagtagtgatactgttattctttgactgaaaatgtggccaaagcttctgaggaacatatatccaaaagaaagagagccttccgaggcagctggatgacatgacaatcctgaagatcaatgagatgaaaatgtcatactgccacattcatttcatttaacctttaagtttaaaactttcaatgaaaaggaatcactgaaaatgttagcatatagtgtaaatactgaccagtcttgtttattatcttacataaaaataatttcaataaattgtatataaatgttatatatccattatatatgtaggagaaaatgaattctaaaggagaaacaatagaagaatctgtggttgaggcaaatttatctctttaaagatactttattgtttagaatcaactatagtactaagtgaatacgacttaaatttgtgatttaaggtgattccacaactgaccaagacatcagggagataaaaggaacaatgatcagtagggtataaaatactatccaaatcttaaaggcaaggtaacttatttcatcttgttaccaaaaatattaaactcttgctttcctttaagaatatattcataagcaagaaaaatgtggcctcttctattgcatagtttataatctaaagttgttgattatggcagacaaaaattaatatagaagtgtaagtacatatagagaaaacaaaatatataattgtttaaaatcttggactgtatgtcagtagtttaaaattctaaatgatgaaattaagcttataactgttactcttgtagccagttgatattcgccaagtcatgcttaacccttctcaaatttcagtaggaaatcaatattttgcagtttgctcatcttaagcagatggttatagcaaaacctcagcttgagtttatttatccattgaacttctggggaaaaaattaatgcaacataaaatcaaataaatatttgaataatttttataggcattattatgattactatgcaggatgatgccttgcccttgagaaatttgcattttatattaagcaatcttccattttatacgactgctgcttgagatgacacaaatatatcacaaggacctaatattttaggcctagaaggaacctataggacagctctgtcaatatcatctaagcaggtgacaagcaatgtcatatctatttagtgaagcaagtaaacagaaagaggatttcaagatagaaataaaaggtacaaggatgcacaaatgaaccttgtatgtggtttgagatggcaataggacatgcaatttaggctatcttgtactgctttaatattaatggatataaagtatattgtacgtgaaacaaatgagtttcatctccatgaaactgaaaatatcatgggggatgttttaattatatcatcttctgtaacattttatcatgaaatcaaaacatgtgggaccactatattttacatttatctacctcaagagtgatgtttccaaaattaaaacacaaatttattataattaggaaattaagtgttctttcagaaactcttcatgtattttgtaattcacatgaagttgagctttttgattttgaacataaaagtctagcaagaattttttcttcgttttttttttttttttttttttttgagatagggcctagctctgtcacccgggatggagtgcagtggtgcaatcttggcttattgcaacttccacctcccgtgctcaaaccatcctcttacctgagccccccaagtaactgaggctacaggtgtatatcatcatgccctgctaagttttttgtatttttggtagagatggggttttaccatgttgcccaggctggtcttgaactcctgagctccagtgatccacctgtctcggcctcccaaagtattgggattacaagtgtgagccaaggcactcagctgaatttttttcttaatttagtataggtatttgagtttgtttttgtaccatatttatgttgtaatctacacacctaagaatattatggctacatgcttatattatgccccttgtgctctattacttatgtttactacttatgtttgtaccactaaagcttcattaaatctctgtattgccccattacagcatatccagccaaaatatttaatacatgaatttgcctcttataccctaatctaattgctaccctgacttcctattgtcaaattgactcattgaatcttgtcttcagatactgctgtaactactccctcagttaattacacctccagtcattcaatttttcaggccagacaaccgataatcaccttttctcatgcctcacacaacttcactgttctcacagttctcttcctatctctattgccattgccaacagctttcttaaagtatttgtgagtcccaagtttcttttgtgtggcttgttactttaggttgctaactgctgaagtctaacttcccttcaaaactccttcctaaataatgtccaaagaatctttctaaaatgcaagtaagattagatcactcctttacctgaaatcgggtcacagttgtttatcatctttatggtcatctccgtactcctcagagtggcatacaagtcctttctactttcatctcctgctattctttcatttactctaaacattttatagttctctgagagattctctgctttcctatttatccttcaagactcaggttgtataaatcaggctccaatcaaaaacagatttcacactcaaattacagtatctcaagaagagtataccacagtgaatctgtttacaaaagtttgggcagggtgtaagtaagacatgaatgttaatgcaattatctaggttaacacaaaaagtaagagctattacaatcctaaacccagaggggtgaggggagacagtggttatctgaaaccagaaggaaagacagctctgtagtaaaggctgactggagaggatcagtgaccacaggacatagcaaatttgcaggcagagggccaggggaatcaatacactgaacacattattctccccattggctgaacctcctgaagtcagaggcttccatagggcccacataatctgccaggtcaggaaaccaggggggatgatggaggtagatctggagagctaatagaaagtttcctaaaacaaatctgttttagattctccccaagtctagttagaaacttcctcctttgcttttccatagtccatactgtcctattataacacttgtgttttatcgtaatcaccttttcttggtctgtgtctttctagagcacaccacgtcctaaggcccccggaagacttttcccttacccttccattccaataaacttaaatcagcatcaaatattgtcttttatttcactgaggccctagactgtacttttgaaacacacacacacacacacacacacacacattcacacacagacacacatagctgtaaattattgtagttacttgcagaagataaaattgtacaactcaattatataatgggaaactaaacattatgagaaacagttaatgttatgaaaatgaaagtatataaaatatgtctggatccttcttggggtgatcaagaatgtttgtaacaatattctaagtaattgcacatagcatataaaggaagaaaaccaagcaacatgccgttgctctctaataaagtataaacttgaaatagatatatgcaaacaaaaaatatgaaacagaagttacaaaaaaagtatcttggatgtgccaagtaagggtttgatcgtctctgccatcccttaatctccattggaaaccatatcattttctttcttttcttttcttttttttttttttttgagactgagtctcactctgtcacccaggctcgagtgcagtggcaggaccaccgctcactgcaagctacgcctcccgggttcacgccattctcctgcctcagcctcctgagtagctgggactacaggcgcccaccactacgcctggctaattttttgtatttttagtagagacggggtttcaccgtgttagcccggatggtctctttctcctgacctcctgatccgcctgcctaggcctcccaaagtgctgggattacaggcgtgagccaccgcgcccggctggaatccgtgtcatttttttatggacagttggcatttgctcaattttatgtaaatgcaataaaaatacaacttcatctattcctccaatgtatacagtaccccttacctcacgtaccctctgacatagaaattctgaagttgccattagaaatgttactgatacattacaaataagtcaaggatacagtgacaataaatatgatagaaatttgtatagtcaccttaacttagtgttataaaatatgtcttctctgatactaactttgtagcatgttaagcaaatttcaaaatattgaaaggtctatgccaatcaatacatttcacataaatacagcagtattatgctctaggttcccagaatacataaaacttaatggctagacatgttagaaaatattaaggtaatgctgtttttgcactggatctcattcctatccttgagatgtcatatgtttcagtaaggtcacagaaaaacctcacctcaaatataagattatatccatgtcacattttgacaaactgttttagtctctggagaactgtctgccttctttatctacaaagtttcagtacttctgctggagaaaatgcatttaagttttcccattttccataattcagtttattttaatataaagttttgttttatattcaggttactatattgatatgtttctgttatttattactattttgtagttctatttattttgtgttattatttcttatcattatatattttagttttattttccattgtgtttaattaataggtatctgaggctgattttagatttaaaattacatatgtagtctttctcccttgtttaaccttgagataagatttatttaaacaaattgcatatgagctactcctaaaccaaataagtttagttttgtgctataacctggaagcttgataaagtggatcctagatcctgatatcctggcagttaccttgactcaaaaagtgaggaagtaagacccagcattcagtttcaagcctctgagatatcatcatgaaagaagaaacaaaagcaatgatgtctgtatacttaaaatagaaaactaaggtatacagggtattctttaaagcttttgaaaaaaaaagtctttaaattatgtgttgaaatgattacaaaaatttataaccactacagagagctgccaagttcatttaagattgattaaaacaaactaacttatagtctggatctatttatctgaggaaatacatttttacctgacactggacacatttaaattactgatagttttagctttggaacatggcttgtgaaagctcctgtcataacagaaaattgtgcaatagggatttaacaggtttttttgtagcattgtgctatagcatgaatattgtttgtgcttattacaagtttctggtgatcttgtttgactttcctacacataacaagggatttggacagttggaaaatctgtacaaatagtaccacttgtggtttaatatttaaaacaaaatactgtggctgcagtgtgctggcttatgcctgtaatcccagcactgtgggcagccagaccagcctgggaaacatagcaaaaacttatctctacaaaaatacaaaaattagctgagcatggtggtgtgtgcctgtggtctcagccacccaggaggctgaggcatgaggatggcttgagcttggaggtggagattgcagtgagccaagatggtgccactgcactacagcctggttgatggagcgggaccctatctcaaacaaacaaacaaaaaacctacttctcttttaattttccctattgtttcattgagagatgtattaatctatctgggctgctatcatgaagtgcccagcttataaacaacagaagtttatttctctcatttatggatgctaggaggtccaagatcaaggtgctggaagaaatggtgtctggtgaggccctgcttcctcagtggtcatctttttgctgtcacctcatatggcagacggggtgaacaagttctctggagtctctcttataagtacactacaccaaataatgaggcatctaccctcatgatgtaataaccttccaaagtttctgtctcctaatattatcacctagagggttagaatttcaccataggaattggagatgacacaaaccctcagatcatagaaagttatttttaattgccaaggtaacaattataacacagtcatttctggtcgatatgtacttgcataaacaagacttatttttcatgctattcaaccacgtcagaataaagaaacagactgaaaggaccgtgaggtttctaaacaacgactgtggttgccacatgtgtatcaagaactgtgaaggttcaatgtgcaagctgaaaagtttgctggatactgtttaataaacaaaggaagaagacatacgtctcctaggctggagagagagaattttatttttcatagcagtggcagcatccatagtatcagcattcacgttggtttcacatatttcccaggtcacacaagagacagggtggaggacccaaatggatacacaataggtttgcaacacagttgagaaatctgtgattaggaaactcaaatcttttataataggctgcaagaaatcccatgtcttgccccagaaggaggcagtaagcaaatctgccttttgctgtagaagtttatctaagaaaatattagctgaattaattctatatattttcttatcagattgcattagaaaaaaatgttctgcaactataaatatatgttaaaaccacttgttgaaacaggacttaaggacacactacttagattaaattattttgcattacaaccaaatattttactcttaatcaccatgttccttgttaattatttcataaatataacagtttccatgaaaatcaaaccatcctagtgacagtcctgaatatgaatatgctctgttgatgccacttatgttatcatctttatataggaggccaatatggcatggaataaaggagataaaactatacatattcaataaaattgtagaaaagaagtttcctaccatgttgcatgtgcatgtaaatcttagttgcttcttcagccaagaagtttgaattttgatgaaggtgaaaatttggtataagattgattattacactattacattccactttagaatagtatatctaacttcttaatttataaaaaaatcacatatatcattaaactcaactgttttatttaatgactaaattttcatttatttaagacttgaaacaagtatgaagactttctaggagcaattatgacctaccttgactgctctaagagttttcagaggattattctaacatctaaacacaacatagatatctgtgaggggagcaaaatacatttcgtttgcctatcttttatttgcattgcatatgagccatgttctaagtgatttttttttctatatagattttaagaagtttttcttaaaggacattacaaatttctaagccactcactccagcacagttcttaggaatgtaattatgaacaactaaagacaaacgttataatgtaatacatttcctctaatgcaaaattagcatgcatctgaattacttggagggttgggcaaaacatggatttctgggccgcaccccagtttctcattcagtcatgccagataatttacatttctaacaagttgccaggaggtgctcatattgctggtctagggaccacactttgcgaacaactattttaaataaaagagactcaagatgatggagatgaagctgatgaagatgacagtagcagccaacacaaactaagtgctgtcctgttacttgtcagtttgctaaattctttatgtgcataagctcattatgtgttgtgattatttttaaggagaaaactgaagctcaaagaggttagacaaattgcccaagatcacaaaattgaaaagcatcagagctagtttttaagctgaggcttttctgacaccaaatcctgtgcttaacaaagaatagaaataactgcagtccataagggcctttggctctacaaagcaggtgggagagatgcactgtgattcaggagagccaggcacaacctgtggttcctagtaaggggtgagaattttcatgtgtaggaattagcccttgaaatctaagtacttgaataagtcagaaatagcccaaagtcataaaaagcccagaagcaaaacataaatgacaggataatcaccaaatcaggtcagaaccagggtttcttcatagttttaatatttaaaaataaatggcttctgttgcttaaacaacaatatttcttcatcaaaatactggagactgaaatggtgtactttctgtgctttgtgcccaataaaagtccaaaatgatacatttgctggagtacccataaaaagcaacattaatcatctgcttgcagagacaagggcaaagacaaagtatcagggaacagtgggatctttgtggatgagccttaaaatctgaaccacaggccaaaacaaaaccatctacctttacctttaccgacctgatttctgttccttgatcataccaagcttgtttctcacatatggacattacaatagccgttttctcttcccagaatgctttttattttagtttttacctggctggctccttcttgctattcaggtcttaaaagttgcagtctcagagagacccatctctgatcacccacactttgtagcgcttatcacagcatgttgcaccatatattttagttacttatttgttaattatctttccctccaaccactacaatgaaaactctgttacgaagggaatttttgcctgctttttactactatgtttctagcacgtagagcagtgtctaacacatactaggtattcagtaattatttttttgactagataaatgaaggagggaagaaaaaaagaaaacagacattgtagtagttgaactcttaatttgttttcattttaattattttttatttatttatttgtatttgtatttatttatttatttatttttttttgagacagtttcactcttgtcacccaagctggattgcaatggtgtgatctgagctcactgcaacctccatctcccaagttcaagttctccagcctcagcctcctgagtagctggaattacaggtgcctgacaccccacccagctagttttgtatttcttttttcctttttttttttttttttttttttttttttttagtagagatggcgtttcaccatgttggccaggcttgtctcgaactcctgacctcaagtgaactggccgcctggacctctcaaaattgtgtgattacaggtgtgaaccacagcccacagcacctggtctactcttaatggatgattcacagggttttcatgccccaaatttgtgcatgcacacacacacatacacacacacacacacacacactttatagtctgtagtgatgatcgaatgtcatgcagttatgtaattatattctctctagtttttgcccctcctcttttccctcaatgcttaaaatagacaaaggtatatatatacacaatatctttgaaaactgcaagcaaattcccagttcaaaatttgttcaatttttaaattagattaaatcacccttgaaagataattcactcagctccaggaatagtatgaattatgtagaaggcctaagactaaatattttaattccacatttcccctatgtcagggaaaccacctaaaacccaaccgcatatttatattcttgtaattaattgcagactaattttattcatgaagttatatttgaactaatagtgacatcgagagttaattctatttggcagtgtatttggactttcatttggtatagaatttaaatcaagggatttgaaaataaagttaagagggcaattcaattttgataaaaattgagtcaatgatgaaagcgcatcctgtaagctctaatgtaaacccagtctttgaaaaatatcatgcatggtacttggaaattctttgaggaatgaaagcttttcatgtgtgatcttcttaaaatggaatttacgttcaaattcaatggacccatgtgcacaaagagtgataatgcatctgaagagtctttctggattctctgtgtgagtgcacttgcatgtgaagagagaaaggaggagagagagagagagaaagagagaaagaaagaaggaaagaagagggaagggagaggttgttaaaggaaagagccactacaggtacctaagtgatttaaaaaaaaaaaaatcttatacttataaatattgtgcacttagtgtgtaaataaaatgttttgtaatgcttgttcagctactatgcttttcattgggattaactagacatcattcaatatgtttcatttgtggcttttaactcatttatttgctcacttaaaaaatattgagtatttaccatatgctagtttctaatctgggtattgggaatgcagctaagtattttacttccttattcttacataattttctaaactgaaaagaagggaaacttgtttttgaatgtagaatgattgaaaatataatgagattgaatacaaatgtattccgtaaaggtctatgccatattttttggtttaacattttactgtaatgaaatttgatgaattttttaacgtacttataagagatcaagtggaattttttcagtaattttgaataccaatcttagaataaagaatagacttttaagtaaaagtagtcaaaggttacaggcatttatattcaaacctacagtgttatcagtgcagcagagagaatcaaaaaacaaacaaaaatcctatacttcttatttgcagggaaaaaaatcaacaagtgagttgtagtcttaatgcctaccattctagaaaaattactaatggatgatcaaatattttctctttgacctacatgatacttgacactttgtatgagaaaaatgtgtactcagattaaatataatctcaaagcaatccttttaatttcaaactttggaaaagaaaatgtacttttttttgaaatttaatactcatggaaaaacagaaatagtgaaactagaaatgtgacacaatgctgatcacttcttgaagtactgcttctaggatgtgtgaggagggaagagaggacattaaggctgcttgcttcatgctgtgagccattagctgattgctccaggcttcaccaccaacagcagaacagaaggggaggtggccctgatgaaagggaggaaagaaaaaagacagatttattgtcttctctataggatcttatttccattctactccagtgctcttttctaagacattaaataagtacttaaccctttactatttacactccttatgatctgaaacactgggaaggtatttatattttgccttgaaacatcattttaaaatgttttacttttaaatgtttattgagttgtacttacaaatgttaattatagcttcctaaagacaggaatccaggaaactggatttctctatagaaggattatgtaaatttggttcactacaggatgcattactagcattttgaaaatgcctggtacatagcaagtgcttcacaggtgttacctgaatgaataagtggttgctatcttttgtttgtgacaaaattgaataatatggaaggatagaagccatgatgtgtggcataccaggcagcgtacaaagttaaggagtgtaattgtttaatgcctaatgcttaaatgacactgaccatgattaaaacccagctgacatctgccatatgcctctgaataagtgagttaacttttctaaatatgttttctcaaatgcaaagtagaaataacactactgccaacttcataaatggcacaccaataacactcatacactgagaccttagtataaatcttatatattagtatcattatttagagtggcagaacatagcccatacatagaagacaaaaataatctgatcatgaaataaaaatagaagagaccttgcgtgaaggaaaagaagggattcaaaatgctttatatataataattaacttcaaaacctaattcttctttatgtattttatggcagtaaattctgtattctcaattatagcatattaatatatctccaaattaagtatatttattgaagcatgacttaagtgaggattgtttaaaatgcacaaggaggtattagtttaaatatgtttattcacgtaataataacatgtataaataggctagttttattcataaatatctgcagttataagtaaagttacttataattccattacagtgttggaatagaagccctgtgaggacagggattttgtctgtttttaatggctatttgtctagtgcctagggcatatcctaattgtggtagatatgtaataaatatttcatgactaaagcaagtaatatagaaacattatatatatttagattcttggaaaagaatttcagcattgctagtacaaatcgatttcatgtaatctcatgacaaaggaaagtttggttcccatatcttttgcttaggcaaatggcatcatgaatttatgtttcagtaagaaatagaggaaacagtcattattttcagggccccattctgttgactaacaattctacacagtcctgaggaaattatgccactagtttgtgacccctcagcagcagatcccgtgtgacgctgctaagcatacattgaaatacaaacactgcttatataatacttctggatcaacaatgcatataaaattcaaaatctccattttcctctcacaggtgctaaccagccacaagggaacctaggacaacaaggaattcaaatattgtcttataagtaacaacctggtgccaggcagggtggctgacgcctataatcccagcactttgggaggcggaggcaggtgggtcacttgagatcaggagttcgagaccaacttggccaaaatggtgagaagttgtctctagtgaaaatacaaaaaaattagccaagtgtggtggagcgcacctgtagtctcagctacttgggaggctgaagcaggagaattgcttgaatacgggatgcagagattgcagtgagccaagatcacaccactgcattctagcctgtgcaacaaagcaagactccatcaaaaaaaaaaaacaaaaacaagtaacaacctggatgtttagcttcaagaaaagcttttatttatgtatttatttattagagacagggtctcattctgtcaccaaagctggagtatggtggcacaatcataactcacagtagccttgaacttctaggctcaaatgattctcctgcctcagcctcccgagtagcttggactgtaggtccatgcaacacgacctggctaattttttaattttcttgtagagatgaggtctcactatgttgaccaggccggtcttgaactccttggcttcaagtgatcctcctgcctccacctcccagtaggctgggattacaggtgtgggtcactgtacccgaccaccaagaagagctttgatagtcacaaagatagtcttcaaatattgaaatcttatcaagagaagtatccattggtcaattttgcacttcgacagagggcaaactatgattacaagtaaaattaccaaaaaagaaagtttcaattcagtgctagaaaaatatttttttaagagctagagttgccccagagttgaataactcatctggtcagttaatgtgacagttaattctgagtttcagattttctgggagagtctagttgtacatatttaaatgttgtatagtgttttgagtggaaaatttaaggaggtaatttaagattacttttattaaaaggaatgtagtatcaggctctagtacagaacacctttaacctaaccattatatctattatatattaataggattacaaacatttcacactgtacataaatacacaaaacacaggcaataattatagtgtggacacaacaggtagcacgggaataaggagaatatagggtgtgagtatctttaaatctgccattacatctggtttggcccaaatagtctctttgcttataagtgctcactgtgcccccattggcacccttaggaggacaccaagtaggggcatgagtttactcacccctttcagcagctggggagagttattgggccagagagcctgttctggccagctctgcatgtaaagaccacagagatgcagctggttccatctgcatttttcttagtgtctgtgtcctctctgaaatttgtgctcccttgtccctatttgagaaatccctgcaagtggtagcctctttgtcctgaaccctggacctctggctgtctcagaagctttgcatcctggtctagggcatgtagaaactctcaaacccctgaatattacccacagaaatacagtcagaggtcgggcgcggtggctctcgcctgtaatcccagcactttaggaggctgaggtgggaggatcacttgaggttaggagttcaagaccagcctggccaacatggtgaaaccccatctctactaaaaatacaaaaaaattagccaggcatggtggtgcacacctgtaatcctagctacttgggaggctgaggcgggagaatggacgtgggatgcggaggttacagtaagccaagattgagccactgcactctagcctaggtgacagagtaagactcctcaaaaaaaaaaaaaaaagaaagaaaaaagaaaagaaatacagtcagacagaagcactgcctccagctcatatctattcctgccttctgtgtcaccatccctttcttggtgttaaagagatgtgagtagagatttttctggaggctgtcatctgaggtctggtatgcctggaaggggtgacttgaaaatctcaaaatcccacatactaaaaacaggtgcttctatctgcctccccatccttttccatccccttaacctcagaattgcacctcaaaaggagaaatatgaaggcatttaactttaatctcatctccttcaacaggctcaaacttcaaaccagcaataagggcagaaattagacaccgccttctttatattaaaactatgtgataaagtcagccagacttggttcttaataagggtaacaaaaaatagattaaagcaaaatatccaaaatattatagctgtgacacttacaaactatgaatagaagaaaatattagaataatagtgatataaacatttaatttcataatctgagtcatatgaaatataccactgttaaaaatataaagggacatctcacttttcctaatacatgtgaaaaccacttttttattttgaagccaacagtgccaggtcacaatattgtttctggagaaaaaatgattttcatctctcaagatgatattttaatccaataatcacattaaatgaacttgttttgtgtgtctcgatgcacagtaaaataaaaatgtgtcgttgagttctgaaattcttaatttaaatttaataaagtatgcatcagattttaatagacatgaatcagcctcaatgtaagcagtcttcatatagaatgcaagctgtttaatttatttttgcctgttctagtttcacgtggtaaaatactgtgtatagataaacactaatctccaaagtatgaaaggaataatgaacattcaaggaagggcacaaagaacttcagaaaagcaatcaaattttctttgtttcagcttacagagttagagtaaaaatacatacaaaataatataattaactcttcacaatgtaattttaaatctcaaagattaaaccgaagcattttccttatggactatctaattctttgtttactaattttaaagtagacttcaccaggtttggtactttgctttgtgaactagaaagtaaacaataagcaaggcaaaaagaataaaaagggagaaacctactttaaaacaatctgaaaatgataagcagaggtggttgtttactcttgatttaaaaacatgaagacaaagagtacatgattgcttttccaggaaaagcatgagatgaaataggcttgagatataattttactagaaatcaaagaagtacaaaatatttataattaaccacagcttaaattgaacaggtggatacatactggttagcatgttagctcattgtgtatttaaagtttgttaaactatttattgctgcttcaagccagactctggaaccaaatggtgtttgataccaacccttcattgtcatgagccgtgatagtaacagattaagaactgctttgcatggctaattctgatagatgaactgttacttcaaagctagcagtaataaagtctaatcagatgtttaggaaatgttttagatatttcagagaaagggaagatataatttatggccaggaattaaatggtgcaaaggtgttcggcagttataaatattaccttggaagcatagtttaaaaaaatcctgatgaagataaaaagaataacatgctcaaaacaaccaacctggttgtccatgtttatcagtgtttacttggaggaagaccaataatgttattttgtcctgatatgtcctattaacatttgttgtaagttactttaatgaaaacaaaggaagcctaaatatgaaattaggaaatagatccccaaagtgattgaatattctttgaatagtaatctatgtctaacctatttagataggtggaaatcaaagactcaaaaaagactggaggtaaaattaacaaaataaatacaaaattctggcctcctatttcacataagatgatacaccaagaaactggagtgatcttccacttaaaataactaacagttttatgtacatttttgaaactatcttcagaaatacttccatgagctggtaaaaacaccctggccaaagtcaaatggagcattgaatcggactttcattttgagggcatttgccaaatcaggtaatttgagtactgatttttgcaggctttcagtactcagaggacaggaaaaaaagcccagggctcgcacttgcaatcagagaagtggcagagactagctagtcagaaagctttttcatccttttcctaagcatggtggtgaataatatttcctggcatctcctgagttaggtagcagtgaggcagctgagttctagccgatgtgctatgaatgaaagtgtcatatgctcattccaggccgggacatagcatgagttttctcccttcaacagatccagtggtcatgtgttgaaggtggtagtgtcccagtttagaaggaaagtgaattactgactcaatgcatagggaagagccatcctggagaattccggttctccttaataagttcttatgtataactgattttagttttctcattttatgtgaaataattggaatttagttctcctaagattcttccagacgcaaagttgttggttttattttggtaagaacacatagcatgagatctaccttcttaacagatttttagatgtacaatatagtattattatccacaggcacaatgttgtactttagatctttagaactagtatgtatacctctgacataaaatagacacttggtatttttgaataaatagtgagcaaatgatccctaaactgccattccctgcaaaagtgtcctctatagcagctattcctcctattaattaaaattctattccttcattgttaccaactgattagggtacaagttttaggaaaataataattgaacaaattcaccctcaggagtaatgataccagctctacagactgatcaatattcagttgctatgcaccagcattgcttacattagttgttaaagtattgaaatattaccataacagttcataaatatctgcagcttcaaaccctccagtatttctccccaccaccaccctaacacctttccagagacctaagattttgtgatcatagttccttgattccacaactaaaagaacagtgtttggtgtaaacatccttttccttcttagcatgaaatttataggctaaccttgcctttatctcttctgatttgttggtgctgtcacactagtggttaaatattttgaataccactcccggatagcttggctaaaccgttaaacaatatttgtcatttaaaatcatctactaagcctagatgaatctcttagtgcaatgtacagtaagtaagacataattttttatataataattcttctaggtaaagaaatatcttaaaagtatctgattgaagaaacaagggggtgtggttaataggcatttaatgagtatttgtgaactttctgagaaacctcattatcttctctctgtattcgtggcaaaaaaacaaaaacaaaaacaaacaaacaaaaaaaacaccaccaccaccaccaccaccaacaaaaaacccttttcctctactgcaattctgcctactcgtattccttaggaacccattctctgtccttcttctctcactttataattatctgtaagggttctcatccagttcacctgatatctatttttagatgatccttacatttatatttttttgctcaaaactctcagttcagtattttaacattgtattggtcatctttgcctgggttcctacaatttaatattttcagattacctacatagaggctccttggtggtctagtggttaggattcggctctctcaaataacctgtgtattcccagtctcagtgattggcctgatgatcctccttttagactaaacttgaaattgtatattcatgatctcaccttctctttattcttctttcattcagttattcaccaagttttcttaattctgcttcctaaatatccttgaaatcatgttatatcttaattcccactaccacatgaggatgttctagccattctgaaaaatcttcatgcctctgcatattctattgctctgcacagaaggccttttctcctccccaacatcttttttctgccttgcagatgccaccattttatccttttatactaagttctaaggtcaccattttaggaatctgtcttgactcctattttcccctggaagtcatttgataaacatctctattactgcacttaacaaattttattgtaatgaattctgaactaagccgacatttcctatactctaagccactttatccagtaaaactgaattatttggcaacagtttatccaggttatctaatagtccagtaagatgacgtaagaattagcatggctggaagatgatagctggaaagacactggagatacatgtacaaataatggagaagggaggggcaagcaagtttataaaatcaaaatgacttcatgtggacagagcataaaacacaaaggggacaggcaatagagaagtgtaggggaaaatacaggagagaaaaatgacagttacccaatgctgggaagggtagcgagggcatggggggtagtggtgatggttaatggatataaaaataaagttagatagaatgaataagatctagtatatgatagcacaacagggtgaatatggccagcaataattcattgtatatttaaaaatctaaaagagtagaattggaatattcctaacacgaagaaacgataaatgctcgaggtgatggatacccaattaccacaatgtgattgttacatattgtatgccggtatcagaatatcatatgtatcccatgaatatattcacctgttacatacccataataattaaaaattttaaagattatgaatgaataaatatgtatgaagtacttggaacagtgcctggaacacagtgttatatgagtttatagagtaaataaataaaacacattttatatttacctcttaataaaagaaaaatagagaggacttacttgaatacatatgaaaaattaaagatatggactttgtgttggaaattggtgagaaattagtaaaagattttgttagcaagagaactatatgatcttgctttttagaaatatctgtcaggcagcatagtgttggaatagattggaggggcataatagtaggaacaaggaacaataatccagttcaaatagatgggcgtgctcaaatgtcatagctgatagaaagaaagaagaagattcacaggccctttagatgtagtgttgacagatcatggtgtttggatggggagggtgaaagagagaataagcctgggattctggcttactagaataagactggatataatagacttattaatgaaaatgagaaaaacagagatggatactttggcaagggtggaaatgggtgggtagtgattttgatttagatctaatcatcttgaaggacatataagggatgcacgggagggatccagtagacagttgaatgtatgaacttagagcataggagagagttccagtgtgggttaggcagatttgaaacttatcggcctattggtggtttttaaaggactaactgtggacaagatgatccaggaagcaagtatgaagtgaaaagtcagtcactcttgtttgttgaataaaaggaaatcaaggatcagttctgagctgaggtgaggaatagaaactcaagtggacacaattaagcatcatataaagtagcccctggtcaatagtgggaaaagtatcacagagcacaaacaaaagaatgagactgtgtcctgcactctatttttcttttattttactcaatcccttctgttaaagtgaaattttgtcaccaaatgaatccagatcccatgtacctggtagttgtgttctcagtaagaagaaaatgtagatttcaaccttaagcctatctactcaaattcctgcttcatactcagggatgcctacattatttgtgagactcgaaacaccctgaaaatgtaggctccccagttccaaaaccaggaaaaatatgccatgaaaggtaataaaaggtaccttttcctttcttccacgatctcttcctctactttgattttttagaatgtcctatttaatgtagtttttaaaataaaaatatctaagttttaaaatattattaattttatcattcaacactatattgtgtagtatcagttttaagtgcaaatatgagagcatgtaactcacctgcagaatcaccaaaattatacaatttgtatttcatagcttcgacatgcatatgtctttcattcttactggaaaagtagaaacgctgcacaaaactagtttttactttatttcctgatacatgcatgttctatcaatactatctactcttttgctttactgattactaaggatgaatgaaaggaaaggaagtatgttcaccttatcttacctttgtttctatgttgtcatttttagatgcaaatactcttctgtactcactttgagacttgctgaactctcatgctctctcgctacaccagaattctgcttatgtggcatcataaaggctgtatgataatgaggcaacaaggaaagactgataggcatacatattatacgtatcttctttgcttaaattcatgtttcattgtcccatcagatttcacttacaaaacccaagctcaaacataaaattattaaaattttaagacagaaataacagagcgttaagccaagcatgactacagttgcacatgtagtgttattttaggacataaagaaagctatatgttaataaatgcaaactagtcatcctctattacacaactttctcaatcacacagcattttctttaaggtgacagcaaaagttgtcagttttgtttgttttcaccatttgtgagatatgtcattttgcagacttttctgccactagagggaaagataatttgtgttctctgctgcaattcgttatgcaggagctagggagggatagagaataatgtatgtttgtatagagagctgaagcagcgaatactcttcatgagaagttttatcattttacatttatccttgatatgtgccttttaaaacatgaaattcttttgaagtaggtgaagcctccaatagtaccattatctaaatctgtttttgcttctcattgtcacatgatagcttttcatttagtgtgatgctggggaaagagaaaggagaaggttgaatcaatttattagggccaggtacatatgtggttttttaaaactctcaatttctaccatactaccttaccttgcagaaaagtcatttccatatctgtcatatttgcattttttttgtaattctgaacttctactcctttgttaaataaatgattttaaaaccacacacacacacaaatacctacatctaggaatacaacgatctaccatttgaagagctctggagttcgagtttggcaaagcaattatttgaactccagctgtctttgacagaatgtggaatatgtgtagattattctatgaagtgggaaacctaagtctgtgtctcagatgagactgaatgaagaggtttacaccaacagatttgccaaacaataaatgactttataagacttttttttttcagaaggtgctgaagataacagtgctattaagttgagcttagacctgattctagactgactctaaatgttacatttaaaaaccactcatttttatgttgctttggtacaaagattcattggccattattcttgccttatggaattgtactatataattacttggcaacaatattttaatggtatcatcagtttgtgctttttttttttctactggtggctgagtccatgtccccataaaatactcctcgcaagctgtgctaaatttcctagcagttgcctggcctccacctacacagtggaaaagaatgaaatggcttgaggaaatagatgattgtacttgtactggtcaaattactaaagaatcaataaggccgactctgtaaggttattgactggcaggctaatctgagcccataactttacttccaaccaatgtttcaaggagtgctggatccaggactatctgtagaagctaagaatcatagtgctgagaaaagcaacataagattattgtattcaagttattgagtgtttttgagtcatccagtcatttgcttatattgcagataggatgctccttcatcatgcctattctgtctctttagtgcttttgaaaaggaattgaggatgagcaatctgccatttcctgtgcacctaaatttatctcatttatcttttttataataagctgatatagtaaaagaaagattactaatacagaagagtcttagctactgtaacacttagagaggattaagttttttaatttcattatttttcattttaaacactgaaaataagacagataagaatttttttccatctgcattttttttttttttttgcttttctgtttcagtgtacttctagagattaagttcttagcaaagacatcatttatttagtattatcagtacaaatcactagatgcatcaaataaaattgaattttgagttacaaagacaagatgggggtaggataattgtacaaaactaaagtagaattaattccattatttaaaaaatactagtgaatttctgtagctattttatttttgaaaaggcaaaaatatatacagtttgatcatctcattcccgtagaagtcactcacatctcagttgttatcctagaatgtgtttgaacttaggtattcattatgaaatgagaatagaatgagttatctatctgtaactcaaaggatatatagataatctttggcacatattttcacagttaaacaataccagataaaatacatattctgttccacatgggaaaactgtatggataattcgtgagttgtaaaacacaggccatgagcattcctttttggattgacaaggaaacaagaattgtgaaacacaggtcatgattattaattccataaagcctaaaatttgtacagtaatcaatatagataaggtaatatcattgaatgcttaagaaaaaattatttgaaaaaccacaaatgaaaaatacaaaaaataaagttttccagttcgtctcgagtcttaaaaaaaagtttgtttacttcaagagataaaagtgacaatagctaaacaaatataattttgttagtcttaccttattagcccaaatccaatttctttgagtgatgacaatgctaaaaaattgtgttttcagtgaaattggtgttctgtgtcctccaagtccccctctacctttgctttttggcaaggttcctttcccctctcctctgcgaaatcatagcactcaaaaagatactggagcaatctccttaggaagatcccattccgctgtctacaattaggacacttgttagccctctttaatgggataaaatatgggttcattctgtatcgtgtaggcatttctctaatagagctgttattagtaaattgtgggctcataagtaaattgatattagtgtggatcataagccagtagtatcactgtcacctgggaactagctagaaatgcatattcttaggcaccaagctgatctactgaacctgaatctgcattttaacaagatttttatatgcattaaaatttgacaacactttgtctacaccagaatggtattaacactgaatgatggccaagaaaaaataaaatgtccagttgcaaaactgcctcagtctaaagaaatgatgtatatggtgacagtactaggctccatgtcagggcaggtgaagctaatggctgtttaggactgtagcggtagcatatcatacagtcatcattttctcagtctttgacaaaagttattccttattttactggaaaaagtttacatcataatgcaaatttaaaaaggatttaaggaacagtacatatatttgcaatgacagagaaagggaaagagagagattctgagaaacttttatttaagccctagcagaattttgacctcttagaaatcaagcaatagaagtatggctttgcctttaacttctgaggtttgagcagaaatgtaattttccagcctctcatcatttctgtgacctttctgaatttcttcacattcttcattattactggagtttagaactgagtatatctcactactttcttaggaaaggccttaattaatatttgaaggaatttgagcttctaattcccacatcctttttaatgccttattttctattacagctgtgccctaaatagtttttaaataattagctgtacatggtaatttatatttttaacaaacttactacataattatcgttcatgtggtctttagaccagattttgaaatactgtgaagattaagcaccagactcaacactaagattttcagggtaaaaaaaataacaattttaaaaatgtgtaaatcatagtttttatgtgactgaaactatcatctccaattccagtttgccttataagttttatttttaatatagcaaaattctccccccttcctgcaatttttgcagtgtaaattgtgcttactaaagttaaaaatattttaagtttttaccaattatgttttcttttatactttaagtttttcttattaatatctatagttatttctaattttttatctcataaaatctgctggaatttaatttttaagacattccaatttttattttgactatggcagcaatttagtcaatttctaatatatttccaaaaaatgatctccctaacatttccagaaaagccttgaaatcctaataacatttctttggaacaggccagttgaggtttttctcatgatgatcatgttaggactgtcatagtggaaagcatcccatttgaggaaagccctccttattctttgtgaattttagaaatttgatctctgaatcctctggaatgaaaaaaatcttaggcagactgacagataacaattttatcagaattgtaataagttaccataaattaacactgaatatgaagacagtgcttaattaaattgtatatattcaaatacatttattgaagaattaacgctgaattaaattagttacaattttcatgcctattagtgacatagaagctcctttaaaatataataaacatgtcagcttaccacatagtagtttcttcaaattgttgagatttaaataaggataggcctgtgttagcgaggaataaaaatattgtgcttcagctcagtagcttccttcttgtgttttctttatatcagtgtgtgtttgtatattcctttttaacaactttataatttaataaaatcttgtctgtaagcttagcaacccataatttatcattatacaactggactaatgaatttattttacaggtacatcatcaacctggaatcatttttgtctgttacatacattttacatgtagaattccttgaaatgttaaaatgtgctatctggagaagggtatcctagaaagaatgatgactgtaccaataattagaaagaagcaagaattttgaaggaaatatgaggagttccatcttcatcatggtcaaataagaaagataatagaacacccaagaggcaatatgagacagctcaaaacacaatattgaatgctgtgcaagattaaatgaagagaaaagagaagggctggtattcattcatgctggcccacacaggaataaaagcacttaccgcattttctagagcataatagttttagcaactcttttgaatctgcttctttctgttttatacatttactttaaaacacacatcttggaagtatcctcttttttaaaaaatcaaaaatattccatggtaaataacatacacattcctttcaggttgtgtgtatacatttgttgtaaacaaatatcttagaattaatattaacatttttctgtcaagatgtgttatttaaatacatatacaaattatatgtgtatttaacagccccacaatgtgatttaatttttatgtgcattaatctaagaacattatggagcatataaaccaaaatatcaagagtggttatctcaagacagtaagattataaatgcctttattttccacttctgattttttttttgtgtatatatatatatatatatatatatatatatatatatatatatacactatatatatacatacatgtatattttctctctctcttttaaatagagacgaggtcttgccatcttgcccaggctggtctcaaactcctgggctcaagtgatcttcccacctcagtcttccaaagtgctgggattacaggtgtgaatcactgcacttgccagttttttttttttaataacaagaaaaaaatttagcagaatttaaaaaaagagaagtagttcaaaatagacatttcttatgactgtatattttttatgatgggctgtcattaaatatttagccaaaaaaagaagtaaaaccatatgaaattttaattacttaaggaacaatgtcatgtaacattggtaggagtggctactagtctggaaaataagtttgggcagaaatagtagactgtggcttaatattaaggctacctgcaaatgcccctgtaacataactagtactggacagaatgtaagagttatgaatttgggatgacaaacatggagactcagaatacattatatggatttttagattaatacagaagttatagcatggaatcaggatccctccttaggtaattgccccactcctatccctcttcacattgtcttataattacctattaagttagttctctttatccatggactgtaagttcatcacacgtgaacttggttttctttactgtgcttggtatataaatagggccttaatgtattctggctagatgagagatgtgtgacaggcgaaaaaccaagcccggggggggaaaaaaaaggtaatttagaaaagaaaataaacagagggaaataccgaacaatacagatggctcagcagaaattgtagaaagcgacataaatagattttaagagcatgactttgggactaagataaccctggtttgattttcttctccatgagaatgaagagcagatgtaacgggctaaagtgagtaaggatagcagcactgagtagtggcatcagaaaagcatctaagttttattacaagacaaattaaactcagaatataacaaggctcattcctgggaataattttttaaaacacagctgagatagtcataaaacatgcagttattttaaatttagaaacaaaaccaggacctttaaaaatttatgcttctctgatttttgtccttccaaaattagtctagaaataagtttattgagaagtcagctgtttttaggctctatgttgacttttaatagtatcaaacgaatggtaggggaaaaaaatgaaaataccggttatccttgtttgaggaatctagctttgggagaaaagtgacaaaatatgcttaatttttttcctttcatttttcagatgtcgttttagaaaaacacttagggaggaaagaatgtgagtgatttttgttttcatgccagagcacagacacttacgtgacaattggagtaaataaagtaagctttgactactgttctctaattcatgcgtacctctgatattgacgtgttaaggaaaataacgtatctgcagcccctttccagagaggcactatgacgtaagagttcagagtatgagcactgttatttcacacacctgtgttcatatccttgcttagcaggaagaccctggagaagtttttcagtttctctgaaggctgcattctcatctggaagatggagataataacttcctcataggattgttgggataattaaatgaggtaattcctgcaaagggtttaacacagtgcctaatactagcaattgcaaagaaatataaattattttgttattattatgtaagcagatatcacatcaactgttagtcctcagacttggcaacttacaactggcggaaggagaggaaaggaaaaagagagagcaatgtcatagtaggttgttgttcttttctataaattcatactgcaaagagaagaaaagaccaggagcctgagcagaagcccctaaatatagccaaagtcaaggttattaatagagtgtgggattgctaaagattagaataaatgaatctaagacagaggggacacaggaaagaggagatatgagaatcctctgtcatttacctccctgactttcctttcaggtgtcttacagtagtgaaactggagagagtaaatgaaaggagggaactgttgacagcagagaatcagaataggaaaacttggtgtgcctgttatgactcttccaaaagagcttccctaagagcagagtcccaaaggagaaggcatgaagcatgatgttttagttttgcgctaactcctctttctctcagagtatctgctttttcatatcagagctgagtcttatcaacaatagtagcaacttaacataaatgaacattccataattaaaaggactccctttaattaaaaatactgtgcagacaggaggtgcttcttaaagcttggaagattgatggacggcgcaaaaccacctattagaaccacaaatagggagcagaaatttaaacactgaaaattagaggaatgtcatttgtatttattaatactcaaccaatattgcattgaatatctatattgttacaatactaggagtggagaatactagcaaattaaaggtgttttatcttaaagcactaaatcatatgtataggcacttataaggcattacgttataaaatactagttgtatcttttaggtaaaaggagcaaatgaaagttgagtgggattcacatagcctgcagtcttcatgatttccacatggaaagagagaattggagctagcatttaaacactaacatacgtgagtaaagataaagtgaatgaaaaattgtagtggactgtaatttgttagctaaaaattttagtatctatctattaaagtgtttcttatgctgttgacactttaaagctaaaaatttacattttctcaaaccccaacatctaaagtgggtagaaggagttatagccactggtctgctctctctacactcccttcatttggagaacatcacctgtgggaaagaaaagaagtcaggtgacctgggtctattctccttgtcagctggacatccaggaaaatggactaaaaatatttggagaaagagaccttatctctgcaatgctgtcagcatgatgtgctggcaaagaataatgaaacttagtaaacataaccctgtatcggtaaggcatggccatctgtaaggaatgccacacataaactatagaactatctggagtataaaatgaagatgtttcagaatttaacaatcactgctttatgaggaatcccagaagcctcatgtagggataatgcagggatataatctcttctggccagagctgcttgtcagacatgagaaggaagaacctggggaaccacccttaatgtctgttctctctgtgcttggtctgaggcttttcttgtctgtctccttgaaataagtactaggttactactgagtaaggtctctgattctcgtgagtctgctttgagaatctaaaccagtgtgctagctcataggttgctagatatgatttgggctccactaagcagatgctctgtaatgagccttcaatttgtagtccattaagtcaggagagaggcagtgcattgacaattattttactaatccacttaccactacagttaatgggagcaagttgtgtgcatggtggcggtgagagagtaaaaatcttgtatgtttcataagagaggtagtgaaagtgacagcaagaagagtaaataacatcagaaagggaatgtaaaaattgtttgaattccagctttgttctgagacacagcaagcaattgttgtttctcattattttaaaagaaattgtgtctttttgaagttactcttgaattgcttcaatgacaaattcatactctagaggcaccccattccttgtttgatggctccagttgttgcacagttatattgatacagatctgtctccaaagagattccaaccagcagcctgctccttggtgctaatttttattttgacttcaacaactatcaaatccatcaaggtatgctagtcacctggtttttgttgtcttagttattttagtagttctctatatcgtttttaaaagtctatattgcatcctgaggtctcttccctgaatgtgcttaaatttgggtaggctccttttttgaaaatagatattaggtttctctgcaacacaaccaccaccaccaacagaaaatggcaagaaaggaaataaaagagtaatgaaggatgagcctatagattaaaatacactaaaaagaaaaacttaacacatagtaacacatgtactttatttggatactgattcaaatgagctgcaaaattaatttatatatgagttatttgaaaatttgaacattaactgaaaacttgatgatattaagaaatcattttttttctaggtatgattttagtatttggattatgttttaaaatttctaatattttagagatgcattctgaaaaattttatagatttgtttcaaagtaacttagggtggtggtggtgagtatataaatataaacatatatatggttgggtgcagtggctcacacctgtattcccagcactttgggtgaacgaggcaggtgcatcacttgaggtcatggattcaagaccagcctgaccaacatggcaaaagaaaccatctctactaaaaatataaaacttagcgaggtgtagtggtgcactcttgtaatcccacccacttgggaggctaaggcataagaatcatttgaacccatgaggcagagtttgcggtgagccgtgattgagatcgcagcactgcactccagcctgagcaacagagtgagactctatctcaaaagaaagaaaagggaaggaaaggaaaggaaaggaaagaaaaggaaaggaaaggggaagaaagaaagagaaaggaaaggaaaggggaagaaagaaagagaaagaaagacttttgttaatatttcaaattcaccataataaaggcatcattaaaaagttttagatgaaatctcattagataaggacagttttctctcactagctatacgtcttacttcaagaaagcagctcaaaaatgtgtgtatatatatgtatatttagttagccagtcaaaagaatgaacaaatagataaaaaatatatcactacaagtagaatgtactattaataagaaatcatgggattccataaattaatttattagttatataaataaataatagtcatctcttttaaaatttaaacatgggcaattggagttgactctgttttggctatttccttgctcttagcaaaaataaaaacagagtctttagcttcaacttaagatcttacagaaaaagagaaacagaaccgtgactagagatactcattttttaaggaatcaaattttatatgaaagctattacatatataatttctagggttacttcttaaatcaacccagtttctggcataaaaatactttcactataatcaccagtactgaaaatgtggtccatttgtgcccatgaaacttgctgcatttggctctgagcaaaaggacactggtaggataacaattaaaataaaagttaatattttatttaccttcttagttctaggtcagttttcaaactatagaaacagagcattatttaaatattccctcagatgactaggggatcattcagtggcctcaagtactattttttaaaaaacagtgaataaaaagaacatgtattcactccttccctgaaagttatattattcttccaagtggcttttttcaacacaatgaaatacacacacacacacacacacacacacacacacacacacacaaacttaaaataggctaagtgtaaaaattatagaaaatatttattgcctatttttgagcacacaaaccagaaatatgtgtctttattgatgtactttcacacccagttgaaatatagcaaattatcttgaaaaactttgattctttctaaaatacatacaaaaatagttatatacaacttagtaatttgacaagtagtctcgaaaatatgatattcacagtcttaccaagattttaatgtccagtgatttactaactttgttgtttatataacaaattagccctaatgtattcaatatttgattgcttgatattttctcagtaagaagcagatatagtcaatatacatagattgcctaaaataggagtcattgccaagggtcaaatattataaagggcaagcctctttaaaagcatcctttatatcacagaaatagagaaggagttatttttcagtggttgaatgtacagaataatttacaagattgaagtgtataaaacattttatacactaaagctcaatgtgcccacttgtgctgaatagcttattgtggcttgagcttctcatacattctcaaacatgacttaagggtgaatggattcaattatcctacatctagaggcaaatttcacctaaatgtaattgcaggaatcaagaaaacaatccaaacttctactgagatatctgtaaaaattctcactgaaggaatcaagtgattttgaatgacacttataaatatgcaaaatttcatcatattcaagtatgtttcaagctgtacaataacacaggtttaacttgaaaaggaaaacaatgaatgttattattttcatcatgccttgtataggctatgttttttggcaataattagatttcaagtaaaacaaacttcacatcatcacataaccattttattttaagacagaggtttcactcctgtcacccagactggagtgcagtgggcgcggtcttggctcactgcaatcaccacctcctgggctcaagcaattctcctaccttagccactcaagttgctggaattacaggcttaagccaatgcacccggctaatttttgtatttttattagagatggggtttcgccacgttggccaggctagtcttaaactcctgggctcaagtgatccacccgccttggactcccaaagtgctgggattacaggcatgaaccactgtgctgggccccccccttttttaattgtaataaacaatggaatccagttgcagcaatgtcagtcatatctctggtcatctgatgtttctctgggcttgggtgcacatcacatccggatgtgtgtttcattcttatttccattgagatatagataggtttctctaccagacagttcctgcttcgccataatagcagttttattttggttttgcattttgggggcattaattctgacccaaattctatacatcaaactctaatgtcaaccaagatctgtttctgtgtcataaatccaattcccagaaagaggatctgattggcgcagctttgggtaactgtttccagcatacacttctcctttgaattacagtcttacatacccgactgcctattgcgcacatccacttagatgtcaaataggctttaaaatgtaaaatgaccaaatttcaatgacgattttccttagagtcatgtttgattcttttttttttttaacctatatgcaattcaagaactattccatttagctttacttttaaatatactcagaaaataatgtctgctcggtacttcagcactactgtctaggccaaaccatcatgtactcctgcctggattattcatctctttgcatctgcccatgccacctacggtttatactcagtacaaaaagtagaatcatcttttaaaaatttagatcatgtcacttctctggtcaggtttcctatctcacttgtagtaaaataaaaaggctttgcaatgatctacatggttctgtattacctactttcaacccattacctttctgatcttttaacattttgttctttatgttactcacttggctccagcaatacagactttttgctttttctcacatgtgccaggtacattctcaactgtgtggtctttcctcctgacttaaatgttcttccctgagatggctgcatggctcactccctcactctctccaactctttgtttaaacattgtcttctcaatgaggctttttctgactatctaaaattgaaattcctctcccaatattccctaagcttgctccacagtttaaatttctcttaagaaattatcctcatctaacattctatatattttactatatgtttattatatccctctattcctttgacatctcaccagaatgtaagcttcatgaacaaacagatttttgtcaattgtgtcctaaaccaggcttccaaataaatgtttgttaaataacttgtccacgtaggacccaatcaaccattcctgttcagtggagggccataggaagaggaggtttacgaagaaaaggatgtcatggaaagagaaaataattactctcatataggcatatattgttatttatttccaaaataaaagaaataatgctcagtatcgctcaatgatttacttagcattatataactaattagtgttagaaagtaaattgaagtcccgcacactcaagttcatagttcttttagtgattttatagccatagcttcatatgaccagaggtgtgttagtaaagagattcaaagtcatcacatttcaatatagctctaaagccaacttgttaattggaaaattgctagattatcattatatcccagtgattttcctattagtttactatttgaggtcatatgaattatctatttaataacagaaatttggggcaaattgggccatgatatccttcctgacctcaggtcaatatatttcatcttcacctacaagtttaaaaacatataccacaagaattgttcaattaaaatgcttctgaagtctacattaccagtgatgtgttcttaagttttgtggtagtcaaaggacctgctaatgtctgatattctattgtcatggatactgacaggctgaagctgtcaggttgggaacatttgccattatttctgatgaaaataatgagaattggccaggcgcggtggctcacacctataatgccagcactttgggaggcccaggcaggcagatcacaaggccaggagttcgggaccagcctggccaacatagtgaaactccgtgtctactaaagttacaaaaaattagccaagcatggtggcacgtgcctttaatcccagctacttggaaggctgaggcaggagaatcacttgaacctgggaggcacaggttgcagtgagccgagatccagccattgcactccagcctgggcgacagggcgagactccatctcaaaaaaaagaaaaaaaaaagaaaataatgacagttgctattggaaaatatatctaatcaaaaacataatacaatggacccacacatttgtgaatgggttgattccaaaacaactatttaaaaagagttatagctatattgcagaaagcatactgccactttaaagaatctaagttaagataaagagaaactttaattgcaccaagaccaaatgagtctcagaagttttgattcaaattactaaagtttggggaaaataaagttaactgataatgagattgaatatttgaattgcatctttaaaaatatcacatcttaaacttttttttttttcagttcaatgattcactattgctctgccaagtttctttctcttaggaaaacatcactaattagaaatgaggcatatttcatgaagaaaatattatttttctgttcttaacaacatgtttcactttttatttcattggctatattgaagagttagaaggaaattgtattgccttaaaaatcaagacattatttttatttatatgtataattagactatttagatgaattgattttcttaatgtgctgtgcttaagaaactagttagaaaattaatccaatagatttttttgaccaaattccagtcagattcaagagaggtttctcaatattaaagtggaaaaaaacagtcttttttcccatttttaagcaccatttttaagaactgagaatttgtcatagagcatattagtgctataatagactaacagctatgagtctttcatctcttaggagctgaaatttatttcctagctcattatatcctaggacaggaaggaaggaaggaaagaagaaagagagggagggaggaagagataaaaagaaatggcaatcaagaaaggcagagcccatgcttactaaagatttttaaatttgataagcttggaattgatgataaaatataaaacttccatgttaatatcctatgtaagaaaacacaaccaacttattatcataacttggcttacataaaattgtccttgttagttctattgtttgtttgttttttgagacgtctcattctgttgcccaggctggagtgcagtggtgtgatcatggctcactgcaacctccaccccctggtctcaagtgatcctccaacctcatcctcccaagcagctgggactataggcatgtgccaccacacccagctcatttttatatgtttttggtagagacagggtcttgctatttgcccaggcctgtctctaacttctgagttcaagcgatctgcctgccttggtgcgctgggattacaagtgttgagccactgcaaccagcctggatttttcttttaggatttttaaatgcattttgtatttagaggtaattaaaaattcacaggtagtcatgagaaataatatagagtaatcaagtatacccttccctggatttcgtcttacataacaagagcacaatattaaaactagaaaactggtattgatataatccatcgagcttattcagatttcacaagtcttacattcactcctttgtgtatgtatgtgtatgtttaactcaatgcagtgttattgtatgtgtagtttcatgtgatcaccgccacagccaagagagagaacaatttcatctaaagtctcctttgtgctattatgatctcagatacctccccccaaaaccccaaccctgacacctggcaaccactaatttactttcgatctccataattttgtaatttcaagcatgttatgtaaatgaaattacacagtatgtaaccttttgagactggctttttttcactcagtggaattctctggagattcatctaagttgtttcatggctgagtaataatccatgtagtccaaagtagtccatagtgcagtggactgaattttgtccctcccaaaattcatatgttgaagctttaacccccgatatgactgtatctggagatagggtctttcgggttaaaggaggtcatgagtggggacctaatctgataggactgtgggccttagaagtagaggaagagagatttctgtttttctctgtcatataaggacacagagagaaggtggctattgcaagccaagaatacagccctcaccggaaactaattggcacccttacctaggacttccagcttccagaacagtgataaataaataaatttctgttgtttatgccacccaagagtgtggtattttcttacagagaagtctgagctaacatacatggcatgaatataccagtttaaaatgtttatttaacccagagcctctgggttgcttccagtttggggctgttatgaatgaaattgctattaaaattcatgtgcaggtttttgtgtgacatactttcttatttgtctagagtaaatgtccaatagtgtaattgctgggtgatatggtaagtgcctatttgattttgtaagcaactgccatacactttttcttggctaactgcattgttttatattcctactagcaatatgtgggtgacacattgtttccacagcctcacagcattcaatgttatcattgtttttttattttagaccttttattttgttttgttttgttttgtttcagacagaatctaactctgtcgcccaggctggagtgcagtggcatgatctcggctcaccgcaacctctgcctcttgagttcaaacaattctcctgcctcagcctccccagtagctggaagtagaggcatgtaccaccatgcccagataatttttgtatttttagtacagacgaggtttcatcatgttggccaggctggtctcgaactcctgacctcaagcgatccacctgcctcagccttccaaagtgctgggattacaggcgtgggccaccgcacacagcataatgcttaataatgataaacatcttttcatgtgggccttactagatttttgaaaagtatattgaaccatattttaaaagccctgtggattttctttttcaaagatatgcatccaataccaaaaattttggtcaagggatttataagccaaaacatttttactccttaaagctcaattttcatacataaaactcctagagaaataaaatttagatgtttttagactcatggaaagaagaattcgaaattgtagatgtcagaaatcttttttaattggttctggagtcctttttccatgttttgaaaaaaatattatatatgtaaaagtttagttcaaacagctattttgaggagcctggttctctaggaggtgagaagctgtcccagttttcccctccaatccaacaaagcaccatgtgaggataaatagattttcagggcaacactcagaatctgcattaggagtggacctctttctcagacagtcatgagaaatcttgaggctttaactttggcttttaaacatcttcctagatacctgcaaagtaggagctaatagcagtcataataatgggtgcataaaagcaaattataattattggtttaataatcaacagttaataagcaaatgggtattttagtagaatatgttctgccgataatggaaattgatttttttaaaaagaaataaattgataaccacaaacttaattgaacagaaaaatctaaacattattaattaacttggaagaaatatattccaaataagctatagattggataattagaagttgttagtgataagaaatttttcctcaccaatctcattttgcttactgcttttaatgtgatgagcctaaagtgaaacaacatcctaaatcataaatagaaagaattgtcttcctttcattctttgaaagatgatagttcattctgactctccagtaaaagaagtcttatcaaataaaaatgattaaaaataaacatcaaaaaagataaaacatgaatttaacatttatcatttcacatttctgtcagtagcatggccaattgtctacagtagaggttcctagtgggagaagttagggaactaagcccattaaaatttctaatgcacttaggatgtaaccgtagtgtatctaacaaaatcatatattatgatggtaaaattttcatttaaaaattatgcttttctgagaccattgtctttagtgtctgaaggaatataatatatgttttaaatattactgtgcttttttaaattattttttgtagactctcttgacagaagtccagtttaacacagaattctcagccgtattttacctttgcctctatgtttatgttatctctgaagtgggaatatctcatgtgtgtgtgaatacacaacaatgtttgtcttggatttccatagaacatagcgagaattgtgaaatccatgtgtatttccggagtgagggagaggagcctcctaaattatgttgacttcgtttctcaccttgttgtcattagagtccaataacaatacaagtatgtaagttctcctacctagcagaaaaaaatttgctgcgtgataccgatgtatttatggatccaatttaggttactacctttaataattccctgttagtgtgtagtgtgcaagatgagttatcccagttttcccaagatcattcagattatgaagccatatattaagtgggacaaaatccctgtggcttctattctgtggcaaagtgtatacaaatgaggaattgaaaaaactctttttttttgcatttttaaaaaatatatagattgaagtgctttagaagtaaagagacaaactagaaataaacaataaatataatagctaatatttattgaccgggccctgcttttagccttttcatgccatagatgaatcctttgatcctcaaaaacacatctgagaaacattctatcattatcctcattttatggatgcagaaatggaggcttagcctgcttaagttacttaccaaaggtgagagagcaaagaaatcaagatttaaacccacgtatatccgattcttgagcaaaagtgtttcctactttatcatattaaaatttttcacaatacttcagaaacaaactctaaattaaattgtaatagaaatactttcattgagtactgttgattcaacataaaaataactttagggaaaaaattttaaagcatattttatgccaaccagcaggtacatagaatctgtcaaattaaaactaggtagtaaaatcatttttctttcaaattttatcactacccatttaaagttgtcattgctcctttataataaaattatttttttctaaactaccattaactagtagttttagcaactgcaaacattttataagtacagctgtttacaatgattactttttctatatgttaatgctatacagtcatttacccttaaagtatttacaaaagactcaaaattaaaaataaaaaactactatttgtcatttttaaacattgatttttcagttctttacccttagcttgtacctttaatttctctctctttgctaccttcgtccttcagtctatagctatcgtatggttttactcaacttgaaaaaaaaaaaacatataagctagtgagcaagtaaccattccttaaagctgtgctcttccatggcttctattatagattctcccttactaatcatccttaaagtgaaagctactgtatcctctttgtcactctctattcacttttcaacccactgtcatgggactctgccccatctgtccaggttaccacagcagtgtcacgttcaccagatacttagagtcctcatcttaactaacactctctcacactcaaactgaggatcattttttttatatttagtgcttatattgttttccttgaaaatagattttttttttttttttttttttttttttttccagagagaggaatcttgctctgcttctcaggctggagtacagtgatgcaatcacagctcactgtaacttgaactcctgggctcaagggatcctcctacctcagcctcctgactagctggaactacaggaacgtgccaatacatccagctaattttctgcagagagaggatctctctatgttgcccaggctggtcttaaactcctgacctcaagtgatcctcctgcctcggcctcccaaagtgctaggattacacttgtgagccaccacacacagcccttgaaaagttttcaagaagagaatgttttctcttctgtatgcgatgtgtgtgaatgtgtgtgtgcgctgagatcattttaagaaatggagttttaaaaaatctttatgttcttaactggtaaacactacctacctaggttccattatatcctgtttgattactgagcttttatttctattaagtgtctatgagagtttgtgagggtagcccaaagtaacaagtattctacttagctcacttaaagtgggctgattaccacctagggtataagtcaagatttctggctcttttatttggacctatgctaatagttttgcttgatatatgaaattaaatgatggcgggcactctgtaaaacagagcagggagatgggtttagtaaaatgtagtcactttaatgaggggttgggaagaactggatctgagctgagaatcctactgaggcaaatggcaaagagaaaaatcttttgttcaatctgaaaccgttgggtttgtaacacatttttttcccacataaatcagtttgatatctaattcacagacactgttggacagcacagcaattgcagccagggtagatgggagtgaaagctagtatatcttcttgtcttcgtagtaactgtatcttttctacaaaggtcagtaataacaatttcatttggggactgtaatacagaaggttaaaaatcaaatgaaatgtacaagtgtcattttccttattcttgtttttccttaaagtcttggggagtaagtactattatagattttgaaaattattcgcatgatgtgggataatgatgtccagcagatttaagtacccactggtaattatttatcccgaagaaaatcatatacagaattctaatacatgaaataaatataacaataactaagttccattaagtgtttacaatgagccaggcattgtgctaagtaccttgtacatattaacttgtttaatcatcaaaacaattcaatatggtaagaactattatgatccctaacagactaggaatttgaagcttggaagaattacataataacgtaaccaaggtaccacaaaaatagtaagtagtagatctagatttattctcaaacaacactactaatggacacagataaatgtatacctccttcaaacgatggggggactgatgcataaacttgggtggttttggctaggtccacgttttgacctcacagtattttctaaggaaattcccaggaccctctgctctagtgtatttaaagaaagataaaatctgaattttgcattctaactctcggaatacgtgctgtttgaagttctctcattactgaacttccattaaaatctttttaaacgaagaaaaaaggcataagcagaccggaatcatcatttacccagttactcaggttacatacaaccctaaagccaaattggatgctatacttgcccccacagtgtcacatgcaacccgtcaaaaaagttcaatatttttctttcaccaaatacaggcatattttggagacatcacacgatgtctccaaaccagaacaaattttctggtttctcagcacatgtaaatgttatgtttgcactatactgtagcatagtaagtgcaatagtatgatgccaaagaaaaaaatgtacatagggccattagaaataatttattgctaaagaatgccaacaatcatctgggcctttagtgagtcaggatctttttgctgatgaagagtcttgccaggatattgatgactgctgactgatcagggtggtgattgctaaaggttgaggtaatggtggtaatttcttaaaagaaaacagtgaagtttgtcataccaatcacctcttcctttcacaaaaggttttctgtagcatgccatgctatttgatagcatttacccagagtagagaagaacttctgtcaaaattggagtctatcctctcaaccttgctgctgctttatcaattaagttgatggaatattctaaattattttttgtcattttagcaatgttcccagcatcttcaccaggaatagactccacttcaagaaaccacttttattgctcattcactagattcaatgcttcattcattcaaatttaatcatgagattgcaggaatccagtcacatctccaggctccaattctaattcttattcccttgctatttacagcacatctgccattacttcctccattgaactgttgaacccttcaaagtcattcatgagtgctgaaatttacttcttctaaactcctgctcatgttgatattttgacatgctctcatgaatcatgaatattcttaatggcatgtagaatgatgaatttgttccagaaagttttcaatttactctgcccaaatatatcagaagaatcacctatttatggcagctatagacatgaaatgtatttcttaagggtgataagacttaaaagttaaaattaccccttgatctatggactacagactggatgttgtattagcgggcatgaaaacaacattaatctccttgtacatctccatcagagctctggggtgaccaagtgtgttgtcaataaagagtaatatcttcaaagtaatctcattttctgagcagtagttctcaacagtgcacttaaatatttagtaaaccatgctgtaaacagatgtgctgtcatccaggctttaatgtcccacttacagagtgcaggtagaatacatttagtataattctgaagggccctagaatttttgaaatggtaaggaatactggcttcaacttaaagtcatcagctatattaaccctaacaggatggtcagccgtccttcgaaactttgaagccaggcattgactttctggttatgaaagtcccaatggcatcttcctttaatgtaaatgaaaatttgtttaatgtagccaccatcgtcaatgatcttagctagatcttctggataacttgctgtagcttctacatcagcacttgctacttcaccttgcacttttatgttacagagatgacttctattatgcaccctcatgaaccagcctctactagcttccaacttaccttctgcagcttccttacctctccaatgcctgaagtttagatttctctgaacttctgttttctacacagcacatagactagtacctgaagatgtaaagattcctcatagtagctggtgaattaatgaattgattttaaaatatagtgtaacaaaccctagtttatcttaataaaaatcctttgtaagaatagaattatttccaatatttacaaaatatggtagtccatgagattatcaagaagtaggcttagaaaaaaaggatttaataaatttcacaagtgtttaagaaacttcttaccaaaataagctttctatttggcctgtcacattggaattcaaatggcattgaaatacttccagttccctttaaacttcaatgtaaaaattacatttttagtgtttaaaatgaagtatatctgataatggtcttctccaaatctaatctaaatggtagattccttaaactacctcatgcaggcctatttaatttcctcttaaattgtcaaaatctattttttagttgaactcattgtgtagatcactttaacagctttttttctgaaaatatctaatgatgttatacctctatacatactccattaacttaaaaaaatgaatttagaactctaaatgtgtgatttttatgtgtgaaaagattcttacttaggcaaactatattctattatctttaaaatagactgcattatcaattcaaatgtataactgatcaaattagaagagagtgatcaaaaatagtcatataggcaactcctaattaatattagatttaactttctctctacttcagttatgtagaaatagtggtttaaagataatgctacattatcagaagtcaaaatagtttttaaaacatgcctacaggcatatttttcaagtttccttattgttctgaagacatggctgctcaaatctggatcttcaaatatttgaattatcagaaacttcaagattctacacccagacatcaccgtccttataaacaatttatcactttagaattgttgccaaagcctaataaaaactctaatcctctctagagaaggaaccttgattttgtctttttcttctccagtgcagtagttttcagagtgtgttccctgaatcagcatcacctggcaaagtgttagaaagcaaattcttgggcaccagcccagacctactgaatcagaagttctgggagtggcgccctacaatttatgtttgcgaagccccgcaggtgtttctgatgcagtataaagtttgagaaagactatactggccttaggataatatctggcattcacaggttcttttattcatcaactgagcagaattaaatcaaaatgagtaaaataaagtaaatcaggtgcctgatataaggaaccagaaattcctaaaatttagttgcctgaggcagaactacataaacacataatatctcaattttcactgatttccagtttactaattaaaaaaaaatgaggtgatccatttgggtaaaattttttaaaaaactctaacttcacaaaatgtttgacagtctttttaccttttatccatgtctgtcaagcttattaaattgaagataatactaaacagaatgtcatgagtttaaaataatgattttattatccccctgtaaagacataaccatgttttcttcaatactcaaaaatgatagcattgaccctcaatcaatagatgtttcacgtgtgatgaatttgttctactacatctaaagagtccctgtagctactaacagcactcaatagagggtccattagggattcttcatggcacccaactgatacattcattcaaacaactacttagtaagtgcccacaaggtacttaattactgccagacattgaacaggatacaaggcaatgtagggcaattctgttctccaggattctataatgtggcctggaattaaaagtaaagaaaaggaaaagggccacacatttttctcataccatcatgtgccaggcactgaatagagcaggagaaataaactatatcagtaaatccatgttaccactcagggaagttggcttcattcccagattacaaataaggaaacaatagtttgagagatgctgagaacttgttcaaactcatcaggtaagaaacaagggaggtaaaatttaaaatcaaaactgatttttaagtgtccactgtaccttacactatatcagttcttatataaaaaatcagcagcaagtcttagaggaatacaataaatgcctaaatgaatgatgcacattatttgctgtagggcgattagaaaaggagcagtaactgtggatgaggaagtgaagccttcccagtaaaagttcaacacagatcttcattgaaagaaaatggtttgtagcttggataaaggaaagaagtaaatgtattccagatgggaaaaactgttaaacagaaatgtgtagtcaggaacaagaaaggcaggttccagtagagtggcaaaaatcagctcagcacatttagttgccaaataaatgatgtagaatggctttgcttggctctagctatgcatgaaggcacacattttaacaacgaaaggggagtggtgaacagtgccacttagctttacttaagtggtgtatttactgcctgtgtccgtgtacattcagtcaaggttttgaagtgcctgcttcttttggctctaattttgtatatgcattatctttcttcatgtaagtgatcattctgctcctctcctctgcaaccaacaggattagttcactttagccatattatttctcaaaaaaaaaaaaaaaaaaaaaaactcacaggtactctttcatatatttctcaagtccctacagctgaacaagttcttaaaaatatcaggtctctggccgggtgcagtggctcacgcctgtaatcccagcactttgggagtccaaggtgggcggatcaagaggtcaggagttcgagaccagcctggccaacacagtgaaaccccatctctacaaaaaatacaaaaattagctgggcgtggtggcgtgtgcctgtaatcgcagatactcaggaggctgagacaggagaatcacttgaaccctagaggcagaagttgtggtcagccaagattgcacctctgcactccagcctgggcaacagagcaagactctgtctgaaaaaaaacacaaaaaacaaaataacaatatccactctcccaggtacttatttgtagttactataatgtgcctgaaagacacaagttctaccatgagtaattcagtattcattcaacttgaataactacagggttaggagagtcattttgaaaatggttaggattattagttagtgttaagaaaatatttttagatagttatggtaggtaaagtatgtctgaagaaaagatgtatttgattgacttatcctttaacttcagtgaatttttatatctctgtatttattttgaatcaaaatccccaggtacaggtaggagaatttaagacaaaatttcaatagcacctctgttttcctgtcttgttacagtcctctatgtggtaagaaatgtttttgtcatttgctttctgtgaatttcaaagtgatgtcctgtgataaaatagtggttcccctaagatcttttatttaccctgggaatgtcattgatccaaaagaagataataaaatcagcaataaaatagtaaacattctgtatgggatatcacagttttaattgactacagacactcaaatcaatttttcaatctgcatacacatgacaaggtcagcaacatgggaagctgatgttgctttcctttataagagatatatttaagatttgtaatataaacatgaagtatggtactttgtatatctctttatatatctcttaaaaaatggactttaaaactgtagatattaatgacacttcaatgtaatttttaaacaaattttaacaaaaattacttagaaaatattttgcttagttttcttacaggttttttaaaaatagtatatttgatgataatgtgattaaagaatacacaccaatttttttatattatactttaacttctagggtatatgtgcactacgtgcaggtttgttacatatgtatacatgtgccgtgttggtttgctgcacccattaacttgtcatttacattaggcatttattctaatgctatccctccccctgacccccaccccatgacaggccccagtgtgtgatgtttcccgccctgtgtccaagtgttctcattgttgaattcccacctatgagtgagaacatgcggtgtttggttttctgttcttgtgatagtttgctgagaatgatggtttccatcttcatccatgtccctgaaaaggacatgaactcatcctttcttttatggctgcatagtattccatggtgtatatgtgccacattttcttaatccagtctatcaatgatggacatttgggttggttccaagtctttgctattgtgaatagtgccgcaataaacatacgcatgcgtctttatagtagcatgatttatatacttgggtatatacccagtagtgggatggctgggtcaaatggtatttctagttctagatccttgaggaattgccacactgtcttccacaatggttgaactagtttatactcccaccaatagtgtaaaagcgttcctatttctccacatcctctccagcatctgttgtttcctgactttttaatgatcgccattctaactgcacaccaattttttaaataaaatttatttttatcaaaatttcctgtgtactcagaaaaaaagtgccgtacatataaaactaataatgtaatataggaattgcttctctacatctccctacatgctcttcccactctagcgaagcaaccttcaatttttgttttgttttgttttagctacttttggtatttttcaaatattttaaataaaattttcacactgttttttcttgatttcctagatactgatatctattgatatactaagttgcaagatgagaatttaggttgcatatgtcatctctcacatgaagttacccttaccccccttctaatatagttttaacacatttataactaaattcatattcagtattatcatttatatgactgtctttgtttgggttgctataataaaaataccatagactgggtaatttataaacaacgtaagtttattgctcacagttatggaggctaagaagtccaaagtcaaggcaccaacagattgggtgtctggtgagggctccctctctgctttaaagatagcaccttctcactgtgtcctcacatggtgcaagggcaaaaggtgataatcagcttcctcacacctcttttataagggactaatccctttcacaagggctctgttctcatgacctaatcacctcccaaaagccccaccttctcatatggtcactttgatgagtaggttttcatgtaagaattttgagggaacacattcaagccacagtattctactcctggccctccaggatttatgtccttctcacatgtaaaatatatttattccagacgaatagctccaaagtctttttttttcttttcttttttgagatggagtctcattcttttgccctggctggagtgcagtggtgtgatctcggctcttagcaacctctacctccacggttcaagcattctcttgcctcagcctcccaagtagctgggattataagcatgtgccaccacacccaactaatttttgtgtttttagtagagacagggtttcatcacgttggccaggctggtctcgactcctgaccttgtcaagtgatttacttgccttggcctcccaatgtgttagcattataaacgtgaaccaccgcacctagcacccaaagtcttaacttgttccagcattaactgaaaagtctgaagtgcagaatctcatctaaatatcatctaaatcagatatgggtgtgactcaagatgggaattatcctgaggcaaatttgcctctagctgtgagcctgtgaaataaaacaacttatgtgcttccaacatacaatgattggacagacatagaaaacacatttccattccaaaaagaagaaatagaaaggaaaaaaagtggtaacttgtcccaagtccaaaatgtaatgttgcaaacaacattaaatctcaaggctggagaataattcttgagtagatatcctgcctttcaggcacactgggtcaagcatcgggcccccaagtttccaggaagccctgcccacatgggtttgcagaatacaaccagtattgcagctctcacagggtttgcggaatgcaaccagtattgcagctctcacagggtttgcggaatgcaaccagtattgcagctctcacaggttagacttgcatgctgaaggctgtactattctggaatctcaagggtgacctcacccccagagcttcaccagacattgccctaatgggatccctctgtggtggccccactcctgtggctgttcactgcctaggtcctcagactctctggagcttcatttgaaatctagagtcatccgtgcctccacagctcataaattctgtgcatctacacctgtggagatggcactgtgcagatgccatcattgtttaccatctgtaccttgcagagaggcagcccaagctgtacctgggcccacatgagcaacagtaagacagggcaaggagtgctgttccagaatggggagagcagagacttaaaatttttctgttcccaaggtcctggatttctaagcttatgatgggagtggccagcccgatgatctctgagatgcatttgtggagttcttctgtccattggcttgatgaataagagcccctggcttccaccaatccatagtaaccttatcaaatacaaacagtggaatggtcacatccttggtgttctctatttttcatttgcaacattgccaggctgagaattttccagatctttttctgcttccattttgattataattttttctttaatttgtttctctcttcttacattttactataagcaatttagagaagccatgctacatcctcagtacttccaccaaatatcctatttcagtgcttgtaagtttcaccttccacgaaaccctgggacacgattcagtcaagttccttgtcacttaataacaagaatcacctttcctcaagtttccaatgacatgtttctcatttctatctgagacctcatcagaatgacctttatcatacacatttcaatcaatattctgatcacaaccatttaggtaatctctaaaaagattgaggccttccctacagttctcttcttcagagccctcaaaataaccccattttatggtaaattcatagctttttctagcacgtaccttcagattctcccaggttctgcccattacccagttccaaatctgctccacattttaagttatttgttatagcagcaccccagttttgggtaccaaattctgtgtttgtcagtttgggctgctgtaacaagatactttagaatgggtaatttataaacaatgtaaatttattgctcacaattatggagactgagaagttcaagatcaaggtgccaacagattccgtgtctgatgaggactccctttctactttaaattggtgccttcttactgcatcctcacatggtagaagggcaaaatttgataaccagatccctcacatttgtttataagttcactaatcctactcatgacggttatgctcacatgacctaatcacttcccaaagggcccatcttctaataccagcaccttcatgactaggtttcaacacaggaattttggagggatacaaacattcagatcatagcaatagccatctaaacatttttttctagtttcagggaggatctgactgataattcaatgtgtactttcattcaatcatattaattttttgttcagcaccataccgaagtatccacatatccattgattccaaattgctttaccacctgtactttgcagagggaatatggaactaaggaatatacagatagttttgtgtggtactaaacaacaacaccaccacaccacaccacacacacacacacacacacacacacacacacacacacacaaatctcatctttaaaaaaaaaacaaacttcagagtaagatttttttgtttctgctccaaaagtgtgtataaaaaacctgcaatagatcaaagtccttacctcttcatctagtggtaactttttccctttgaactctgagaatgacaccagtattggtggttttaatttctgttgccctctttggatgagcatatttacaactactgaagttcaaacttgtcacattgactttgcatttattttttatattatcttttaaattggcatagtttagaatgcctaatggtttcattctttatatttatgtcataatttgttacctaaattaaaataaaatgtttcaagaaagggaactaacacttttgttttttattaaaataaaaagaaacaacaaactgtattgtctttatatagacttcttgtttataaccttgatatttctagaacttaatatagatttctatattttattaaactacatctcaaaagccactattgatttctataaattgacatagccattgacttaataaagaggacttaattcagctctgcaggaaaatcttattctttatccaagatttgctgtcttttcaacttcattcagaaatttggcagattggataacccttgacattttggtgaaccacctgacaatttcaattatagtttgaatttcaaacagcaaatatttgaggtgtttcagattccaaatcatatccaactctcaaccctaaaaatgtccttttcttggctctcaataacattttttccatttgaaatgtttcctttttaagtttcttagtcatattcaaagctaaagataaggatttttgaacagtgtcaacttttattaggacagagagaaaatacacaatttagcaatatgacctacgctatttcctagctttagagctagatcatcctttaactaattatttttcttttgtgttactgttttaatcataattcatattggatgttttgggtctttgacataattcttttcattagatttgcagatacctttattcataaagcaagtttaagtaaaagaaagttaaggtataattttcaatataatataaatatgatttagaatttttgaaaattatttgtgatttctatggcttacagtagataatctacaaaataatttgaagaatatttagaaattaatcttaatttatctcagaaattttattagttctgagaatgatctggcataattgcaagtattaaaaatttcagataaagttgattatgcatttttaatagtgtacatgcaaaataaaatttaataaaattagaaggatgaagaagcacgtgttttatttttaatggagatttttattcatttttagcacaaaaaatagcaaaactctagatagtctttgcaataatgtactggtagtatgtatgatgaaaaaccatacctggaaagaatgtaaccatgttaaaggatcagttggtaagaaatgttgctttcctgcttcttactactctgtatatcagaatctgaactgccatagcaagctgtcttcctctttgctcacatacctaacttctaaaatgttgagagagattctttatggcccttataaatagaaacattaatttgttgaacgtaattgaacccacaaaatgatttttaaattatatgtaattttaatttgcaacacttatacaaatataattttaacaaatttactctaaatatattttatacaaattataaattgtgcacagagccattattacatatctttatttctttatcactaagtgttgttttaaaaaaaatcttacctttggaataatactgaaaatagcaataaacatttatttttctttttgtcacatcaagatttgtctaattctctcccatgtgtcccaaattgcttttatccaagcccaatctgccctgccatatcaattattattgtcaagtaatatgtaactatcttcataacagtatcaatctctgcttttaatttactcaaaattcatttcaagcatattttatttatcaaaaacatttcaagaaaattttatctctgcaatatgttctggaaaatgccaaccataaattgcttgctcattatacccataatatcttctatctatttctatatgaccattcattgttctttttacaccttcacaatatctctttctaacaacaatattctgccctttatattctacatttgaagacttgatggtgattggataatgttccattttattttcactggggcttatgtcttatgtccccttacagacataaccatgattctagaagacaggaacagtaatttacctagagaggaactgaatccataaccttactaacactttgcttttttaacaaaatggggcaaccagcaactgaaatcattccatttaaaataatttcacacctcaccgaaagaacttgaaaaatgaagccttacaataggccaatattctatttttaggaaaatagatagccttctctaacaaatacatttttctcttaaatccttacattagaaacttgaatgataaacacttcagtgaatagtttacaacttatagtgtaagatacaagattttattcctaaaagcaaaggatgggtaggtcttaagaaaggagatttcagaccaggcactgtggctcacgcctgtaatcccagcactttggaaggccaaggtgggcagattacctaaggtcaggagttcaagaccagcctggccaacacgtggaaaggcaaaacccattgctactaaaaatacaaaaaatagccagcatggtggcaggtgcctctaatcccagctactcgggaggctgaggcaggagaattgcttgaacctgggaggcagaggttgcagtgagccaagactgtgccattgcactccagcctgggcaacaagagcaaaactccatctcaaaaaaaaaaaaaaaaaaaaaaaagagatttctgttgattttaaaattatcctgagctaaccacactgtcatactgcaaatcagggtgaaatgtgtccataagaacaagcctgccgaactaaggtattgcctgccttatctcatgagataattatttgttctgtagtggggtgcatatatttttaaaatgtgttacaccaatgtgtctacaaaagaaacaaatgaaaagcaaaacaacaacaaaaagatcacatcatttcaacaattgtggtgatcaaaaccacagaatatttacttcaagtatgtccttgtccttaattagcacaagaattagtgctaccagaatactcttaaagactctcttctaataattctatcatcaagtcatcttggaaggaaagcttttaaagccagtcagccagcctgcttaatgactgtttctgtagaggaatacaagtagctcccagaattacagttgtcagcccatctccttgggtctgaaggagaccgagggatcattatcaaatagatcatttgatatggtttggctgtgtccccacccaaatctcatcttgaattgtagttcccataatccccacgtgtcatgggagagacccggtgggaggtaattgaatcatggggtcaattacccccatgctgctgttctcatgatagtgagtgagttcttacgagatctgatggttttataggggcttttgccccttttgctctgcacttcttcctgccaccatgtgaagaaggacgtgtttgcttccccttctgccatgattgtaagtttcctgaggcctccccagccacactgaactgtgattcaattaaacctctttcctttgtaaattacccagtctcaagtatgtccttagagcagcatgagtatggactaatatatccttatttgctcttttccttttgtattctgacatgagtaaactgtgaaattgtgctaaatagagatgtatgctaactgtgaaacactgataattatttcagtaaactatgatacatataagagatttaaaacgggtatatgcttctttaaaatagacgaagaaagtcttggcatacatctccaggataccccctgaattataggccacaattgtacctcacagcatttatggcctcaactctagtaacagaaacacaccttagtcctattctgtagttcctaataaagattgattctcaaaataaaaactgactaaagggcagaaatacatacagtaatcttcaagaattttttctctttatctgcctggagttagttgaagcaagctttgacaagtcatttatttaacagtttagcggaactcattcctactcttgaacctggaatggaatgtaagaaataaagagcagtggaatccaatgatgtatttcaggatataattggttgtctatactcaaggctgatcttatcacttgagatgaaaaaagaaaaacaaaacatggtagtggaaaaaagtttatgtttacaaaccctgaaaacttaattcttgtaaataacatcaccacaaatagaaaatatgtgtcatcaaactaatttgtgcaaagctataatttgtgtagcaatgattgaagtataaatataacactttagtgtgttttaaggagtttttttcagatatgctattttctctttacaataggcttgaaaatatagtatttttttctaaaacaagccttttgtctttccttctatggaaagatgcatgtctttagttatttctgctggactattatgtgtggactggcaggtattggcatacttttcataatcctaataagtatccggtgtagccagtctgaaagctcatttagaacaggacaaactctgtcttgcttgttgaaacaactccagtacctagcaatgtgtctggtacattcttcaggtgctcaacaaggcagaatggctttgtttattaattaaataatatagactcaaatccattcagtccctgaccaggactcttcataaaacagtggatctcaaaatcattccctgaacctacaatattgcatcaactgagaactcgttagaaattaaaattttcagaccccatgccagaccttctaaatcagaaactattggggtaggcccagcaatctgtgtttaaaaagccctccaggtgattataacgtatgctaaacttgagcaccattgatgtaaacaatactcaaatacattgtgcacagctttttagaattatgagagtggcttaagggtatattacaagaagacaattcctatggacagattgtgaataattttaatttctcaagaattttgttctaatttttttatgtataggatagttggaacgtatgttctacttcttacaagtatctttattttaactataggactactcccctcatgtaacaaattgtgtaatttgtataggaaggctgactcagtttgagttactggtacagatactgagacaaggagttgaatgcagatggcttattaaggaggtgttcccaggaagcacaagtgaggaagtggtgaacatgagagagggtaaggagaaaagccagtcaagcatgtgttaacaagaaagggttacaactgtgggcaaataggtctcaatcctgtggagaaccatctgagaaagcatgtgtggaatatatctcagaatcacccagtggagagtggagagactgaaacatttatgtacttacttccagctccactgtttgagagttgatctccagtggttctaacatatgccatattccaggttatatttgtgtatggccaaataagctggacaacgtcatcaggcagagaagatgagacacagcacttgaggtgggacatgtcaatacactggaaggttgaattgtcactgccttgagaatggaagaagagcagaactgactatatacagaaaaagaatgagggtcagctttaactaggggttagaagccatgaatttgcaataacaccaaagcacccagttgtgtgttccatttctaggaaaggtagaacagtgaattctaagacatataaatggcattcagagtaactctaattgttttataggaagtatgcaatcataaacgctgacagataagcatacatgtaaaatttttaagaaaggttatgatcactaaaatatagcagatgacttcgaatgttcttgctttatgtgatcacaaatgggctcctttgtcgaattctagaattctgctctgcaagtgacattttgtttgagcagttggcatctggtacctcagtttcaactgactttttgttactaaacacagttcgaacaccgtaaggtaatttttcaatggtaagaaaaggtagtttatacttcatcctagtgaaataactcaggcagggaagtcaattgcttggaattatggaaagtttccatgctatcaagcccaacaccatttgaaaacattttttacagtaggccacaaagctgcctttttatggaagaaactatgaaagaaattttagaaaccccagaaagctccaaggtcctgttctgattcagtaaaaatttcaaagactatacctcctgagcttactttgagaatgacaaaacacaagtagcttaggaagacggacatggaaattcaccttttgcatttccctgcattttcttttggatattttgcacagaaaaacaataaaaccttttgatttttgttttcctgtgaagtcttttaattttagtagaatcatcaacattttatgccactcttaaaattctagaaagcaaaatccccatgtaatactggaaaagtccaaggataacagaaatattgaactaggactgttttttaatgagaaataattagcctccatagtagcttcatcaacgatgagctacttataacagtatactaccaagctacacaaagactttcattagtgtaagaacagtagtagactaattaactgtctaactacagaaactagatgcttaattgccatgttgctttattggcacagtatctaagaatcgtcgtccaatttctcctctagaagcttttttgttttcctcctctggtggcaatgggaagtttcgttgtgatgaaagaacagtaacagataactgtttctctggttaagtgtcaggtgcaaatacttctctggttaaacatcaggaatatacatgtgtatgtgactgtatgtgtgtgtgtacatgaaatgtttaatcagttaaccagtgtagcaaatttctctcattctgaaaagaatatgaaaagtaagtcttactaaaggaaaagcacattttcttataccactttaaggcaaatagtcatggaatcacctgtattgttcaaagtcttctatggtttagtctctttctctatcagttatacaatggatgcacgtaagttaacacagtggagtataaataaataaaagtctagtgtatcccacaaaatgttctgcaacattcagtttaactgtaattctaattttgaaaactacataacaggttctgcaacttagaagcagagggctatgagaaaattttgtagaacatatctttactaattattaactcttgcatccactcctgtttcgctttatgatttgggtgagttactttaactttttgttcctcagtttcttcatatttaaaatgcacatagttgtagtgtttgcatgataaggatgttgtgataattaaatgagttattatctacgtgtgtgtgtgtatataaaaacacatagtgtcatacatagtaagcactcaacaaatattagcttatactattattattaatgacatactgtaaatagcattcaataagcatttactggacagaataaatgttgtcaaacatgaccatttatgagtactgtcaaaagtattacagtaacttgagtgatttttgaacacatgtaatgttccagatgctttagatacatttagccatttagtcctcactatgcctccatgaagaaaatgtcattcagctcatcaggaacctgagactcagagtatgtaacataccttgttacagttaaggaggcccagcatttgaattcaagcccatttactcaactttcattttatttttctagtatcagatagtctccaagtcctgaggtatttggctttgcagattttgaatttaatatttctatacttaattactatataaatagttaagatcttctcacttgagaaaatgtaaattgattcattttctgatttaattttttaattaaaattttttctaatgacttcctttttatatgagcttatcaaatagtttagtcctaggtgaggtatggatatccacagatgtataaggacgagttagggctatatggttctcttatttccgcaagcaacatttaggaaaaaaaatctgacccattcctagcaatccattttattgaaaccctactatgtgtcactcactgtaaagggatagaccagtgaccaaaatgaagtccttactaccatgaagcttattctacagcacagaaagagatggtaaataagtgactctgtgtgtgtttatttgtctcaggtgggataaatgctctaaagaataggacaaaagtaacagagactcatgggggagcaataatggatgatcatagaagtcatgcctgatgaagtcacatgcagagacctaaatgaaatgaaggagggagctatgtgtgtgtctctaatggaagagcaatccaggaggcaacataaggacaaaggctgaactatactagaggaccagcaggaaagtgattacagctgaaccagagggactaaggggttatataaaatacgtacaacatggccctcacagccacttacatagttatctacgatttcattaaggctgggatagaggttggctcagagtgtcaggcaagcataagggttgggataatactgcctggagttagagaggtaggatgggaagggtttgacattttgttcacaatttgagttatgagaaacactttgtcaaacagagaaactgagaagaggtcaaaaggaacaaagcaaagcatgaaagtccacagctgtggagagctcatatattgcatttagacgtgatgaatagacttgaaaaactttattttttctttattggcttcaagatagcaagaaagccttagttcataaatcctagcaattaagtgccaatttacccccaaatcattttaagcgttgatcaaaatccaactaagaactcatattcatttgtttgcctgtcatacttaagaattaatttactctgccaagggtcatttagctattaaaaaataatagctacaagaaaataaatattttagtgtaatttcctgatggtgccaaaagttaccatattagcatatggtaaaataggcaagggatgaggggtccttcaacaaacaccgcttttcctaatgttttggcataatgcaccttaaatcaccacagcaaacgcccaggaaaaccccaatgccagcagaaactcacagagaattaaagacagtaacacagtggtttctgacactggcaatgatttttaaatctttattctcatgaggtaaagtactgaaatcatgaatttgcttttaatcactgttcaatctttgttcaataatatagaacacaggaaagttggtctatgccacatgatgaatgcagtctatctcttgcattacacattaagaagcagagcaggtagcacagtgttggctaagtctcagcggtggcatattttcatctcccacagggtgtgggaagaccccactgcacagcagtaacaataaatctagcatatccgtttatgaaataactttggcagtaatggcaagaggatttggatgaaagtgtatttgtggtcttccagctggaagatcagagcagagattctaaagcaaaaaagcagagtggaatggcagatagtggctgcttggaaaagaacagaagacagttgaggatccatgctgagctcaaggggaaatgcaaacaagacagtcctttcagaatatccccatgctgcccagtgttggcgtgagggattactaatgccatctgctggatattcttgggatttaaaaatggtatctaaacaaataatactccagtctccctatgtcttggcttcagttctttaatgagaaaaacagcaacaataaccagctaaagaaaacaagtgaagaaaacaaaactcaggtcatgtacatgtttcctgtaccttgagaaggttggagtttcgtatggccactgtgtttcagacatagtatttataataattgcatttttttggttggtgtttgtttgtttagttttagcagaactctatagtagtgcactttggccatatgcaacactcaggcaactggatatagtttgaactgtaaatccacaaagcccttgctaaaaatatattatacactataaactttgtatactacatactcccttttgttggagagaacattgtggttttattttgtctattttgtttttaaatagggataaaaataattaaaaggaaagaagcacaagtatcaccatttggtcaaaaacattacataggccgggtgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggtggagcttgcagtgagccgagatcgcgccactgcactccagcctgggcgacagagcgagactccgtctcaaaacaaacaaacaaacaaacaaacaaaaaaacattacatatacatttgtgtcatataaaatacagtaagtcatcttttgtttttgttttgtggaaatattttcctctgtcgtgctctctgtaggtttattgtgggattgcaatttaaaatgacaaaattccttctggtatttcagtaaaattttagaacctttagaaatgtgtggctaaattaacattgattatagtctacatgttccaaaccgtactaatcccatgagacttgcagtggaaaaaaatggtttctgtggtcaaatccatctgaaatattctataatccaaatatcttctcctagagatcaataaggcacatgaactgaaatgtgaggagctgatatttactgacagtttaccatataccattatctcatttaatgttcattctgattctattgtgtgggcactatcattattcttactgacaaaaaaggaaacaggtttataatttgttcaaagtcacactcagaaaataaaggtactaaatctgactttagagattgcactcacaagcacaaagctatatgttccataatatcaatcagtgaaatagtatatattaatatgatttttatgttaattatatttctatattcatgttaacctgtttaaagctttgaggaataatgtggtaatagcatctgtttaactttgcttagcccaatatttctaaatctacttagctacagaaaactcattacttttagtggaactagtgtcctacagaatatagttccaaaaatgctgatataagtaagctataatattgctatagatgagaagccagaaagggagtagctctttagtgtttctctagccacttgttccagcgtatctgctggtgtcctctgcctatgcatgccccttgctgatctccacctgatgatttggaagggctagaaatagggaagcaaacacctgatatctttgctgctacaggtgcacagagcactggaactctctgcgtaaatgtgtaatatttagtacatcctgcaaaaggaacaagcttaatttagttaagccacaaggttgagtgataaacagcatgttgctgttattgtttagtcaattaaatcgtcccctgcacttgtaggaactgttccacatttattactagtgagaaacaagctcgggcagggttgttgatttccttgcattgggttgtgttatatttagcacatctaaagatttgagaatgaatgatggaagacacagtgataaattgtcgagcttttccaaagattcagaagttctaaagttcctgccagtgacagatggtctgtccttactcattgcttgtcttcctgacaggacttgatttttttttttccttttttgctcaattcccttatagtaagctcagcttcttgggaggtgggatagtttaatttgttataattacattgctatatttcaaagtggcatcaactctatatgaacatgtcatgctctttttagattattaatgtgcacatgtataatgacaaaagagaattataggataagaggaagagaggaaattcattaccaagggaaagccatacctcaatctttcctgttattttgataaccaagcatattattaaatagagtcctcattggatagtggttttttaaaatcaatattattttaataccttcaatattttataataatcgaaaactttttgaaatttttgtttaaacagcactagtgtttatgagcttgtaaaatatttctaagaattcacacaatgagcccaaacaactataataatgatgtgcctagatattaaacaggttccaaatgaaaaaaggaaaattgcaatcaaatttcttaattcctttcattgatttcaaatacgttcactgctaaaataggagattagaagatatgctaaatagataaggaatgtgggaaaagaaaacaatttcctgtggcagtaaatataaaggctttaaaaattctagcttgtcttcaaataacttctaaaatccagaagtaatttagccctcaagttagtaatgccactagtgtgatagagcattatatagctgcaagtgttaccaagtggaaagagatcaacattatttaaaactataaaaacaatcaggtgaattgatttgggatttataatagttgtcttctgttatctacacaaagagctcagaaattctttttaggtaaattatttttttgtaagtgctcactccatattagctcaatttgataatacatgagaagcataaacaatattatcactgctttttctcctttatttcctttaattctacttctactggagttttaaccactttgaagtgatatgcatataagtgcatatatgtttcactgaatatatatatatcatactactatacattcttttttgtgtgtgtgtgtatgtgtgtgtataatacactactcatttaagtgagagaactcaaagcttactggatttccaaggtctaggctattgaattccattttatctttttattccccttactaaatgctcctaccattactgatatcagttacctttttattcagtggctttttaacattgctttattttggtaacatttgattacaaaatctcagagaactcatgccagcccactggttatgcatgaagatgttaacctagacctagggaaattataacccttgtttagtgaatattttctcagataataaatggaagaattaactttctgtgtagaacattacaaaaaatttcaagcttctttaacacatgatgtcacaataatacatggattttagttgtgtatattacatatacattgatatataattaaaaagacaagacatatctgtttttttattcttaaggaccattctagtataattcgtttttcttctccagataaaaatgtgtttgtaaaaaagattctaaatattcaatatttttgaaaaggccaagaaatattgcataattttgaaatcatgccattataaaatcacagaattaaaagttactctagtgagtatgtttattaaaatttattaagattagaaaaagtgcatagctgaagttaataaaaatgctttgcattaaagataagatgggctaaattagtctaacaagtagacccaaaatgtaatattctactactaaagatttgtttcatgtcagctcagcactacagcatagagtaggaaaggggagtctgctccatgcactggagctactgtggcttccaaggtctctaggcgtgacgtcacaatcctactaagctggaatggacagagagcagacacaagcacatgggaggttttatgagtcaggtttgaaagtggcgtacatcactcggctcacattctattggcttagaactcagtcacatggccttgtaataccctgcagtggaggatgggaaatgtagtctagctgagtgtcccagcagaaggagagaatggattttgatgatcatctagcagtttctaccacatgaacccttgactttgcttaaaaattgaggtgactttaaatgattatgctattaatatagtctagtttttctgataaactttgtatccactcacttgtttgtagggcagggtattttttaaattcatttagtaacctaaattggagactaagtttgaggactaatgattttagaatagttggtccaatagaactcgtaggagacctgttaacttgaggacccaaaagagattcagatagactctttcttaaaaatgcacattaagacatacaggactcatactgaaggttcacagatacttagtacttgcctatggtgaagagcactcaatttagaacatgaagatagatgatttatttatttatctgtagtaatgtgctaatgtttgcttgtaacaaatttatactgctaaaatatcttagatgttaatactcatgaataaaaccaaagaccagaaggagagactatctccttgctgaccctaagcaacagaggatagtacagtgagtagaatcatggctttagacaacatgtttgtctttcttcttcactgaaatacaggatttgtgcctcaatattatttcttgcttttgcctaacatactttaagatgaagagccatgggtaaatctcatggtctagataagttaccaacaagttatcatcataactcttaccttctacttagtccataaatgctgttgcacaaaacaacttctcatttagtaatttctacaggtgatgcagagtgcttatagtttaaattttgccttatctgattacatagcgaagattattatttagcttcaaatgaggataacttaagctaaatagaatcactgtactactattgcttcagaagtattttacatccatgctgcctatctattggtattcacttctttttctctgaattctatttacatattttagtagtggtttacccccttgtacaacatatttctctttattttacccagaaacccactttccttatatcttagtttctagtttgaagtctttttaatctaatggagtctcacgtattttctgttactttttattgttaataaatttttcattatttgtctcttagatgtttaaagtaaaacaatcagaaaatttgaaataaggattaccattactggtataaagtgttttttttttatttttttttagctaaaactgaaaactgccataggttatgttttaattattaagtttcacctataagtggagtatacatatatttcaaaaatgataataatagtccctggagtgtgatggtccccttcccgtgtccatgtgttctcattgtttaattcccacctatgagtaagaacatgtggtgtttggttttttgtccttgcgatagtttgctgagaatgatggtttccagtttcatccatgtccctacaaaggacatgaactcttcattttttatagctgcatagtattccatggtgtatatgtgccacatttgcttaatccagtctatcgttgttagacatttaggttggttccaagtctttgctattgtgaatagtgccgcgataaacatacgtgtgcatgtgtctttatagcagcatgatttataatcctttgggtatatacccagtaatgggatggctgggtcaaatggtatttctagttctagacccctaaggaatcgccacactgacttccacaatggttgaactagttgacagtcccaccaacagtgtaaaagtgttcctatttctccacatcctctccagcacctgttgtttcctgactttttaatgatcgccattctaactgctgtgagatggtatctcattgtggttttgatttgcatttctctgatggccagtgatgatgagcatttgttcacgtgttttttggctgcataaatgtcttattttgagaagtgtctgttcatatccttcgctcacttcacaccagcatggcatgtgtatacatatgtaacaaacctgcacattgtgcacatgtaacctaaaacttaaagtataataataataaaataaaattaaaaatgataataataataaagcttagaagtagataacatatcctcaattatctgatcatgtactatctctacacctcaataaagtcacagggaacaatgtgatgtataatggaatagtatgaaacttgtaccaagtgttaaaaaacaaagattctgcaactaattacgtactttgaaaaaacattgagtcacataccaaatatatttccaattttattttttgtgatgcaatgcacctcttagcaggtgtttctcggtagaacaaagaatagccaacaaaatgcaattcaccttctataacaactccttgatagttatttgaaagcatcttcatttgaaacccaatcgctgagtattattgctaaaaacaacagaatgacctcttacaaaagagtctcacttattatatgcccatgccatgcataaatcagaagaacgtgtcttagaatatgtatgataagatttattagcgtagaaaccttcatatagaaactgcccctactacacacacacacacacacacacacacacacacacacacgcatgcacacatctgaggcttacttctttggcctaagccaagaatcatttagaataaatgtatctgaagttagtcaaacaaagagtgctacccatatatttttattcttccttttaaatatattttatttcttttcatcttattagcaatctaaaagctactaaaatttcctacccatgctttaatgctagtatgttgcctatcacttttggtatttaactttcagataattttagaatagatcaccttagaatacacgttacaaacattttcaggagaatacagagcagtttacttagtcaaaacagtagaaagcatatacacagagaagtagcagcagataagaatattaagttagagccagattgtagaagctatgtactttgatatttattaggtagatgataaaaagacatcaaagtttatttcgagtagggaatgtgatttgaaattttaactccactctccactctcagttaaatcacaaaacagtgtattttatttatgtatttttttctgttgaaacccatggttttctaggttttgatgaattatgttttcaaatataattagcaagtctacagtgcatctatatgtatgtcaaatgcaaatgcatctacagtgttttgctaataatttttccatcttcaattgagtaacaaagacctttctaacatacgattcattttttgtcatttgcaaagtatattcatttagttgggtttgttttgcatgattaattttgactgatagctgatttgttttctattctaggttgtggagactaatttggttgcttttgactgtcactggatcattataaatgaggtaaagccaactaaaccttattgttaactctgtgtccttttttcacatatataattgtagcatttccaatggccttgaatttttaagcggaaacaaaacttgaagtaaacattcaacttactgagtgaatgctgtttaacaaagatagaatgaagagtttttaaaaatgataaagggttttatattaataaaataaatggagaaagtctttctcactgagtctcttttagctctttctgttggctcattctgcctgctcaaggagatcatctttataaaaagtacagttctactttgtaagcaaagtaaactcctcccagtggagtgcttgtgttccatttatattttaatgttgtttctagaactgttatgtccaccctccttacatgagtattaaaaagttcagcatatgaatatgaataaacacagaacagatttttcccttttcataaggaagtacaactgttttcaaatctttagacttgtcaaattcttgtgaaagtcttttgatttttgcaaagataatacataagattaaaaatatattacaacctaaaagccctgggaaataagttgttccattaggacctgccagtcagaaatggaaggaacaatgagcaggtcagtcatggacaaataatgtgatcacatacatttttcctcaacaagatgtagtacttggtcatacctattatttatgaataaaaataatgtaatatttacttattcattatactaaatacagaattctagaataataagatttcttttagggacaaaatagtatttttggataagaatcctggttttatagtcagcaagataggtttgatcctggctataaaacttggtagctgtcttaacatggatatcagcttcctgtgcctcagtttattcatttggacaagtataataacaattactttgcatgttcataataaaagttaaatgaggtattatcaggtgctcttaacacagtgcttgacaaatgacacacaagaatggtactgcgataatgatcatatcacgttaaaattcagagatcattcccttatatattatcttatggaatactaaaccatattctctgaagtactgagggaatgaggtccatagagaataaattattttcctctttttacacagaaaagtgaaaataattcccagtttcaagttgtttctcctacactacacttcaatgatggaatgatcctttttatttcagagtaaagacgctgaaaacaccttacaagtctgtttttggtctgccaaacattaggtttctatgaattttagctgtatttctcatgtcaaaataagataggtttttctgagatttcctcaggcaatacgtatctggaggtctgcttttcaataaagttctggtaccttctaagtttctagtatgtcttaattttcatgtggaataactaaacgttgggatagagggaaagacaaaggaaaaggaacttaataaaccttcaaattaaatattttcatttcaatttttctccaaggaaactaagtttcaaagaaattaaacaattcagcaaatattacacaactattagtgatgataatggaatttaaaacttaatctttttcagtgtaaagctttggttggttttgttttgtttttgttttgtttttagcttttaagttcaggggtacgtgagcaagtttgtatgtaggtaaactcgtgtcatgggggtttattgtacagattactttgtcacccaggcattaagcctagtgctcattagttatttttcctgttccttttcttcttcctactctcttcccttcagtagaccccgaagtgtgttgttcccctctttgtgtccatatgttttcatcatttagctcccatttataagtgagaacatgaggtatttggttttctgtttctgcgttagttcgctgaggaaaatggcttccagctccattcatatttctgcgaaggacatatcattccttttttgtgattgcacagtattccacaatgtatatgtgccacattttctttatccagtgtactgttggtgggtatttatgttgattccatgtcattcctattgtgaatagtgatgcaatggacataggcatgcatgtgtctttatgataaaacaatttatattcatttgggtatatacccagtaatgggattgctgggtgaaatggtagttctgcttttaggtctctgaggaaatcaccaaactcttttccacaatgattgaacaaatttacactcccaccaccaacaatgtataaacattcctttttcttcacaaccatgccagcatctgttattttttgactttttaataatagccattatgactggtgtgagatggtatctcatagtggttttgatttggatttctctaatgatcagcgatgttgagctttctttcatatgattattgatcatatgatgtattattttgaaaagtgtctgttgatgtcctttgcccacttttaaatggggttgtttggttttgctttaaatttgcttaagtttcttgtagaacttaaggataaatagacctttgacagatgcatagtttgcaaaaattttctcccattctgtaggttgttcactctgatgatagtttcttttgctgtgcataagctcgttagtttaattcaattttgtttgtcgatttttgcttttgttgcaattgcttttgtcatctttgtcatgaaatatttgcccatttatatgtctaggttgttttccagggtttttatagttatgggttttacatttaaggttttaatccatcttgtgttaatttttgtatatggtataataaaatggtccagtttcaatcttctgcatatggcttgccagttatcccagcaatcatttattattaaaggaaagcgtcctttccccattgcttattgttgtcagctttctcaaagatcaggtagttgcaggtatgcagccttatatctgggcaatctgttctgctgcattcatctatgtgtctgtttttgtaccagtatcatgctgttttggttagtgtagcactgtagtatagtttgaagtcaggtagcatgatgtctccagctttgttcttttcccttaggattttgttttttgatacatgctttttgatacattttcacttagaattttgtttttgaccatgagaacaacatgatcacccactgtttaaggctcaatttgtactttgggagaaatagcctcttcatattatataggtgtaacctgaatagactagcatgtatttaattggtaataaataaatattttttgataattatctttatggtttatatttttgaaatttctactgcctcagttataatctgatgggagctatttatgtcactagcttttttgtattaattattttctagattactttttttgaaataaggattcttctaattttttgtttttatttcacatcctactttggacaggatatagactacacagatttcctgatgcaaaaccagcgagagtcattttacctattcatgtcaatcaaccttactagaaaaataaagtgacttcttacctctttagagaaatggattaatctggacaaattaatgcttacaatcactaaattgaaatggccattctcctgtattggttgataagattgcagaaggaaccccttaattaattttttttaatatccaatttagcttccacaagtatacctgaacttaaaagtataaactgaaatagagcttctgagaacaacatggtcatttacccactgtttaagactcaatttgtactttggaagaaatggcatcttcatattgtataggtgtagcctgaatagactagcatgtatttcattggtaataaatagtatggaaaaaataataaaaatttatgttttattgtatttttcataagcattatgattcatgtttttaaacttattaaattttatttcataaaatattacaaatgaaaatattgtcattaagtggatgctccataatttgggccactattttgcaaaataaaacatccatataaacaaagcaatctcactggtaaataactcaatacatgttagaagtctaggagataattaaggagacctcaattattttcttatccttcaaacttaggttttctactgtgaattgtctaataaaacttcaccatcaccatcattgaaaccgttatctctttcttacccacagccctactttcttgtcttccagcagaggtataatttcttttgggcaagccacactgcctagcctcttaaaaatacaatgttcacaacccataccatttacattacacaggttagcacttttatctgaacaaggttaaaactcagataatgagcaaatgttttctgtattttaacccataaaaaaataaacaaaaaccattattggctggtatatccaaaatcaacactcttactttcaaattattccattcacccgcatacttattctcattcatccactttattctgaaatatgcctcagaaaatgacttacatttttcttgcacacttttcatttacatgcttgtttatgggaatttataatggatgaattataattttccctagtttctataaaagaaaaaaaaaacatggatttctcaatattgctaggaagctactaaactctaaatgtaataataaaaaaaaccctcaaaagatgcaaatgcccgttttggctgaacgtggagaacatgaatctgtctagttttgtttgtgtagctattattttgttgctaattttaaaatgggttgcagacattgatttaatcttattgcatcaatagtttttaaaggagggaatataaatcaaagttggcattgtgcatcatgatagaaattaatgtagaaacttgaaaacaatatatttttttcatttgcattaagtgtgctataataatgagaggctgtgctagctcatatggtgtaatcaatcatatgttagtacttggtaatagtatttatcttctccccgcaatcagtggatccagctcagagcagcctttccgtgcaagtattgtcatcccttcagggccctgaagcagatggcttaacactttatttaagttttacaaaagttagaaattcagataggaagacgtgcactgttcagagctgcaagaagcacaatgcttcatatacccttctattgcctgataatatcaaatatgacctttgttgtcttgattgactttactggctttttacttaatttgaatagtgtaagacattattctctgttaatcactgctgagtattacatttaatgagaaagttgttggtttggttttttgttgttttttttttcttttttgacagagttttactcttgtcacccagactggagtacaatggcgcgatcttggctcactgcaacctcttcctcctgggttcaagcgattgtcctgcctcagtctcccaagtagctgggattacagggatgtgccaccacgcctggctaatttttgtatttttagtagaaatggggtttcaccatgttggccaggctggtctcgaactcctgacctcaggtgatctgcccaactcagcctcccaaagtgttgggtttacaggcgtgagccaccgtgcctggccagtttggggggttttgttgttgttttgagatttaaaaagcctatatgtgtaatggatgtttttaattttttctagtttaatgatgaattgaactgctcacttctaagctttcaagtagaaagttgccatcctgcttctcttcctgttggtacatagcctacagttggatttgttccattttttaacatttgcctaattgattcatattaatgttaaattttatggaagcatcaaagggtcatctttgctaaaatatgaaaaatacaaacaaataagaaacaaacaccacatagtagagggcttaatcttaatactaaaatcttctttatttagaattgtttaacattttaaagtattctggtgtctagaattaaaatttcaggtataagtctttagaagatgataaaatcttaccattcattcattaaataaattttgtatttatcaacatttattgaatacctactataagccaaaatatttgttagatgctaagaggtataagaatgggaaaaaggaaactattcctctgaaattgttatttttagtctaaattggcatctgatccaatggattttgagagtcttttcttcccacaatcttattcatttcaacctaaagctgatatactacaaggattcagaaatgattcaattctcctaagagatttcttctgggaaatggctgtttctagatggagttgtatccccagaagatattttagcattccttttttcttcctcggggctttcacagttcaggattcaaccgacattaaattattaaagcaaagtgaataagaatattttgtcggacatattgactttgattcttagtagttttcaagtatctaggtaaattatttttgggaaaaaaggcttccttagcctaaataagtaaaatagaaaagttaagtcgctaaaaaatacttaatcatttgttattgcaatgttaattctacttttatgaatatactcaataaaataaagaatataagaaggaaaataattttataatttgggttctttaaattacttagagctcaggaatactctatatcttttaaaagattaagatatttaatggtgctgggggcttgggagagtgagtgctttattggtaaactagttcttcacatgattattttaaaaaatctgacagtttaaacattttttaaaaaattcagagcattaggataatatagatcctagtacattgtataacattttaatacacaagtttatttctggacttttttccatttaaatggatctctttatagattaaatgatcacttgtctttcagtgtttatataactttgcatctgccactctcgaaatgccccttttgaaatgcgcaagtaaagttccgtaaatataaaatagctgcctaatcaagttttcatatcactgttaaactgtttttgagatcacatgtcaagactaaaattgcaagtgaattttttgagacagattgtctgttagtttctttcagaatgacagattctttcttcccagaaaattactttctcttcccttccccaaataataataggcaaaatacactcaattcaaactgacatttcttcagatatattttagttgtttaggtgcctgagaacttcatctttggaaacctataaaaggtaaccaccccttttccctttttgtgggtttgaaaaatgtcctcttaaaggatttggctcatgatagatgactacatcattccttccagaatcatcaggaaattaaatgctgaaataatgtatctttacagttttaatttctaccattcataaatattaatctaaataattcctgtaaggaaatatgggcatgtataacttcttcagagactgtttcttttgatgacatttataaattcatcctatgagtagagtattatgaatgaagagcttcaagtcttcctgaatctttgtttataaactgagaataaatagcatctgattcagagtatcatctgttagcagaaaatgagataataaagtaattagtattttgcttaacatatagtagatacttattaaatgtgaatttttatccaatatgctgatttgtagttcattatgagtggtgtagatagagatgctgctgtttgataaaatgttgataaatcttagtattgctaaagcaaaaaaaaataccatatacataaaacaacttagttaatgttatgagaaaagtcatacaattttccactgccttcaaatgaaagttcctgtctgtatcatttggaatttaaaaaattggaagacattgaatagcaatattaatattaattaactttaaaagatgtctggttaaaatcaggacttcaaatggagttgacaggataccgtttaatcctactttgtgagtagattacatagaatttaaaagtgacctgctctttgacagacaaagtttttggtggccagtgaaatgacacagactaaaggaaaaagacggcattttaaactgagaaaaaccatttttatggaacattaaggattgattaaatgcccagaaatccaggctattacactagagctagctgatgggaggcatcattttattttcagaaaaatctacacttcataaagatcatatataaaggacgatttttgaatctaacatatgctacaagaataatatgtaattaatctggtaagaaaaaaagaacatttacacctatgaattatctgttttctttcattttttttgtaataatttcttagatcaaacctcagaaatgctcactgcaacccaaaacttattttgtttcccatcttttatttctgttgccgtaaaaattgattgaaaccaatagtatgttaattacaaagacttcattcgttgtaaaggttccaaatgaacactattaagcaccaacttctctagtaaagactaccttaaaactaaaatttattttaatcacttttatcctaattccatttagaatagataaaatttgtttagataaaattaatttagataaagagcactgggtttctctctcatctcatcctgattcagattgtattaaacaacagaatttttcatctattccttaccaagagaaacatacgagttaacatcaacaattctaataaattattagaaaaacttatatatcctcttgctctacttgcctcagttaaaagccaaatttttcattgctaattatgtgtgtgtgtgcatgtgtgtgtgtgtatgtgtgcgtatgtatgcatgcgtatgtgcgtgtgtataactcttacatggcaattaccttcctagatactcaaagtaatagtattaattaataataaactataatagcaacttactttgtgacctttttaaatgttttgaccacacctatgtttctacaatgttcaacattataaattataaacttattgttaataaccatatgtaagacaattgctccatttagcattgtttaggcactaatgtatataatttaaagcatagaaagcaactacaaatgagttgataattttaacaaaaatatgttgctttcatttagatatgcactaagcattaaaaccaatatattacagtaacagaatccctaacatttacagataacaactcataataggtttgtgttttgtgactgtattaaagtatctctaattcttccacctcttatcttataggaaataaacgatgtggacgtacaggaacttgtaagaaggtcaattggaaggttaacgattattcggcagacatttccagttccccagaacataagtcagcggtgtttccgtggcaaccatcgaatatcttcaacattgtgtgatccaaaggatccatttgctcagaatatggaggtatattataaatgacaggatatttcttccagggtgctttgttgggcaattgcaaggagagctttatgagttgcattggattcagaattatacgtgttatttctgaacaattctcctccagcaatttcataagtctaatggggagaaagtgctaagaatttgcgtctttgttctttttgatctcattatagaaaaatttctacttgcttaataaaaaaatataataagtaaaggttattttcttctaaacaagtaggtccataacatttcccacaggagaatttgtaattggtactcctttttccaaactctaaattattaaactaataaatgtgcttgacttttctggcctaagaaggacatagatatttattctttttaaaaagattggtctccagtttgaataactccaacaaaaaaaattagatatgaaaaaagtgctgtagaattgtatggtcatatccaactccgagaggatatagctgaaaccttcagcatccagaatacaacaaagaatttgaaagatataaataaaacctctgaacagcgaaacagagaacaccaagtccctgtagcttactcataagaatgccctttaaatacttacttgaagcctatttctttttcttaagaaaaagcctctgtggtttttttttcactttgctctggagatctcaatatgtcaatctgaagggggtgttacacaaagcaggcacacaggacaacagcagggagccttaaggagccctcttaagcaagagacgggaaaaaaatcaatcagataaactaactcatataacctgtcagtataggactcttcctgcaaaaacaaatctgtgccataaaacaactcctaaaggtatcactgcagtataatgctagcatataagttaatatttaaacaataaccctgagatattagcaaatattaaagtcatggccaatcttagaagtaagcaaaacctaatatattttagaaacttgttctttaaaatatttaccataggaaacattttagtacttagagattttcagttttaacagtttggaaatataaccctaggaaaactagttcctctctaataatactagataaataaggtgcttttgcaaaactaatctgaaaaataaccccacaacctccctatccttagtcacctttgaatttttaaaaaaggatttgccatttatccaaccatttcttctaattactatcactgtagtacgtggactggctccaggatcattaccctgtaactttctgttgcctactagattttaagctcctttagaataggtcctttccatggccaggtgcagtggctacacctacaatcccagcaatctgggaggtcaagggggagaatcacttgaacccagaagtttgagaccagcctgggcagcatggcaaaaccccatctctgaaaaaaataataataataattagccaggtgtggtggtatcctcctgtagtcccagctactcaggaggctgaggtgggagaatcacctgagccctagaggtcgaggctgcagtgagccaagattgtgctactgcactccagcctccagcctgggtttcaaagtgagtccctatttcaaaataaatagatatgtcccttcaagaacccagcatcataagtactcataacgtgcttctctaccatttcctccatcataattaccacagtgctttggatctgtgtgaatatatatgtttgaatgtaattaaggagaaggcaatagtcaaagtaaatcttctgaagccttaacaacatctctttaaatttcagttccacccttatctatatgtgtattagttcattctcacactgccataaagtacagggaagaggtttaatttactcacagttcctcagggcagggaagcctcaggaaacttacattcatggtgaaaggggaagcaaacatgtccttcctcacatcgcagcaggtaagacaagtgctgagcaaaaggtggaaaagccgcttataaaaccatcagatcttgtgaaaactcactactatcatgagaatagcaaacggataatcatccccatcatttgatgacctcccaccaggtccctcttatgatacatgggaattatgggaactacaattcaagatgagatttggattgggacacagccaaaccatatcaatatgcttataatgtcccatgtttgcattttaactggtcatggatataattgatgtgaaaatgatagaattctaaatagaaaaaaaggaaagaattttgatttagaaaattataaaatattaaaagttgtgtttgttaaaagaagtatcaggaaatgaaatacaaacttaagaaaaattattgactgtgtcatttagggacagcagaaattattttacagcatatttgcctaacaacataatctttccatttcagttgatgaggacttcaatatctgtgaacaaatattttatttatgtctatattcctaatcttacctgaaacaataaagtatggggaagcaccaacttcctcctgactcataccttcatcttggtcctgtcaaacccacagatggaagaaaacaagaaaactacttttgcgttgaggatttgttacatgtgaacatccctcttatgtatgatagaatttgatctctagactgttacctattttaatatacatagacagagaagtaaaatttagaaaaaacagaaaatgcatttcacaaattttttaattagtgtccaaagactgaaacccaggattagcttaagttgcaaaataaatattaaagaacaccttttagctagaaaatggtgtttttgcaacatatgtaacaagcaggaagtgatccatttactgcttagtggaactaatgttagtttggctgctaatggagagaaaacagaaacattctaatacttttgctcctttctccatctaagaaaaattgtcttcaaattgggaaggttagagtaaaattcattaaaagaaaatattccactggttcagaaggagcagggagatagcaagagtaggggcactgctttgaattaggcttgccaaataattgctcagagtagccaatcagccagcaggaacgatcaaaatatgatagctcagaaatactggagaaacacttaggaagaggaccaaggtacaagagattggtgtattgtcccaattactgaaaggaaggaaaaaagattctcatggagtttagcatattaaatgttactatgtagataaactgtagaatatattattaaatcaatggtttggagtacctcagataagacaacagggcttccttaaaaacaaacactgccaaactaagcctttatttatatatatatatatttttttagattgggagaatgtcataaatctatgtgttacatgttgatttttatgtggtgtttgacaaatttttacctgaaatccttaggaaagatattgaaaagtcttgacagagtgatgacactgaaacattttcaccaaagggttcctaaaggcagaagatagtgaacactctggcctcagacagaaagcaaaataaagctcaaaaatatttaagtctcattattacctttaaaagttataacatttgtgtatatacaattaaaagtaatacttcaaattatttgccaattaaactagttgtttttctccaaatattcaaacaaaattgatatctaaataaatcaatcaaatcttcaagcaatattgatatgactagaatatgccttagatgtattcggtggctttgagtacttcctgatatccacaacctaccaccagggtttcttttgtccagagtttgaggattgtagaaccagatgaatattcaaactgcagtgataaacattctattcctgaaatgcaaggaactgtctatggtcattcacaagattctattcttggacctaatatttttaaaacgtctatcactacgtgaatgaagatgaataaaacatgcctatcaaatttgtaaatggcataaagctagaagagaaagcttatgttgtattagataatcaagttccaaattgttagtgttgactgaataataagcctaaatttgaaaaagcacagataaagtataggttcaaaatcaattacatgaagaatcctggtttgacagctgttcagatcccttaagttgaaggtaaattcagtgtgtgtatcacacaaatcatatttgctgtaactattttaatataatcgtggtctctatgtcagaagaattttgctaagataaagagatctaatgtcttacactattctctcctagtcagatcacatctgtaataatgtgtcaattctggatactaaatttttaacagaaacattgaaacacaagagaaagacagagaaagagaactaagatgatcagcctagaaacgataccaggtgatgaaaactaaaagaaagatatctcaaagcaagccacagatggtgtcaaatattgaaagcttgtcatgtagaggaggtgagtgtggagatttggtgatgtcaaagaataagtgtagtgccagtaaggtagggagaaatgattggtcatatgtgacatactggagtctatgattttagaggtgatgtatgtttctgtccagtaaatggtcatttgtgttggttgaggcctaagtagaagtgaagatcatctgtacagaaattgaagtgaccttttaaaatgatgagagatagtttggtattattgtgaaggaggagtcaaaggccttacaaataaaataaaattaccaaaagatcagttaatgatgacagaaaaaagcaataaagtgtagcataggaaagagtgtgaagctcaaagaatgggcacttgcctgcaaaagaaaaagtgtcagattaggaggggtaatgaaaagctcagggaatattaccaccacttcttgatcctgcagtttggaatgtggacaaatgaggagacgtagtcatttattgaaaatgcctgtcatgtaacaggtacgaagcactcacctttaagactagcatagatgctcaaaatacatgcctcacggtctgcaaaagagaatgtgccccagcagtgtcaggtttggatagaacccaggttaccagatttttcgtgtctcaacgtctgccaaacacacctagctttaaaattgactttctttttttctcctctctccatccttcgtcttcttttacttcacaactgtttatcaaaacccaaatatgtgcgaggctctaggctaagtcttagagaaataaattacggggaaaaatggaagagaaaagatgtacagtatgagtccccatccaggaggaatttatttttttgtggaaaaggtagatttaaaaaagaatttagtattctgatatgtttcaaagacgtatgcactgtgtgttccggtagatgaaaagaggtgctcaaccttgtgtaggataaggaaagaaaatcagaagttggcagggtaggattctcctagcatgtaagctttgaaccaaatattgagaaatgttaactagttggagaaaggtaaggagatagtgagggatgctaccccaacaatcttttttttaaatatatatatatatatatttttattatactttcagttctagggtacatgtgcacaatgtgcaggtttgttacatacgtaaacatgtgccatgttggtgtgctgcacccattaacttgtcatttacattaggtatatcttctaatgctatccctcacccctcccccaaccccacaacaggccccggtgtgtgatgttccccatcctgtgtccaggtgttctcattgttcaattcccacctatgagtgagaacatgcggtgtttggttttttgtccttgtgatagtttgctgagaatgatggtttccagcttcatccatgtccctaaaaaggacatgaactcatcattttttatggctacataatattccatggtgtatatgtgccacattttctaaagacacatgcacacgtatgtttattgcggcactactcacaatagcaaagacttggaaccaacccaaatgtccatcaatgataccccaacaatcttaaatacacgttcaccaaagggaagagtaaaataaagctagaaaagtaaaaggaagcaagtttcaggcagtagaaccaggaggggttaggaaaggccagaaggttgtgtattattttgatttccctgggcatgtatccttcatgtaacttctatattttcctgttgggtctttactgcctaattccaacctgaatgttgattcatggactagttttagctgtatagcagacttcagccattcttttgtagtctatctagtaattatcaggcaaaatggggagtggctgggatagggagtgaaaatagccagtcctaatacttccttatgaaggacaaacttgtattgcacgtaatgcattgagtgttcaatgtctcttcaaaaaaggcctacaagtattatacatataaaatgatatttaacaaacacaaaggattgaagatttacatggtatgtaaaagaaaactcacaaggcactgttaggaagttcttattaaaagctgtgcattgcatcagactctaattatctcaatagccaaagcttagtaccatcctgtgatgtgggtagactattttaaaaatttcctccatgattaattataacccgaggacaatccatatagtctcctgtatgtttttaggaaaaaccgtgataacaatatactttcaaaaatctgaaaaacacaaatgctttaagatggaattaattttcatcactacattgattcctcattttttttattttatatagagtttttccttcagaggaaatataacatgaagcagcttttattgacctaggattccttttggtattatgttttccaaaaaatttttaacttctttgaaaaataagcacctttggtgattaattgacagtataaatagtagttctggtgaaacttaattgtaagaatacagtaaaaccttagcaaaaaattggctataatttatttttcaatctatgtagaaagaagttaataacatggttgtttcagaagaagaaagtattaatgtaaacacacattcacaaacagttaatagtttatggtatttgtgaaatcaatgaattgtaatgcatgtgtatacctgtataattttgtatagatccttgatcactataatacatataaaagattgtgttctttcattatttcatttaagaatctccatatacacaaaaatacacacagtagactacttcttttttaggtacctatgacattcatatatgaaatcaagttgatatttttccatctgaataactagaatgcaaaaacttaacatattcagaaaatgtattattcagtttgcccttccaatcttaaacccttagattcttacctcctcagagagaaataagggccaatgattttctaaggtctaacactaacagccttatctctgtcgaaatttctttctttccttttttaatcttctctttcacacctaaataagctgaaaaagcaattgaggcatacaatcagacaagacttcattctcaatgacaaaattgcccaggaaatgacaaaagaaaccttctgcttaataacccagtaaaccagccatgtatgacatgaacagaagcagttgagacaattattttttttccttattcctgatgactggtgtcaatgattctaatgatcactttctaatgtcttttcagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaaggtaacttcttaattttcatgtaaaaaggatatggtaaataattatttgacatattttagaaaaagggtttcctctttaatatttctacaaattctaagcacaaaacagtgtaatggggaaattaaatattgaaaaagaaaaaaggtgagagagtcatcaacatataaaaaggggaggcttccttatttatttataagggagttttaagcaagtaaaaaaaattgtggttgagatatacccacttgactatgtcattagcattagagatactgaaattgttttggtgcctgtcgcaaaatacaaaaggcttttaaaaaaacacacgccatccactaaaaaaattaacagtagacttaattagcactttttcagttagataatatacatggtaagacactggatgtgatggcctttaatttatctcatgataaggataggattcataagtagataatatgttgcagcatttgtgaactatttggggtaactgattgcattattcctcttcactgtccatgtgttgcttattccagctgtgaatctgtttggcttagctacctgttccattcccagaaggcagtttatgttgtttagctcctctcagtggtataagcattctgcagtttattagactctttgtcatgtcatccttcttgacattttccatttgtcttgtaccgcctcttggatttaaaatgaaatgattaataaaacaaacaaattctcctataccctttacacaaaggagacagacatttggaagtttatattctgtattttacccatcctttttctttctgcatgtattttcctttctttcctgaaacccaaagaaaaatagctagtcaattgaaatataaatgcccttaaaaagtcagagtaaaatataaaactttaatattagaagtgaactaggtgtacaaaaactagaagtagaggaaataaatattttaaatagagaatagcctggatctttctcttggtacttgtatcagtcccttttctgctgttctaactgattaccacaaattgggaaatatataaaaaatggaagttttttggcttatgattctcaaggctgggaagtccaagaccatggcacccacatctggagagggtcatctcatggcagaagagcatcacatgctgagcagctgcacaagatagagcgaaaaagggggccaagacttcctggataactaatccactcccattatatgggcattaatctatttacgaggtggcatcctcatgatctaatcacctcaatgtccctatccttaataccattgcaatagcaattaagtttcaatgtgagtttaggaggggacactaaaatcatagtattccatcctttgacccccaatattcacgtcccgctcacatataaaatatattcattctatccctatagttccaaaagttttaacttgtttcagcattaactcaaaagtccacatttcagagtcttatttaaatcagatatggaagagactcacatgattcatcatgacgcaaatttctgccagctgtgaaactatgaattcaaaactgattatctacttccaaaatgcaatggtgggacagtcataggatagacatttctattccaaaacagagaaataggcaagaaaagaacaataactggtcctaagtaagtctaaaacccaacacgaaaaataatattaagtcataaagccgagaaacaatatccttttacaccatgtcctcatttctggatacgctgagacagggattgggcccgcaaggcctcaggcaaccctgctcccagggctttgctggacccagcttctgcagctttcacaggttagagtcacatgctgttttagtcctacagttctgtggtcttagggatggtcccacttccatagctccagtagtcattgccctagtggaaactctttgtggcaagtccaaacccacatttttactcaacattgtcttagtacgggctctctgtggtggtttgaccctggagacaagtctctgcctgagtcttcatgctctttgtgacatccttggaaactttagtggaggaatccatagccagagttcttacactgtatgcctgaaggtgtaacaccatattgatgataccacagcttactacttgcactctgcagaatgacagcccaagctttacctgggtccacttgagccacaactagggcaggtgaagaatgttacactggaataaggggagaagagttgctaggtggccctggacagggagcccatgatgagtgccttgggcatatcccctgaaatcattttgccttccgagagactgtgagggcagcagcagcttcaaagacttttgaaattccttttaaatctttctcctattgtcctgataaatagcacatcgctcctttgtagccatgttaatatctttagcaaatagtacttgactgcacccttgatattctctcctgaatattatatatatataattttttttgacagtctcgcacaggctggagtgcagtggtgcaatctcagctcactacagcctctgcctcccgggttcaagtgattctccagccccagcctcctgagtagctgggactacagccacatgccaccacacctggctaattttttgtatttttagtagagacggggtttcatcatgttggccaggccgttcttgatctcctgacctcatgatctgcctgcctcagcctcccaaagtgctaggattacaggtgtgagccaccatgcctgtccctgaacataggttttcactctttacatagccaccctgtaagtttttcagattttttgtctgcttctgtctttaatataaaatctatctttaagtcgtttatttttctcacatcttattatgttatgtacaggtaaaagtagccaggcagaagcctgaatgctctgctgtttagaaatttcttcaaccagatattctagttcattgcccctaagttctgaattctacaaagtcctagaatatggccacaattcagccagggtgtttgttactttacagcaaggatggctttcaatccagtttccaataccctattactcatttctgtctgagacctcaccagaatgtccttttctctccgtatttttatgagtattctggtcacaacaaattaaataaactcttaagaagattcagactttctctacagctctcctcttccaagtcctcactagaattgttcttaaagctctattcacagcagtacagtttttttgctagtctgatccttcaaattcttcaagcctctacctttatgcagttccaaagtcacttccacatattcaggtatttattataacaacagctccacttattggtaccagttttctctcttgatttgtcttctgctgctagaataccatggacttcgtagtttattaagaacagaaatttatttggcacacagttctggaactgggaaatccaagggcttggagctggcatctgataagggttatcctaggtgaaaggacaccacatggcaagcaagcgcatgagacagagacaaaaaggggaccaaactcttgtgacaattaacccattatagttattaatgcaataacagcattaatccgttcatgaaggcaaaactctcatgatctatttatctcttaaagtttctacttctcaataccattacaatggcaattgcatttcaagatgagttttggtggggatttcaaaccatagtaatgctgtgtcttctttgccaaggataattttaatgagaattttggctgttatcaacaaaagtacttgagaattaaatgtattgaatatattggcagagaaagacttttcaactgaaaaatgaataagtctaatctagcctcaaggtgttgccaaaatcttccagccttatctatgtagagagctggcaggtataaatccaagggaggttgttgaacatgattctaatcctgccaatttattaattcatggtttggctaggatgcaggatcctgaatatatttcttcttctgaagctttcataccaagacaaaataatagtttaggaggttgcttagaaaacactttagtgagaggatcaggaggaaggaaagagagacaccataatatgtcagtatttttcatgtagaaattcaatatgtaagatattgctgttagaaaatttataaccaaaacaattatttaatacaataattatgaaattttattttgtgggactatgtgtacatttgtccctgtcagcttctgccccagtgtcacattttaaagaaatatatccattctttgtgtcaagaaactcagtttgaataatgtacatgattacaaatgttcaattttatatttttgtctcacatttcaaactgactttaaaaatggatttttagaaaaaaaaattggattactttttgcatcatatgagtgtttttggtcacctatttagatgtcaatgctggtgatactccacacattaagtgagaaagaaagttcattactcacatagagactcccaagaagagcagaatggccccagacagattcaggctggtttggacaaaacagagggagtggcctgggcctttttgttgactaggggttagggctggcaaaaggttcccactcatgcgggctggagatttgagaagctcaagtttcctacaggtgtcaaataagtagatgtaggatggcctttcttaatcagactgtacagatgtggggccaaagaaagggagggtaaggcttaaaaagaagtcagcagccagcaacacaaatgaggtcaggctctttattatgatgggaatattctagtgttgaaatttttaattacattcaaataaatacaaaatgcctatattaagggcacgctacatacacattaaaaatccgtgtgctgctgcacaaagtacaagcaagaagagaacaagtttctctccctaaattaatttctattcttattatggggaatgaaacaaaagaattaaaaataatgtcattgacatagtagtataaatgtctagtaatgggcaaggtttctgtttctcaggtactcttgtgtacctgagctttataatatatgaatcggtagaataagtgcctcctcattttcattctttttttaaaaattagcagttaatgcttgcctgtttattcctgccaaatattatcagcagccctgtgccattgttatttacgtggatgttgtatgatatttttgaaggaattatagttttaaaaatattgagtctttccatctataacatggcatctatccatatagttagctttttgtaatcctgattaaagatttatagtgttcttcacacatattttcattctatttatttctaaactttaataggatgtgtgtgtatgcgtgtgtgtgtgtgtgtgtgtgtgcatgctatcataaatgagatatgttccattagattttcaaactggttattgtaggtattaaaggaagatattgatgtttcatatattttttgactgacctgatcaactttccaaacttaattactggttctcttgtatttttcaaatatacattgatatcactgtcaaataaaattaatcactccaattctaatactttacgtattggcatagacttaaaaagcagcatgcaacaagtatactcttaaacataccaggagcattatctgaaaagaggatttttaaaaattttgtaaagaaagtattcttctatttttgttttattatattatgtaattaagttgtttttattagtaacttgtacagttatagagtagcaagtcacaataaagttaatctaacctttttattctatttttaggtgtacagaaccgaaattcagaaaaattaaatgatgtactaagtgttgcgtagctaattagttttaaataccaggttttttggtttctaatttggtgtctgtgtactttaccatttaccatttttcttgttcatggcaatcatttttattcactcctgtcaaagtcacttggctaaacatgcacaccaagaaatcatgggaataaacaccctcaattaatattatataaaccctatttaagttttaatatggcttgtttttcagtctttagtttattatgacaagttacattgttgtagcttctcatgaaaactatatttatatattgggaaagagttttcatgtagtataatttaatttgttagtgttatgtaacctagagcaagctttcaaactttttaactatataaatataatcaataaatttgagctgttctggaaaaaagtaggagaggatttccagagacacccaccacaatcagctcttagagctacaatttgaaaaccactcccctggggtatttataaatcaatttgcccagtgcagatctaccttcttggaatagtgccatgtcattgcaacacgagtagcctgtttttatttacagaagtgtactatatttaaatagaaatcatttttcatttttttcttagtgttaatatttttaatactgaaacaattttcaacagggcacttcattcatgtattaatcactcttttaacaggtatttatcaaatttctatattgtagaatgtactgtgcaaactcatttatggaattaccccgcaccccctgccaaaaaaaaaaaaaaaagaaatttagaggccagtagtgaatattgactaactatacaaagagctacactctaaggccagaaacaacaaaaagacccaaatgtggtaaatataggatactgtagaatcttagagaagagtgtaatgtgctgtggtacatactgagatacttgcttcacagccaagaaagacatctgagcctctgttcaggaattgccatggacgggaattgttccaccctctttctaggggcagcatgaatccaatgaacagtcattgcaaaactagaaatgtctaagttcatttcttcaggggacaaatatgaagggttatctacagactagtacgttggatgatctaaactggtattgtatttgcatcaaactttcatctcttcctctgtccagtccctcttccctcactccattgcaagtgctctctcagtagcacttcaaataaaccttctgcatacaagcaaatctccatctcatacctgtttccttgagaacccaacttagaaaatagattagaaatatttgcatggaactgatagcatcttaatggaaatttcaaaactagcaggcttaggatatataaagctatggaaggaggatatttcaggtggtagaatgctgtagctgatatatctattagactaaatcatttgtacaatgacaagagttgattaccagagtgcagagaacacataaaattgttttgactggaaagtgatttaggaaaaaaattattttgtgggtaaatgtaagacactaaataatttttggataaaatcagacctgaattttagaacacctttacctcttttatttaattttttaaaagctaagaaaaatcttagattcaaaattatgtgattgcacataaaatcactggacattttctatgtattctatattagtaagtgaactaaaatgtaatagatgtttaaatcaaattcttttgcattgtcttaattgaccaatttctgttaaaatttttgtaattatttttaatatggaatgtgggaaaatagaaaatatcagtttatgcaatatgtcaaatatttaagtaccagtacattttcttatattgatatatgttgagcccaacatatatcaatatgatatctgatagagttatcttgatatatgtattctatattagtaagtgaactaaattgtaatagatctttaaatcaaattcttttgcattgtcttaattgaccaatttctgttaaaatttatgtaattatttttaatatggaatgtgggaaaatagaaaatatcagtttatgcaatatgtcaaatatttaagtaccagtacattttcttatattgatatatgttgagcccaacatatatcaatatgatatctcatagagttatcttgatatatgttgatatctcaaaaagtattttttgaaatgataaaaatattgaaattataccatttcttacatggtaatttattcattcaacaaatatttattgaatactaccatatgttgtaccataagatcagagaataaggaaggaaaatagaaatatcaaaaataattacaagcatgatttgttctacaaaaggagaaataccaagtgttctagaaatatgtcattggagggcctacttaggcctgagagtgatagataagtggaaacgtttaggctaagtatgcattagccaagaaaggaaaatgaagagtattccaggaaaggggaaggaagaatgcctcatgcaaatgaaatagaatgtttctaggcttgtaggaaagagagcttaacacattgaagcacctgaaataagcccaaggcagccagaatagagacatggcttctaattagctaaaagggggaaagaccatcaagggtttgataaacgatgttgaaatttccaaattttattcaaggaataacgtgacactgaaggattattattattattattattatttttttttttattttttattttttgagatggagtctcgctgtgtcattcaggctggggtacagtggtgtgatctcagctcactgcaacctctgcctcctgggttcaagtgattcttctgcttcagcctcctgagtagctgggattacaggcgcgcaccaccacacctggctaatttttgtatttttagtagagacagggtttcaccatgttgggcagagtggtctcgaactcctgacctcaggtgatccatctgtcttggccttccaaagtgctggaattacaggtgtgagccaccacacccagccgacactgaggtattttaaacagggtggtgataaaatcagattatcccatgcttgccaagtagagaattctgcaactgccattgaaccagactgactgcatgacagaacaccaattaagaggctaatcttcttacttagagaggacctggttaggttgtgggccatgggatggatagaagtagatatccttgaggatatttacaggattgaaataagatttggtgatttaataagtgtgtgaggaagacaaagattaaaataatgattcctaggttaatggttgggacaaaatgaactctaataagttgtcatgtttggttttgtggccttttaaaacgtctgcatacttagagaaatggagacattactttttgtttaaagcactatgtatcatttagaatttacaaatctgaaggaaagagagagaatttaggaaaacataatctggcttaccacaaacagtattgtcttgaaatataaggtagcctttttacaaaaatgtgtgcaaataaactttttgtcatggggatttaaaaactgtcatccatgctctcggtataggcctcttgtcaattcaccaagatacactccagcttcaggtcattttgatcataaagtaggtaaactggaatagatttaatttaattcagttcaacatgcccttctgagcaattctctatatataatatgttatattgaacacacagtttacatagtccaaaggaaaaaatacgagacacaagatgaaggtttcagtttgggctcctcagttaaccggttgacttagggcctaagggtcccctaagatggagacagcatgatcacaatgcttgtaacttcctgtttacttctcagctggctgtgagtctctattatgaatgactatttgagtgtatatgtatatatgcaaatatatgtatatatacacacacgtaatgttacatggcaactcaaattttcctagatatttcacacaaactagattctttgtatttgtcgtcctcttttttttttttttgcatcttgtatcttagtttctatttacccataaaaatatttgtttgttgggtagaaaatgtggtatttttctggttaggggtttttctctctgaacctgatgctgatgaaacatgaaggcatcagggctccctgctgagtctggcacctcccagagtattcactgccttgctgggcccatgcttatattaacagattatccttggttaccacacacatctgcaggttacaaggaacctagaaatatgtataaggaaattagacgagtatgataaatatttgatgtcccacgtgatcctccaaaagtatctcttaagttcctttgccatttcaagcgtaggaaaagatccttcatcataaacagaatgacataaagtctcagtaattttttttttactttttccccaacttttcctagccataggtgaataatacattttgccttttagaaactcattatccagtggtaaattattctcaacctctgattctcttcttttaatttttctactctttgctctctatatttgatgtccactggtatttctatatcaagtggatggatgaaattaaaacaaattttatttcatattttttaaaaaggtttactctggcagcaatttttactgccaatttaaaggacgtttagaaattatctgtatgtgttattcatactaccaatgtcccattagcttatattgttgaaaatctgctgcatcaccaagagataaaaaataccaccatgcatgcacaaaaataatgaccattcattaccccttggctagcacacattttcaccaaggctctgttttcaaggttaatttgaggatagatggaaaaaagctttaaagcgctggaattttctaaggcaatccaaaatcagagaggttaagtctgggtgatataacaataggttttagttaaagggtttatttgctcgaaatactgacctctgaatcatccctgacatcttcatgagggaaggtttcactgattttacatgccaacggctcattaggaatatagcataaggaagataaatcacaaagtcataaagttgagcaaggtaagtaaatgctgcagcaaactaaatgcaagtcccccaatttattgttttctgtaccttcttcaagtaaactaagtcattcagtggaagataaagtaaaggataaaggcatgacctggagtggtcatgtgggtattgattgaaaataataacacaacaccagattagtctagtgctcaaatgtgtaaacattttagggatatagtagttttatgtagcaattatattgatatatgatatctttttcgtataaataagctactaaaacataaatttaagattctgatataattagaagatattaatcaggtagatgtgtgattatgaacaagaaaaacttgtataaaaatattctgaacacaagtttttgaacttacttgtagtaatataagctatatttgtcaatcaaattcctacagtatttgtcatttggagatactaatgataataagatgcactgcacttacttcagtctttaaaatataattggatgttttgagatattaacagtgagcacataccggaatagattggcaagaatcaggtatattgcccttatcaaaaatacaagcaatcaaagggaacaaaggagaaaaaggaggagacattctgcatggctccccaggttctttcttcccacactggaaatgctgattcggtctccaaggaaggtttcataggtttatttctcaccacagggaggatttacattatgaaacatttccatttttacccgagaaaatgtaaagcttcaggacattttctgaggagccacaaaccattaatccatagatcctgggtttatttactacagtattttttagcctgggatatcctgctaagggctttgtatagataaggaatcttccacctagtaaatattaccagtctgtttacctggagttccaattggcagggaaattagaccaaccttcaccctcagttgctgccctatacacacaccagtgaaaggagtgaatacatcctagaccagctgcttaacttttttctcttcaagtactaatcaatgaaatgtaactgagttgacatttgcaaaaatattttccaaagccatctaaatatttaagcgtataataatttttggcaaacccactgaattttaattaacaaaacaagattatgccaacgatttctaagagaactaaaaatccttcaaaaataaagaattaagtaacagtggaagtaatgatgataatagtatttaagctcttaccacatgtcaagaacttttcaatattctgtacatgtattataagaatcagaataatcttctggggtaggcactattattttcccatttaacagatctagtgtttgaggcataaatgaaatggcttagcctggtttacacatctagtagatcccgaagccattggtgaaacccaggaagtgtgacctatgttcttgactgctaaatcatgcatgaaaatccactaggatttttattaataaaactagataatagaaactggctgattagggaataatagtaaagaattaattttgttgattattactattataaaaatacaatagattaaatattaaaattagtgattcaggtaggaaaacatcaatcaaaaatagtttattgaactcatcatgaactttgcatcaggtgattgggctacaaggcacaaatgaagtagaaggaaaagcaaatagcataatattactaccagccagaaaagactggaaacggagttgcaggttatgtcaagtgagatatatttaaatatcaacatcttagaggtgataattaaaacaatttacaaaactgagatcatttgttttctaaataaatgtcattaccaggccaaaattttaagttagacatattttagcattgaagtgactcagagtgcgattttcatttgtaaaatcctaaataatatgaagactgataaactaaactgagaaaagaatgataaacaagaaagagagaagtatgacctacattgccatctgttggataaatgaacatctgtcatattgaatgaaagatgaagcttggaattcccagagaatctcaacagccagcactacccgttaagagcaaaaacagatttcaagcctaatttaactttcttttatttttgatttggaaaatatatttaaagaaggggcaaaaaaatcaccctctaataatctagaaaccatggattttaagatccccaggtataattttagaccaaattgaatggaattgtgctagaacaaagaagattgttgaaatctatcttatatagattttatgcactccagaagcatcttgttttcaagatggatccattcaagtcacaaggtatggtggcaaaaacttgagcctggaacttagtctgagctctaacatggtttcattttgagcagtcacttgacttttggggtctaaatttctgtttttatgaaaaatggatgagattggattaaggaatttccaaagttaggttcaactgtactcctgtttatgctgtgtacctattttaaaaagtagtctgttaaaaattgcttactttaaatattattttatagatagaagtagagttcctagaagttccttttatgtttatttatttatttttttacttctcaaattttacatcagtatctgttctctcctttagggtggagttagtgggttgactggagagctagaatttggagaaaatggaggcaatcccaatgtccactttgaaatccttggaaccaactatggagaagagcttggcagaggtgttcgaaaagtaagacaagacacactgattaatacgctttttcctatactatggttttgcttgattgttttccatgcagtatgatcacagtacccattaaagtcaatattgtagtgtgaaagagaaagcagggggtgaggggaaattaggcattgaaatgactttaaatatttaccagaagtattaagcaagaaattctatttccgacttagaataatgtaaaggaaaaaagtaatctgaatcttacctagggaaatagcatcatctttcatttgttacaataatagtttttataaaatagtaaatttaatatttatacactttgtagctgcttggtttttaacttgtaacatgtacaaaatcagaataagagcttggataaatttcatatagtaagacagaaagtctactgcaagatgtgacattacagtattttaccttctgtatgtgtcatgtaatatgtagaaaatagtttgcagaaaatgaactcttgttggatactactgatcacatgtaagaagaagctgagtgccaataatgatgtttcatgaaatactgggacaataactttctcaaggagaaatacaaacgcccttatataaatgatgtttctataattcggatttgctatatataaatttttgatatatatatcaaatatatatatatttatagcatttgatatatataatatatatatatatagcaaatccaaattatatatatacacatatacacacacacacatatagatatatttggtagggaaataaatcatatatatatcatataaatatatcaaatcatatgtatatatacacacacatatatatatgatttggatttgctatctatctatctatgtatctgtctatctatctatctatctatatttggtagggaaaaacctaacataattgtgtacgcagagctggtaactgtaaatttctaactgtctaaagttgatgacatttagggtaacaggttcttcagtaggtatttttagtgctgagatgtaagatgcaaaacaacctagacaaaatgaagtgaggagtaattagcaatacaaatttctcaataaattcatgctaatatggatgaaactatcttgatgcatttaaaatttttgttttatagtgaataatatgaaacatatagaaaactgcataaaacacaaagtttagtgaattattttaaaggaaagaaccactactgtggtcaagaaatagaaaatagccaggattctcaaccctcccatatgcttctctctgattaccgtcagaccatccttgtcaatagtgtaatatttagactgatttttacgatgttaatttatttgcatttaaaatatgtttttatcacctgtgtttacatccttatataattgttttgtcaatgtttcaacttatgaatggtctcaagaatgcgtatatccttttcttcttgcttcttgtgttcaacagtgtgtttatgttattgatccttgttgttacatggagtggcagtttattcatttatattgctgtattgttttctattgtatggatttgtcccacaccactgcagtttgtttccatttttagactgctataagctgctgttacaaaaattcttggatatacatcttggatacttttatgcttgtaggtgtatttctgtaggttttgtatccagaagtagaactgcctgcaatataagaaaccatatcttgaactttaccagataacatcaaacccattttcatagtaatttactaatttacataccaccagcagtgcaggcattgccccacattctaatcaagtcttgaatttgtaagacttaaaattttattaacttattgggtggatataatgatatatcctcatgatttcaatttacatttccctgattatgaaacagtctgcaccttttcctacatatttaggctcttcaggtgtttctgagttaattgctcattattttttttttggagaagggtgtcttttgctttttataattgattttagaagttatgtatatattctgaattttagtgttttatcatttaatttttgccagttttgttttcttctctgtggattttatttcaatgccatttatagtatctttaaatttagaggaactatgaattttcatccttattattattgctgtttagtattatctaagaaattactccctatcccccagagtcatgaatatattatgctcaattatgttccaagggttttacagttctgccttccaaattaaggtcttttatctatctagaagttttttttttatatatatacggggtaagaaaaaggtaaaattttactcttcaatactcttcatttgttttattgagatataatttaagtgcacaatgacttagagtagtcgcattcaccaatttaaccactaaccaggtcaagttattgaatgtttctgtcactcagaaagtgccattattcctgtttttattattagaagcacagacagtttgcttggcctgaaagtttatataaatggataaggtagtatttacacatttgtgtctttcttctctcaacatttaaggtacattcttattttcatgtgtcaataattttgcttgtttgtcttttaatttatattgctgagtggtattatagtctataaatataatatggtatcttctaaatgtcattttctgtttgctgctgtatatacaaatgatattttatattgattttatatctagcactcttgctcagacttttaattctgataattcaactgtagattcttgtgaattttctgcaaattgtcttgtcatttgcaattaataagagtttttgcctcttcttttgttattttacaccttctagggatgatgttgaatggaaataacagtagtaggcatttttggatcgttatcaatctcggagagaaaacattcaccactataccactatactactatatatttataactaacttagatcagattaaggaaactccatacgttcctgggatatgcataattttatataaaattgcttatacatatgtaaaattataattatgcttatgtttacataaaattatttgatttgctaccaccttgcataagggttttatattgatacttatgactgaggttgcctaaagctgtcctttctgttggattttgaaattaaggtatgctggcctaacttaaatgagttagcaacaaggcaaagcatccagaaccatgtctagtacatcacaagaagttgtggttaattttcattaataactgaaatttcagtagaggggtaatgccatatgtttaaatagcaacagtagaaaagtaaaaaaaaaaaaaaagtgagtatgtttgggtagtaattaaatgactttgtgaagttgttgggagagattttttacaatgtaagagatttgagtatatttgaatgctcacagaccaagccagtagtgaagaagaaaatgaagatataagaaagaaaggtgataattgatagcgatacagtaggggaaaagagaggattggatcaagaattagatggagtacttaaccataggcaccggggaacatcattttccagggtgataaggggtaggggtaagaaaagaatgctgtgtttgcaagcaagtctttatgtttgatgttaggaagttaagaaaattattaataaattgtctttgcttggagaaataggaggcaagattatcttctaattgggaaaatgcagcagaaggcattggcaataatgagactggaggtttaacaacagtggagaagtttcgaaatagctgctgtggcaaacaagagaggtgactagggaatattgaagaaatgccagggagggctattggctcacatgaggctagagatcaagaaatcactgtagtactaatctacacagttgtggatgtttgtccagcagcattgagcagactgaataaatttaaattaatgtaggcttgaagcttcatcgggttatttttgttttgtattgtgttgctttgtgtttgatagcagtacaacaaggcagtatggttaagaacattggcaaggcaatggttgaagtgacaaagcataaaatctaaactgaacatgaatggcaatgaagaaaggaagagtataacagagacaaagtatggctcgagaggttagtgtgtgttcagcacatctgaagagcttgtatattagtatggattaagtgagagagcttcagagccagaaattatgtttggggagagagagaactgaattcattatcctaaggctgggtaggttctaggcactcatcaagggatgtttgtgagggtggcagaggagagcttcatttagccttctaaaaccagtgtcatttaacggagttctgaggtcaatatagttgtttcaacctgctctgaattcagagtttgtaattgttaaatctctgctattaaaatgatagtgaatcatacacattagattacatctactttgtccttaagtaataactcctgtaattatttcattttttatgttcctatgtcccaactcccaaactgtattgaaatgttctgtgagctggcactatagaggtattatgaaaggcactataaatatttattccatggtaccttgtatacctttgacacttgaaattttttttgcattgttttacaaatttaagcattcttaattttgaaattttcatttttataactcaattatttttctactaagctgcaatttaattactaatttttttaaaactccagatctaacactcaagtaattttaaaagtattatggattaattcatagcttgccagctcattttataaatggggcagttcctttgtataggtattaacccatataataatgctttcaaagatacttatgaaaggaaaataacaccacgcaaacaattgcaatatagatttactagatgtgtgtccaaaatgaaggttccactcccagtttctccatgtctcaaaaggagtgaatggtttttcagttgacggactgtcaagttgtcagtgtttattctgctgccagtggctcagtgtatacaaagactgcagccttatcacctcaagcaggggtattgtcaggtctcataaactaaacagagttttgtctgctcaggatttgaatgtgtgatgtaccaaggattcataatcccaaattttggactagtctttgctctcttggcattgtatgaatgatggtttcatttttttgagtttggtgagaatgtggaagggattatttgattctcactgatgttcatctaaattaaggactttcttactttgataatttttacatgttcttctattttgtcataaggtggtacttatttagcagatggtatatcaacatgttagcacattgtatatacccttgaagataaattcaggtaaaactcaaagtcaaattttgaaatcgctaaggttttctatacccttaaattttgcccaagaatgtggttatttctgtttctgttagtcactatatagaatttctaaaaaaaaaattaatttgagcaaaagttattataagaagacataaaaagtaaagattaaataactctacgtttaaggaatcaatatatgtttttcattagaagagttttacataatgttgtttgcttatttgtctcatttttgttaagtttgccagtgctgctcacatattattgcagactgaattccagtattaaaatgtaatactctagacttagtgtctttgaactttatcacaaacggaataaggctaggaaaagctgattaaagctggtttcacaaccaatcttaattgcatagtaatgcttaatatcttcataaaagtgttttctcataagttggtaaaataaaatgtacgtcagagatattttacctcctaggtacagtggtttctcagatatacttagaatctttattcgggctctccagctttaaattcacaaagtctacaactttgtgttcttgggcaaacctaatgtactgcttcgcaaaggatattatattatataatctattaattaatagattatataatctattaattaatagattatataatctattaattaatagattatataatctattatatattaattaatagattatataatctattatatattaattaatagattatataatctattatatattaattaatagattatataatctattatatattaattaatagattatgtaatctattaaaaatacaccaatttttaatggactaaaatctttaattgctttgtacttataaggaggagagaacagctctgctttcaaatagccagtgattaaatattgcacttgtattcagcattttatttgtattctgattctggaatatctaaaatgacatttatcttttggtattaccctgttttatgttttcttaaagcactttttgcaaactgatattatatcagtctttgtaatataaaacccagttgtaatttgagcccataattggaaaatctgccatagttatttactgtcatagttctaacaatgaattcatgtcttggaaggtttatataatagagagaatctagaaaatattgtgaattgacaatataattatacatataactcttctatgtgtatatgtaaatataattaacttactcttttataatttgtctttcccattacaatgttacttcatgagacaagaactatgtttgttttctgttgtattcctaatgaatggcatataatagatgcttgttaagtatttaatgaatgaactaatgaatacatgtgcatactgatgtaagaatccataagattcttctctgcatctgtaagtttagcagccttgtttttcttctatttacatgaaacataattatttgcatttaaattaaccagaatgttagtgggtgttacactctttatcctcaattcctatcagagttgggcacttgatcaccaaaagtataaacaataattttaatggttaagcaagatatatgtataatttgtttgcaagaatttgttgtgaatagggaaatagtgagtacttaaattgattattccaagcaaaatggaaatacccataaaagtacaagtttattcggaccattagtatttgtacttttaagattattgtctcacagcgagactagatttaacaggctgtagtggaaaaacgtgtagcctttgctgttagacatacctgggttgaaattctgcctctgtcacttactgattgtttgatctttggacttcaaagcaaattgagtttcaagttctataatatgtgaatgtaacacatgtaacatgtgaatagtaatacttatctctcaggatttttgtaaggattaattgaaattatgtttgtaggttacacaataagggaaaattaaaataatacctgttcagaaatatacaggaattaacagaattcattttcaacccaacacaagaactacaaagtctagttgctattctgacaagaagctgctatgtgaggtggtgaaagtaacttgattttagatgtggttgacagaggattatacatgacagtcacagtgatagcatgaaacactaacttttttgtttcatttaatgtcctttatggctccaaaattctacaagtctgttaatcaaggcttggaaactataatatctacagttgtatggaaatctaataacagaaaatctgatggtaaacatagcctgcataaacccagtctttatagtttaagcccataattggaaaatctgccatcttcaattactgtcctagttccagcaatgaattgtgtcttggaaggtttatataatagagagaatctagaaaatattatgaagtagggcctggcatggtggctcacacctgtaatcccatcactttgggaggccgaagcaggtggatcacgaggtcaggagatcgagatcatcctggctaacacagtgaaacctcgcctctactaaaaatacaaaaaattagctgggtgtggtggcgggcacctgcaatcccagctactcgggaggctgaggcaggagaatggcgtgaacctgggaggcagagcttgcagtgagccgagattgggccattgcactccagcttgggtgacaatgcaagactccttctcaaaaaaaaaaaaagaaaaaaagaaaagaaaatattatgaagtaatagtatgttgtgaacacaatagcttttatttctttatcccattctcctttatttataatatataatcattatacatttagctccatcagcttttattctgatgtgtcttcaagaaaatagcttgtaccataaagtcatgagatggatatgcagtctaatactttctaacattaccattgagttagactctcaaaatcattgatcccagcagtctcttgatgggtaggggaaccctgcactcttgaaaagtatattctgtggaccaaattgtttcagcttcttagggagcctatctgatttcactgcagagtagagaaaataacccgtatctgctgatgtttagggttactctgagtttctggaagggttagcagctggttggttgagatcacttctggaggagttctacctcaggtaagcagcattcactgcctcttggagagaatgggagctatctcttctggtggttgggatcatgccaacctctccagtgtggagcaaagatgactgatggggtacaattctgtgtccaagtcttggtgaaaataggaacgacttttctagaaggactataaaatctgaactgtttgcttgttgtgatggttaattttatgtgtcaccttgactgggctaaggggtcccaagatagctggtaaaacattatttctggatctgtctataaggtattcccagaagagattagcattttaattggcgtactgggtaaagattacctcacccatacggataggcatcatccaatctgttggggaactgaatagaacaaaaaggcagagaaagggtaagtttgctccctgtttaagatgggaaattcatgttctcttgcgctcagacatgggcactcctggttctcaggccttcagactccagctgggaattgcaccatcagccccccagttctcgggccttacacccagactgggactgacatcattggctctcttgtttcttaggcccttgggtttagactgaaactataccacccacttttctggttctctagtttccagatagctaatcttggaacttcttagcctccgtaattatgtgagccaatctctcatatcaaatctctgtatatggcatatatttatatttaaatatatatttatatatacatatattcccctggagaaccctgacaataccttggtatgatatcttaccacgtttgagggaagagctaattgtgaggaatttagctactattggcatccatactctcagagaacattcacagacatgaatatgctcataaagagaccgagatagtctgtggtgtcatctgtagtccacatgcttaggattagttgggttaggagttcaagactgtgtctgatacagaggaggcaaagtttagtttccttcccactctactagagagcatcaacagtggggcacactggaatctgtgtcactccaatatctaacagatacacacacacacacacaccagtgaagctccagtccagctcaaattcaacaatatgatgtggtggtacttaacatccactgaacaacctaattcctagtttcagccactagtggtaactaatgttcaggacccagtactatggtaataattattaaaagaacttatattaggaattcacagaattaagaagcatttgctcatatgggtactcctttagcaagatctcattgtcatgatttaattttaagtgacagatagtgaaggtttatttcacagaaattgcacaagtgggcagacagtgataggagagactcaaagagtaagccattcacccatatgtgttggaagcctaccacagacaaatttattacatgacaacactcatgatatgataggttctgttgaaccaaaattccaggggcttttcattacacctcaaattttctgctttctctgctctctaaatttctctgtagtctgagagaaagatatatatatcttgttctctcaggcctatctggacgcctcaaggggattacacattctcttttagcagtaactaggttttatataatttaaatttgaatagttttgagcattaatttcacaaaaagtgctaatagaagtttcatagttcatttatttggcaggggggtgactctcattcaaactaatgaatattatgtccatgtgagtaatgcataattggaattgtaataatggctttaggttactgatgcttgtattgcctcctatgtctgttttttccagtaattttattttccttcttaatcaggacacctgacccattggagctatttagacatcactaagacattagtcctaattaagctattctgtagtgactgaaaattgattgatacttgttcctttgtttttggtacaaactatggtattaaggaaaacttttttgaaactttgggttggctgggatgcttactctttcccattttaagaattctgctttcagttttctgcatatggctagccagttttcccaaaatcatttattaaatagggaatcctttcaccattgcttgtttttgtcagatttgtcaaagattagatgactgtagttgtgtggtgctatttctgaggcctctgttctgttcaattggtctatatgtctgttttgttagcagtaccatgctgttttggttactgtaaactggtagtatagtttgaagtcaggtagcaagatgcctccagctttgttcttttggcttaggattgtcttggctatatgggctcttttttggttccatatgaaaattaaagtagtttttgttctaattctgtgaagaaagctaatggtagcttgatggggatagcaatgaatctataaattattttgggcagcatggccaacttcatgatatcgattattcctatccatgagcatggaatgtttttccatttgtttgtgtcctctcttatttccttcagcagtggtttgtagttctccttgaagaggtccttcacatcccttgtaagttgtattcctaatatccagagtcaaaaaggaacttaaacaaatttacaagaaaaataaacaaccccatcaaaaagtgggcaaaggatatgagcagacactgctcaaaagaagacatttatgcagccaacaaacatatgaaaaaaagctcattatcactggtcattaaaaaaagcaaatcaaaaccacaacgagataccatctcatgcccgttagaatggtgattattaaaaagtcaggaaaaaacggatgctggagaggatatggagaaataggaatgcttttacactgttggtgggagtgtaaattagttcaaccattctggaagacaatgtggtgattcctcaaggatatagaaccagaaataccatttgacccagcaatcccattactgggtatatacccaaaggattgtaaatcattctactataaagacacatgcacacatatttttattgcagcactgttcacaatagcaaagatttggaactagcccaaatgtccatcaatgatagactggataaagaaaatgtggcacataaacaccatgcaatactatgcagccataaaaaaggatgagttcacgtcctttgtagggacacggatgaagctggaaaccatcattctaagcaaactaacgcaggaacagaaaaccaaacactgcatgttctcactcataagtgggagttgaacaatgagaacacaaggacacagggaggggaacatcacacactggggcctgtcagagggtggggtgctgtgtgggggatagcattaggggaaatacctaatgtagatgataggttaatgggtgcagcaaaccaccgtggcatgtgtatacctatgtaacaaacctgcaagttctgcacatgtatcccagaacttaaagcataaaaaaaataataattctgctattgatttgggtactgtttactccaaggttttcttcttgacaaaaaaaaagtggtatattacaaaaaaacaagtaacacatattgttgccattccagagagcaaaacttttctactgaaatcattacatatatatatatatattttatatatttatatattttatatattatatatatataaaatgtgcatgcgtatatatgtttacatgtatatgtgcatatatataatgttatatatatatttatatatatataaaaaaagtgtgcatgcatgtatatatatacatagaaagagagagaaaggctgtgccaaaaccagaaacattctgtttgaaaactggccttcattttaaaaagtataaagtctattaaaacatggttgtgagtggatagtctgtttcttgttatagtcctggtttttgaggggaggttattcaaatgtgcagtatttttactaggaccttaaacacataccccctgttaatgtaaagatgtccttatttacctgatggcaaatatttctgaaaattgagaatgtccccctttagtcatgcctttctttcacaatatgtgaaactctgtgaccttgcattcaagaaacattatttctagctatggaaaatgaatggaataacatttattttctccttgttagttggatagttctgtatttaaatgtttcatatttaaaattatctgtgtattgtttatcagaagtgtgcaagtaatttagaccttgatgatgagtaatattttgcctgtgatttgaagtagctcctctctagcactagcactctgattatttctctctaatataacctcacatgcacaaaaatttttgaagctctatttttttaaatggcaaaaattgatttatttccagatatgatctataacactaggttataaaattcattttaagcagagcttattttaagcaaaactgtatcatgttgaattaatttgtaaccatatttgtaaatattccaattttttaaactttaaagttcaggagtacatgtgcagggtgtgcagatttgttacataggtaaacatgtcatgagggtttgttgtacagattattttatcactcaggtattgagactagtatccattagttatttttcttgatcttctttttcctcccacccaccaccctccacttccaggctccagtatgtgtcgttcccctctatgaatacacgtggttctcatcatttagctcccacttataaatgagaacatgcagtatttggttttctgttcttggattagtatgctaaggataatggcctccttccatgtccctggaaaggatatgatcttgttcttttttatgactgcataatattccattgtgtatatgtaccacatgggcatttaggttgattccatgtccttgctattgtgaatagtgctgcagtgaacacaagtgtgcatgtctttaaaatagagcaatttatattcctttgagtatgtaactagtattgggattgctgggtttagtggtatttcagtctttaggactttcaggaattgccacactgtcttccacaatctgatcccatttgtcaatttttgcttttgctgcaattgcttttggtcttcatcatgaaatctttgcccgtgcctatgttctgaatggtattgcctagcttttcttctagggtttttagagtttggggttttacatttaattattgaatccatcttgggttgatttttgtatatggtataaggaagggatccagtttcaatttcctgcatatggctagccagttatttcagcaccttttattgaatagggaatccttcattttttttttttttttttggttaggtttgtcaaagatcagatcgttgtaggtatatggtcttatttctaggttctctattctgttgcattggtctatgtatctgttcttgtacaagtaccatgctgtttttattactgtagtcctgttgtatagttcaaagtcaggtaacatgatgcccccagctttgttcttttagcttaggattgtcttgaccatttggctcttctttggttccataaaaattttaaaatagtttttcctatttctctgaagaatgtcaatggtagtttaatggaaatagcattcaatctgtaaattactttgggcagtatgaccattataatgacattcattctttctatccatgagcatggaatgtttttccatttatttgtgtcatctctgatttccttgagcagcgttttgtagccctccttgtagagatcgttcacttcccttgttagctgtattcctaggtattttattctttttgtggcaattgcaaatgggagttcatttgtgatttggctcttggcttgactgttggtatataggaaatattccaatgttagattagaataaaaaattctgaagaaactttatagtgtggcaattttacatataataataaaactcaggccggacgaagtggtttacgcctgtaatcccagcactttgggaggctgaggcaggcagatcacgaggtcaggagatcgagaccatcctggctaacacggtgaaaccccgtctctactaaaaatacaaaaaaaaaaaaattagctgggtgtggtggcgggtgcctgtagtcccagctactcaggaggctgaggcaggagaatggcgtgaacccgggaggtggagcttgcagtgagctgagatagcgccactgcactccaacctgagagacagggtgagactctgtctaaaaaaacaaaacaaaacaaaaaactcagttcttaccataaccaaaattatttttaatttatgaaatgtgtcttcaaattatctcctttggtgaaagtttgaaactaaggactctgaaaaagaacatttaaaaattatagatttactagttctaattttaaaaattaatattagatcgttttaaataaaatttattgctacttagattttaattataattaatgtaaaataatgtacagttaaagatttccacaatatcaaaaaggttttaacaaaacatgaatgtccacattgttcctaatccaaaattagtaaccatgttgaaatccaaagatttactaagcattaaataagtatataaataactgaagaagtaatacagactaaaaaacaaacaacaaacaaattaatccatgtctgtagtttccgtaagagcataagtgaacacacacataaaatctcaaattctatcaaaatttctgtcaaattccaaataattctgaaggaccctttttcaaggtgatatttaaatatttttattccaaaataaggccttatttttaagatgcatagtattactatcaattattatgttcatgacacttaaggttgtcgatataggttccccgagtgttactatttctctacttcttttccctctgattttgttgaagctacaaatattttgaggacctgttattctgattttaaattgtcagcatttcttctagagtgttaaatgtctttctagtaaattctctatagatttaataaataatctaccaaagttatatagaaagctgagtttttatagagttcttttcaataagataaatgtttggagatggagatgctctttttgagtaattagagtcacttttattaatcatagtaattcaggtgcaaaaaatggcttttacttactggtagtgaattttgatttttaaaaattcaataaatacacttttcagggttattaaatcctgttataatagtaaaataatatttctggattttgaaaaataatcaaaagtgagaaatgaatctcatttttaacataattccacaaacagcttggattaatataggttgtgctttgaaatgtttaactagtaaaatgaatgcatctagctgagtataatcaccctgagtaagtcacttgatgctcatgaagagaaaaccacttatccactgaaaacttttccaagcaattcttaatcagaaactatggggagttttattgctctggagtacctgaatcaaagtagttttgtggttttaaatggaattgtatttgaaatgctttgcttgagaatttcttcttttgattctttcaaggttgttatgaatctatatcccaaaatgagatgagaaatctatcagtgacaggcttatgcattttagaatgtctgattatagccatttggagctgtaatatgatttgaataagtgcactttcattaaataagagacagtcttttttaggattgtgggggaaattgcatatttctttctctcatgtaaagtgttacgtttatgtatacttttttcttccaaggcaaattggaaattggataattattcttgggacaaacaaagtaattacaatgcaggggttgggttgtcattccaacgtgatttttatttattgaaagtcatgaaataagatttgtttcaccttcttttcctttccgtggttgtcacattctcagtcttttacaaacaaacaaagaaattcaggcctcctaaatgctatttattttctagctgttggtgttagataacctaattatacaatagtctcttccagatattttctttttcttatagcttatagctctcgtgttagctgtatctactttaaaaaataaatacgtgaacattttattcattcatatacatactaatgtttttccaagtaggcattattttttctgatgaatgcgaaacatttctgaaggaccatacattaagaaaaaaattagcaatcatttggtgaaacatctctatcttacatatatatagtgcctaagttttgtgggttgaatggctttcttaaaaaaacctttagtttgttaaaagactagacttctagttaggtatcttttccatagacttgtcttctcccaattccaaaacctttacttattagtgataaatagtaaaggagaaaacgtttttgttttgtttttgtttttcatgtgtttgctatgatgtggattggtttgtccccacaaaaactcatgtttaaatttgatcctcagggtggggatgtgtttggttcatgtgagtggaccttttatgaatagattaatgccttctcactggaataagtgagttctcactctcggaaggctggattaattctcatgggaatgggttagttcttgtgcgaaggggttattataaagccaacaccttgggtcttgtctctttggacatgtctacttcccctttgaacttctgccatgttgtgacacagcatgaaagccctcaccagaaaagatgaaggtgctggtgtcatgcttcttgaacttcccagactaaggaactatgagctaaatagacctttattccttataaattacccagtctcaggtatcctattagagccccacaaaatggactaagacacactgtaagtacagacaatctctatataattacagttttatagttatgttatagtttattgaagtccaagaaaaaatctattttaaaaaaccttacttataaaaattgctcacatttttctataaggtaaatcaattctttcatgcttttctcttgaaaaccctgattgctgaaatacaaaataatttttggctacacttcttcctattcttttgactttctcctacaatattttatgtaatatttaacttttagcctttttttcactgtccacatttttgatggtagaagtaatattcccgttcattttttcaaggctttccttttctttttttgaatggcaaccatgttttaacttactgaggacttcatattcagttttatcttattgttgctaacagaaatatattttgattgaaaatacattggtgcactagagagtgaattgtaattttggacgaagtattttcaaaattatgttatttagacaaataatcataagtagggttttttagcgaaagtgtgatttttaatttttggtttttttttttggtcacaatgtagtcacacaaaaatatgatggggctgttatatcaatccccttttccaagaagccatttgggtgaatcatggcatagcaaggttagacctatattgaggaacaaaagtcacaggttgcttcaagatcatatagcatcatccaaaggttttgagtacttactattggtaatctttttataaagaaaatatgatagatagatagaaatagagataatataaatatgatagatgatatggatatagacatcatccacttgagaaaagaaagataaataaatgtaaaaggcaatatagaccaaatacattctatattactaatatgtactgcgagggaaaagggtcaaatatttttgaattgagttattctgtacagtgtgctatagttttgtgacagacatacaaaacaatttgaaactgcttgggtcttatgcataagtagtgacatagcaggagataccaaaatctaaagttattcaaaacattagaggattgtgacatacttttatgttggctgtatagttttattaaagcatctaatttaatattatttgcttattttttgatgcacgtgggacaaaaaagaaatagcagtaatagcaggagagaagcaagaaatctaacaacttaacgtttaagtcaataataagtagaaaaagaaaaatgaagctcattccgaatgatctgaaacacagaaaatgacatatatgtagtgcctagcattctaatcttgtttatctgatttacttaataatatcagcaatagaaattgcctgcaaatataagagatatccaagaaatgaacagaaattttgattgtttgatactgtagcttggttatagcaatttaaagatcattgaggtagatgaatgatgtagccctgttacattgtaaagagtgatgcatttcacttcagtgcaatgacattgggtttaagataccattcagtagaaaatgaaaaccaaaaatttattgattagtctacagatagtgattttttaaagaaatggcataatttaagaaacattttaatcattttccttatacagactattaactttacaaatattgagattgtttctatagatagaagacatttaagcctacaagtaataaactgaaaatatatttctcttatcttcaagaattctgttaatattaaccatttatcaaaaagaagtatcataaataaaatattccaatgcattttgtatttttaatgttaaaatgtcaaataccttcctttaattttgacagcattttatgaattatctttctcatataatataatgaaaatatactttttgaaagatagcatgatgtgtgagtgccctacttggtaatatctatttattatttcctgatttcctaatttattcctacttcagcaacgcataggaataaaatataattttattcactgcttattgctgaataaaggatttaccacataaaaatattttatttttatagaattattacctctggatataaaatatgtatatatacatatacacacaatatgtgtgtgtatatatatatatatatatatacacacacacacacacacacacacacacaatactggtaatactaatatacacaatactggtaatactaatacaacacacaatactggtaatactataatcaattgcagaccatacattaaaaaattttattctcatggaagcatgtaattcttgattaaaaagatatagttttgttgtgtttgaataattaagttttcagcattaataaaagagcagtgaatgtgccttaactaacaaaaataaattggatggaaataaaagacaaacttttcacttgcaataaggaaaaaaaatgacaatgataaaaactagcaaagatatttaagtttgggtgaaatagaataaaaaattttagtggaccataatgtcagagaagtagtgttacctctcccaaaaagctaatgaaaattactgaaatcattaagaaaattatattggaggacaaactcatgaaagaattaaagttatatcaatattactttcatgtatataatgacagacacatggaaaaaatggaggtgttttatattatttcaaagacatgttttgaaaaaaagactcagagttgtaaagagacaaatgtggctttatgcattactcctttagtgcattatgataagatttgaaaagcagcaggatggtgcttatcttgacccaaaatatccataaggtgctaaatagtttgttattagttatgcagtgccataactaatattaaatgacagcttttaaaataatctgaacctgaaggattgtcatttaaagctataattaaccactacaactaatgcatggatttatttattgatctattctttctataaacaacatgaaagtaattaacaaacacaactactgcaagattcatttattatcctctcttttccataaacagaatgaaagaatcagaccacagggctctactgggaaaatctggccccaggtgaggaatattaataaggactgatgtgctgactagagtaccactgaggcagcgaagtcaggaaaatgagtcttcacagaaagggaaaaaagattaaagaaaaaaaagtattatagagatgctttgcctatttttcccttttgctttaagttgatcttggtgacattctcagagtgtaaatatttgctcaattaatcctgtgtgaatagatgaaaaaaatgcatgatgataggacaagtacctaggagacaagttggttggccttacaaggattgccctacagcaccatgcagaattaagatcccaaactgtgaagggatttaacttgtcactagaatatcatttaatggtattgctgtaaatacacagctccatatcaatcatagttaggcacttacaatcccggagtatccagtctttgaatagttagttttccagaacccaaagaaatcaatattccttttcaaaatagtctcgactgtgttcattaccttgattttttaaaatgatttcacaggtgcatatatatgtcaaatcttaccaaatgataggctttttacatacatgaaatttatactgtcaataatttaataaagagattttcaaagccaagtgcacagctaattaagtaaataaataaaatagcattgatcatcaggatttatatttttatttttatgcaaagcctttgactattcagttattttttaatatattttaccccatatttcacaagaaatgtgaatgtaacggttacatgtaaagttcaaaaactatgttttttcaattcattttataaagaaggttaggctaaatagcccttttaaacatacatatcatcattcaccttggttttaagttgtttttcttgactatctgaagatggctatacttaatattgtctaagtgatagggggcatgtgttaaaaatatgtacatttctactgcctttgctattagtaaagcacacttaaatgagtaagaagagagagaattttttaaacatagcttattgcccatgtgatattaaaatttggttttctctcttagttttcatgggaagacttaggtaaattagtattttacgtaggaggtatgtacaaaaactgtgtccgctattaaattattctaccttgaattgtgattttattacatataatgcatgcttattttggaagtgtgttataaaaaccattgatactttgccctactggagaggatgattcttactagcattctgataaactgtaaatccatggagtttatcacaaaagcaattttacattattttggaaacaaaatttcctatatagtttaaattatttttgattctatatgttatctttataagaaaaaataataaagtttcttaatgtcaaattttaataatcaaaatacatctattaggcacattgcgtacatttttaaaagccaagtaaaccctgtagtaaatataaaaaaaaatattaaaataacaagataaatattatatatttatttatttatttgttagaagttggacacttaaaagggtgacagcctttgcatacgactacattaaaacaatttaagttaatttaagtaaaggaaagaggcattcaagcatcaactgttatttatactcaaattatctgacagctttatgttgtgacatttggtctttgcaaaacactcaaaatataagtcattgctctgtaacctcacagtcagctttatattatggtagtcatgaatgccagtttgtacccaacgttcataaatcctactgcctttttcaacaggccaatcacaggatgatcatagggtttctgattcacttatagtgaatttaggtgaaatggaatataaaccaatttctctgaaatcatctaactataaagttgtgataaaagagacatggtgtggcaagaattatactgcagagatctttattacattcaatggttgacatcctgggctggtcctaattaaaacattggcctgtagaagccaaaagtaacttccaaggcctaacaagcacatcattctgtggcctatggcattcattcttgagagtaaggaataatcagtagtagaatgggcatcctcttcatcatagttccctgggactgagggttagatgtgcatgatatagtatacctataatgaatcaacaaacatagatctttctccaactttagttcaactaaaagtcacttttgacacatgttaaaaaaaaacatcaatactcaagctcggttcccagagattataattgagggcttttcgaaaggagctcaaaaatctgtgtttttaacaagcagtatctgtagttccaccacactttacgaaagtgctttataggaaacttgcaaagtatagggaattaggaactgtcaaaagacatacaatgtgatccttgcacctaagtggcttacagcctctttgtgggacaagtcatgtacacaatctaactcagtattagtgacaggttcttacaagtgccacattacaggttgtgagttctagatgaaatcctataattaagcactcactcaggctggaattgccagggaaaccaggaaataatagaggaaagggtaaagaaaatttcaagtggaatgacctgtatatacagaatagagagatgcgtgggcctggcatatttaagaggataactcttggatagatgcttgaataaactgatataatagattgaacaatatattataaagagaggagtatatattgtattaacagaggaatttgtataggagtatgtattcctgtagtggaggattttgagaaactctaaagatgtagctgactaaccatctagccgtctatttaatctagggtttggcaaactttttctgtaaatattttaggctttgtgggccatgtatgtctcttttgcatattcttccttgtttatgttttctgtatatatgtatgtatgcatgttacatatatatatatgtattttaattttttaaatatgtgaaagaattcttcactcaaatactgaaccaaaataggctcaagggccaaaccatagtttactgacccctgatcttatccgtccagcttctggcttcttccacaaagggtttaaagaaacttggagaaataaaatatgtatattataaatattaaatgtataataaaaaattagcaagtaaaaaaagtcaatacctaataagggaaaactaacaaaaatatcagttactatatttgagcttaagaatttggtttcaggctttcagaaacccagtcaaaaatttgaccagttacttaggtcttatatattagggcaataagacaagccagtctcccttcttagcattcctttctaaagcagtgcctcacataggacttcactctcttcaacagcttctgtaaaccaaatgcaaataagcctgttttgaaataattttttgatgaaagctgagaacgtaaaccataaatgcccagggaggcagttatgaagaatattaaggattgtggcccaaatatggagtcttcagtttctaggctgattcaagaagaaaacataaaatatgaattggatatttgtcaaatcattatatacatatattttccactttgatttacagggaattttaaatcaattgcttctttttgtctaattatataaacttacctacttcttatgcaaaacttggaaaagaaaaagaaaaatcattcgtaatcttactactttgaataaaattcctgttgatattttgatgatttcctcttattttacatacgttttataactctataaatgtattttaatgttatcatttaacttacgcaaatattccaataactcttcattttttggccttttccatttttgcccttttaagtgttggaataaatgcaataaatagatttctaaaaaaaatgaaatcgctatactaaagtctgtagcattctaaagtatttaaatgttatttctgtttactattaaatttttttttccgttttactctttcaccagaagttatgaaagtgcctatttacaaaaatgtaactccttgttccacttatcactactaaggagttacattgctgtaaacttttgataactataggaaaaaaatagtgccagtttccatttctgttattactagtaccaaataattcatttttctcttttatttctaattatgcatatttttctctcatttatattttaaaagcctagtatttttaatcaatttttcgagatctttccatgccaaggattttaatcttttgtcatattttttaatcatgtttatctaatggatgatttactttttagatttattttgttttgacttagaaaaagtagtaatttcaatacagtcaaatcactttccttatgatttcttctactgacttctaaagaatgaagccgttactcagcaagatatcagactcataccatctgcttcctccatcccccattgtgtggtttgaatatttacaattatcttttcaatccatctgagatttttttttgtatggcattctataaagaattaagtggacattttttccaaaataattgaataattttctatatatggaaaaatatatccttctcattgatttatgatgccttaaattatgtattatattttaagtatgcttaaaatcttagtatattatatttgaattaaatagatgacttgctttcatctttgtttcacaatatagttcatttggcttataattagtggatcatcttgacagagtctaggtgactgatggtcttatttttaatttgcagattttcattttcttgtcattctttaggggttagagtgggtaatttgaaaagacatgtcagaaataactacttagttagaaacctttgtgaaaagccaaaagttttatccttcgaaagcaggctactactggtcagtggcaatgactctacatcattatagagaaatatgcttatcttaattgctatgaaatgggagcatagaagtcaactgaaagcagtttcaagtcattgaaatgaatttgtttgttttagggcagttcagaaaagagttgcattttgcatagcttgaaattatcatctgatctctgatgaccattcttgctgaacttgtcttttgcaatgctattaacacacaggttatattcaggcagctaattgtagggcttctatgttgaactcaagtttagtgcagactttttgtccagaaattcaaaaacctagcagtactcattgacacgtgcaaagaatatgttatttttggcttatttataactttgaccacatacaatattgaaagcagtttctctaattattcttcattaatgattgcactaagaatccaacaggtaatttataagcaaaggaatggttttgtcatttcaaggaagatgacttctttattttacttaaattatagtatgagtttttccaggtaaggtcacagcaaaattacagttaccaaggtgacaataattagaccccttgaagttttaaacaatggcaaaataatcttaattattgtttcaatgtaagctttccagcaaaacaagctatttgaggatagatttttaaactttagactgaaaatctcttgggtatgtgaaatccaaagcacttacacgaagacatgggaaacctgggaaaaataagctccatggatgacttttggtttctgtgttcctacaatttctcttctcctgaggacataatttcagtgcctaggtttaatctcattattggtcctgagtcccccacaaggagttatgtttgagttttgaatgatatatatatatatatcatttgaattatatatatatatcatttgaatgatatatatatatatataaatatatataatatatatttattttttgagatggagtcctgctctattgccaggctggagtgcagtggcacaatctcagctcactgcaacctctgcctcccagattcaagtgatactcttgcctcagcctctcaagtaactgggactacaggtgcccgccaccatgcctggctaatttttgtatttttagtagagacggggtttcaccattttggccaggatggtctcgatctcttgacctcatgatctgcccacctcagcctcccaaagtgcggggattacaggcatgagccaccgcgcctggcctaatgttataatttttttataaaattaaaattgcatacgtaactggtagtcttttcaggattctattttggtttttttccctcatgaaactatttaaagctcatttgtcaaatcaggaactggaaagataaggtgtacatttacctgcagttgagacataaaaaatctgttttaaaaccaaaaaatgttttaaaatatttataacaattggaggcaggtgctgtcttttacttacaagatttaggaaagcttctctccatttaattctttacttcctaatctcatcaatctaaccaagttgtggacattctgaagagccaccttatcaaatgagtggaaaatgattaatttagaaactatagtaaatccttacttaaggtcattgctgggttcttggaaaccgccacttcaaaggaaattacatataataaaaccaactttcccataggctaattgatataaacaagagctaagttcttagggcatatttctggtcagagaaacattaccaaacttctaaataaagacccagaacaattctaacatgaaacattgaaataaatgtgacctatgcatacttttaagaaagataaataaaaacaagtaaggtaattatttactcaattttggtgaattagtgagtgacagtgattgtggtggtgagtccactgaaggaataaaggtttacaaagcgaaaatcttaaggagcaccccttcccaccatgcagttcaaaatcaaacaatgaaaaatatggcagactagaggagagctttagtaccccatcatttcttgttgcatttgtaggattattatctcctttaagaatttttattttacaatcatttgtattcattcatttattttccaaccagcttattctagttcagggttttgggtggctggagcctatccctgcagctcagggagcaaggtgggaactgactctaataggacactattccatcacagggcacacacactcctacacactcactcagacggggatcattcagacatgtcaattcatgtaatgtgcacatctttgggatgtggaaggaaacgaatattcagagaaaacccatgagagaagtacatgtacactccaaacagacagtggctctggccagaaattattttttttctcatcaacattataataaaacaacattgaacaaaacaattttattcgaggacctactgtatactaaactatatttcatagaaggctaattaaaatgtagtctgtaacactgtttgctaaaggagagaaaaacagcactataatccctagacctactctataagccacctgtgttgttttatatattcagaacataactactattatttttacacacacacacatccacctgttcaccactcccctcccacacacacatacacacacagcccaaaaggttgagtgtatgacccaagctagaccagccaatcatggcatcccacacgaaccccatcaattggcccagtaatgaacatgtcacttgtatttttagtagagacggggtttcaccacattgaccaggctggtctcgaactcctgacctcaggtgatccacccacctcagcctcccaaagtgctgggattacaggtgtattatcaactggaatccttttccagggtttttataagggaaacttgttaaaaggggatctctttcctcttgagtctaggctttatgaatgaaagcccagaagtacgtgtagtgttgggttttggagataaccagactggtagaataaagtcaatgagaaggtgagtggcatagaaagattacaaatactgttcgaattcttggaccgtgtactcatcacgtaatttctcatttctcacccctctcccaccctcccacccttctgatctccagtgtctattattccacactctatttccatgtatacatgttatttagtgtccacttgtgagaacatgtggtatctgacattctgcttctgagctgtttcacttatgataatggcttccagtttcatccatgttgctgcaacaatcatgattttattctttttatgggtggatagtgttccattgaatagtacacacatttcttttttttttttaattttattattttttttattattatactttaagttttagggtacatgtgcacattgtgcaggttagttacatatgtatacatgtgccatgctggtgcgctgcacccactaactctacgctgggctgggctgggaaagcctgcactcaagtccaatgatgggcacaagtgctggccacaatggggatcagaggacagtcctcgggcctctggagaaatgccccagcagggggtggagcaaccactgctgtgtcaaagacccagcatggagaaagaggtgcagcctggtttccacagcctagcaagtgatattgggacctgatgcactgtcatactgccaacctggcagggctttctcccgccacccaaagctagtgctaagtcagaatacttagctgagtcacacacaatttgccttcagaccacgtaactgcccaaggtccacattcgccacccgggtcaaaaccacacctctcaggctaaaaccctctcagtccagtcccacaaaggggaagcacacaacttgagggcccatgctggagcccatcccacagtcacctctcagttctggctttgggagttcctccctaattcaagacaagatcacaaaacccagcccaagacactctgaagcagtgactgtcattcctgctagctgcttaggttcccatacagccctctctgagctaggattggtgtggcacccaggtgtgagatccttcctagtgtcattcctgctccgtctctctgctactccccaagtcagatctggggtgtggtagggtcaggacgctcccctgcggcctggattgcctggctatctggtgggaatgtgtattgcagagacactcacctgctctcacacactaggaatttactcacaattttctgctggatctcaccacaaaggattctgcccattttcttttttctgttatccaaaattttcttttgctttaatgttgaactcctgtgttccttcttggataaaagttcacagtatcaatctctacacactattttgctgtttccaattgggtgaggggtgctaacaaagcttccattccaccatctggggaaaaacactcaagaaagagaaatacctctgtcttcattgtgcacttgtggagagagagagaatgagctttttggtctcatcttatagggacaccaatcctgttgatcggaaacccacctcatgacttcatttaacctttatcacctcctcataggccccatctccaaatatatttggggttagagcttcaacatatgaatttttgaggtggacacaaacattcagtccataacaaaaactatagggtaaggactctgttaggataaattcaagcctttataggactacatcattaggtcaaatggggcctcccacaatgattttcatgaaataaaaacagatttaaagaaaatgtagatttcataatgtctgccacctcttacatgttacattttacctaactcaggctagagggatcacagaagatataattatataaatgaatatatagaataactgtgggtcaaagatttattaaattataaccacatatctaaactgactgatagcaggtatcttgtctcgaaaaatataaaagcactgagctaaagcacatctatcttctcggagagctgaattaggataggaagaaataaatgcttgttgtatgattctggtagcccacggccaattatgttagattgatggagaactgagtgaacgagtctccctttcctgagcctatttttaaatgatggagagaaatacaagttttatgactggacatcataaaattatgataatgactgaatctatttcctgaaaccatatgtcttacagatatgtaattttgaaatacaaaaaattttaacatgtcagtatcttttaattcagggtcacatccaggcatatttcaggagaattttattaaatgctaggaagactagaatatccatgtctggaataaaattatagtcagtttaatgcagtgattcttaatctttttgcacattaaaatcacctgggaagctgttaaaaaatgccaatgtctgtttcccaccccaaattaataaaatcagagtctagaaataggatcaggcatttttaaaaaaagtttttggttaattttattttacagaaaatcactgtcctaatgtggagaagcaattaagtcattgtctaaggcagcaaatagtttaattccttggtctaaaattagaaggtccagcctgtgtagaccaacatattcttgtcagccaacttcatatgaggtgcaaagctcactgaagtgtcaagacaaatcagtagtcaaaaggaatcaaacattactgagtggcaactgaaaatctcaacccacatttggaatggtcctagagaagtgttatttcctggaactaaatggagattggagacattcagtgtggctttctgtttgtaaaatccattgaggggataattcttactaattagctccctttggaaaagtaattgggagatttagtcataagcagcaaacacaggaaattcactgcaacttagaacctgaactttaatcaaatatcccttcagggacttgagtctttataaaagaatatcctgttttttcctggacactaggcaatggaaaagagcatcacatcctaggatgccttttggtgcactaccaaataaggagtaaaatttgtggtgaccatttgaaatactttctttacctatttgcatatgatttctataatcctttaggaataactttgccataatcatctcctgttaaatacttacaataaggcaaagacatagggatgctgaagtgttcagttttttccagtaagtaaagggaaccattaaaattttctgagcaagtaacttacatgcatagagaagttaaggaagttgactttagaaagatatagttgaagaaggagaaaaaataggcaaagagatcagctataaaatcatcatagtaactataccaaagcagataggacttcaatataatctctctctctcacacacacatacacacacacacacacacacacacacacacacacacacacacacgaggttgcaggattttttaaatacaaatgtaaaagggtggcaaatgaaaaagtttaagttgtagcaataagatgcaatgccgattacactctaaaatagataaaattctaaaatgaaaaatcatcaaaggaggatatagtaactgcttatactattctcaaatgtccttacatcaagaacataagtctgccaaaggttagagacattttggagaagacttctctgtaaaagctcttaatgtgttacgagtcttactgttacagcacatcatcctatcctaccaaggagagctggagaagaattcagcctcacctcgaccgagagaggataacataatatgtattttcttcttcttgtttttgtttttgttttgttttgtttttttttgaggtggagtctcattctactgcccaggctggagtgcagtggcacaatttcggctcactgcaacctctgtctcccagattcaagtgattctcctgcctcagcctcctgagtagctggaattacagatgcccatcaccatgcccagctaatttttgtatgtttagtagagacagggttttaccatgttggccaggctggtctcaaactcctgacctcaggtgatccacccacttcagcctctcaaagtgctgggattacaggcgtgagccaccgtgcccggcccataatatgtattttctataggttggaggactcagaagtgtagtgactgattttttcatacctggaaaatttatgcatgattgactaagtgcttttatagctaattaaaggaaagattgaggctacattatatgatttgaactcgcagtgtttatgtggaaattatatatgtgtcccatggaccagatataagccatttagaagacagaatatctcttgtctgggtcaacctggtcccattctgaagcacgtagacatatctcagtagagagaatctgaaggtcctgatagaatgccaggggttcaggaagaagctagcaaactggtagaataaatatgaactctgtgtaatgagaacatccataaaaatgtgtgcaatgctgggaggtgggggaatgtcatggtctccagagaacgcatgaaagttgtaaatctaggaccaggaacaatgaaggggttttcctcttctgcctttctgtgctccaaacctgagggagccagcaatcccggttaggaagctgagggagcagaaatcatagtcatggcctgataatgagagaaaaagtcaactatattttcccagctgtagatttcccacctgcaaaaggcccagattagaggagggtagaagcctcaatatctaaccagggccagagtttgaattttcactaaggttagaggtttttaaaattgttgaattttaagaatgtgatcataagtcactctattgcttaaaaatacacagaaaggtcataggacctgtctaaattttttgaaaagtaaggaaaaattaacccagcagaaaaaatttgaaagtactctgagatgcaaaaaatatgattatttttattgtactttatgaatgttgcttatgcaatctaacattaacaaagctaaaagtcaagaattataaactactaagaaatacacagatgaataattacattttatgtctttgtagcattttataattttacatgtattctcttatttgatcctaaatattctgaagataaaatagaaataattttcttcattttatagaagaataacctgaagattaagggtaatgagtgacctattatatgtgttgaagtaggttttaagttaggaccagaatccagatgactatctataaatcttacccaagggcacagctccttaggtaagaagtagcctttgcaattttcctgaaagctgttttcattaattcattcagtaaaaattattgaccttctaccatgcctcaggcattgataggaattcattagggaagaaatcagagaatcccacttcttgcatcgaactttcattctaatacagaaaggcaggcaataaacaaacagaacaaataaaaggatatgtcaggtggcaaactttgtgaaaatataaatatggcatgttaagacagacaacaagacagagactattaggaaccagagctgctgtatgttatgtaggccatactagagctgggctgagcagaagggccagaggtgggtgcactttcaaaaagcaaagaggctattgcagctggagcagtgagcaaagaaatgtgctaggtaggagatgatgctctagcgcaagggagtgcatggtctgagaaggaggtcatatagggccttctaagatcttccaaagacttgcaactatgaactattcaccgtgaatgctatgtgaagccattcacgtgctttcaccagaggggtggttttgcctggctggttttgattctgttttttaagataattctagctgatatgtaagaatagatgccagcaagccatggcaggagtgagaagactggtgtggagactactgtaataatggtccagcaagagctagggtggcagtcgacatgcaaaggcatgttttctacttttttaactttttattctgcaggtggtccttcgctggtctcatactgcatttccttaggtcacattggtgcaatctgtaataaaagatgcctcaatgacaaaattgtttgctacatggagggattcctcactcccatgtctggaaatgaaatcttgcaggtcattaccagttaagataacccttgaccatcctttgtagttcactctgcctttgcaccatcatcctgtcagcagatttctctatcactgaatgctatttattttctttatagcactcattataaattgtaattgtacatttatatatgtatttatgcagttattgttcatttttctcactagactctatgcctgcagaaggcaggatctttctctattttatttctatttatggaatgcctagtctacaatttgacacaaagtagttaataaaaattacatatgaatgaatagaaatagtttgacttttactttacttctaaggtatcccagatctctttctcttatctctatctaaatgaaaaagctaaggaaaatatctgaatgatttcatttttaaaaagaaaaattatttaattgaggaagaaagagaataccctcccctcatttttcaactacattgattatatttttgtggtagtcagaataatatccccccccccaaaaaatatccatgccccaatcctccaaacctatgcatatgttacattcctgaggaatgtaatggggaaagaggaattatatgggaaagaggaattaaaggctataattatctggctttaaaatgagggattgaggattatctgggtaaggccagagtgataacatgggacctaaaagggaaaaaggggagacagaagggagatcagagggatgtgccctaagaaagacaggccctgccattgctgaatttgaagatggagggattgggccatgagtgaagaaatgtggatgcctttacaaggtggcaatacctctcagtttaaagctagcaagataacaaaaacctcagagaactgcaaggaactgaattctaccaacaattgcaattatcaaaagataaattttccttttcattcccaaagaatgtagctgtgcagacaccttgattttagcctggtgagacacatttgggactcacttagtattcatttagctatttcactttttataatgcagaatctgccgatattataatgcaaattaagatctttatgattagcatctttgaaaaaatactttttctttttttgtttttaaacttcatatatttttgtaactattttgaaacataatagctgatgttatcggaatatatttgcacctgaaaactgtttcctcatatttttatcataatattaatattcttaaaatcctgcagtggcattgatagtagccaataaaatcaagatttaaattttaaaaatgttctagacacagttaaatcttaattatgccatttgcttaacaaggcactttgtaacaccttcggttacaccaaaggcacttcggggttttattgttgtattattgttattactttacactttctgtcctacaattataactgaaagctacgagactggatttcaggaaatgagaaaagttgaaaagcaattttactgtaacttctcagaagaattactagcagatttaagaaaaaagaagtaaataatcactaccaaaattaggtaatggtctcatactgcatgtgggtaattcatgaatttcatttcatatcacttctcatttctacaaggttttaggtacaatatgaaaaatgctcatagacacttaacatttgcccgagtgacagagactatatcttcttgtttctttcttccatgtaccagtaggaactaagaaactttgaagcatattcaaagaattctgtttctttggtaggaaggctggctgtgcataaaggctggctcctgctgcatggttagaatcttgagatataatttagcttttcagaaaaagacatcatgtacgtgtcacaaagtctagtctctgaattttttttgtttcttatttgctgaaaaatacctattctacttcctgaagcaagttcatatatttaaaaatataacagctttattgagttataaatcaaataccataaagtttatgcttttaacatgtaaaattcagtgctttaaatatatccacaaagttattcaaccctcagggctatctattttaaggatattttcatcactctaagaagaaactgtacatccaatagtagtcacccccgacttcccccttttctcagcctctgacaaccattaatctactttatctttctatgaatttgcctattctagacatttcacataaagggaaacatatgatatgtgatctttgtaactggcttcattcacttactattatatttttaagatttaccactgttgtagcttgaactgatacttctattcctttgcattgataaataatattccattgtctaggtgtaccatattttatttatccattgattaattaataaacatttcagttgtttccgcttttcctccattatgaataatgctgttatgaactttgtgagcaagattttatgaggacataatttttttcatttctgttggatatatacatatatatatatatatatacctaggaatagaaatgatccttcctttggtaactctatgtttaccactttcaggaactaccaagttagtttccaaagtgaccatactgtttagtgtctccattggcaatatacgagggttcaatttctccacatcttcaccaccacttatttcatgttatttgttatcattcttattattattgctgctgctgctgttgttattattgcaatcctagtggatgtgaggtgatatctcattatgtttttgatttgcatagttataataactaataacaagcatcttttcctgtgctcgttggccatttatagatcttctttggagaaatgtcctttcaaatttttcgatcattttaaatcgggttatttttctatatttttaggttgtaaatcttctttatataaattggatataaatcctttatcagatctatgatttgcaaatattttctgcccccctctgggttttattttcacttccttgatgttatcatttctagaataagagttttatattttttgaatctatactttttctgtgcttagaacttttattgtatctaagaaaccattacttaacccaaggtcccaaaacttttctcttacattttcatctaagatttttagagttttagctcttacatttaggtctatgatatattttgagttaatttttgtatgtgatatgatatagtggcccaagttttttcttttgcatgagacatccagtttattccagttccatttgttgaaacatctattctttccctatggaatggtcttggccctttgttgaaatacaattgactataaatatgagttcttatttctgaactcttaattcaatttcatcagtacatatctctgtcctaataccagtccccactatcttgatacctgcaacttgtggcaattttgaaatcataatgtgtgagtcctccagttttgctctttttcaggatcatgttgactcttctgagtctcttgcatttccatgtgaactttatgatcgtctgtacgataagcagtaggattttgatggggattgtgttgaatctgtagatcaatttgggaagcactgtcatttaaacagtattatcttccaatacatgagcatgtctttccacttacttagatctttaatttctttcaaaaatattttgtagtttccagtgtacaagtcttactcttgttaaatatatttctattttgttctttttgatactattgtgagtgacattgttttattaaatttatttttgattgttcattgccagtatgtagaaatataactgatttttgtacattgaacttgtgtcctaaaacctgtgtgaagcagatacctttttttatatgtactgtattgccacttttaaatcaaatatggagtggctagtaaaacttttactcctaagctttatttctttattaaagcttataataatttctttaagcagaggaagtatttacctaataccttctgcttccatagccatcaataaatattttaataaggtactgtacaaagcaaaatggatttaagaagatatttgatatgctccctagtctctataagcttattatctagtggaaaaggggatacagatgcataaatgtttacatgtagtgttacaggtcccatagttgatgcataatacaaactagtaagttatctaccttgtttgaaagtagatttacctgtccttttatgcttagaaagaaacttattgtattttgttttgcttaactcagaattttaattaagtaagtaatctttgaaaatagaataacatgtccattattttgcttacaaaatactgataattgtaacacaatgaaacataagcagggacctgacactggcaaagttagcatatttgtaaataaaggtttaacagttcgcatactttatctttccactataaatgttttaagcacctttctaacttattaaagatatttcaatttaattttatatcaaaaatcacaagacatttgggctttaagactttccatcgtcttattgtctttaataatatctctgtggtcagttaatattttaagtactttttggctatttgctatgaaaactttaaaataactatagttaattttaatatacagtgattattttaaaatgcacctattatgtaattatttactattgctttctaaatttaattacacattgaacatattagctaagtgtaaatatgatatgcatattttcattgcatgtatttaagtaaagcaactcttatttaaaaccaccactcctatccccacttcacccctttcacacatttgtcattcctaaagtatctgcccctctttgcatctgttagtcactgtcatagtgtctggaatagtaagtatttatagtgttttcaaaggaaggaatgaatgaatgaacagagggaacacgtattgaattttcaaggaagtataaatcactatgaaactgagtattgagagaagtttctaaagacactataagacacaaaaagatttataggatttccataattagagaagaaaagacaagggatttgaggtatgaacaagggtatggaggtgaaaatgtgattgcatctgaagaaaatgagcagataaatttgactggattagacacagacatgggcagtatatggtcctaccaaattttacatgccagaatgggaggcaatggatgggaacagggaaacatcgataatgatttcaagtttccatagtaggttactggaaggatagtattgctcatgttaaaaactgagaaaaccacaggataatttggctttgaagaaataattttgactttaaaaaaaaaaaacatgttattcggtgagacaagacacctcaatagaaatgtctggtaggtaatcagaaatgtgagactggcgcttgaaggcaaagactgaagtagtggtatgggtttgagagatagtcgttaaaactgtgagagtaggtctcagaggaagaaatggttatggtgcaacacggggtggaggaatggctcttagtgctagggaaggctaatgccgaatgggcatgaggaagaaatggtgacacaggatgagaagcaagagtgtatggacagaacaaagcatcccattatccacaaaatagtttcaggatgaaggatgcaattcattcaattaaaccttatttgagtatataatgaatacacaaaaaagattttaagcagctcatagtccactgaagaaaacagaattttaactggaagaaaaaagagctttacagatataggaaaactcttattataagatcataggaagaacaactttgcataaagaagttaaagattatttcataatgactttctgatgtcttcaaaggtggtttttgtgaacagaaaaaaactgtgtaggagtttctttgcctttaaaaattaatgtataatatattaaaattgcaaatcaaaatatctgctcccttattaaacctctaacgttataaacctttagtctcagtctctctctccctctctcctctcctctcctccctctccctatccactcattgttttaacaaccgcttttaagtctttgaataatattggtatcatttaaacaattaaacaccttcaagtataaaaactgcatttataaattaattatatttgattacccttttaaagtactgcactttagttacataaataacaaaatgtcccaaatattttaataattccaataaatgtttaagtatatggcatcttgagtttgtttacaagttccaatactatatatataattaataaaatttttactttaaaattacatatctaaattattcagttgtatattacttcacttaggcacactacgagtacacaaaatactgtactagaacataaaatggcaatatatctgacatcaatatgttaatgtctttggttttattctcgtaaacatttctgttactctttaggtttgaaagaagcttatccatcaaaacaaaaagtaggtcatcctaagcaatttgagggatactcagccatgatattgacaggttttttttcagcattattttggaacatactgagatctagaagtaattttaatataattctataaattggaagaactcaggtaatacataatctattatgagtcgagaaactacccctacatttatatgtttgcttgaattttagatatttcgactcctaagatataaaaatgattttgctccgtttaaagacctttgaacttcatgaagacctttactttttttatatatcttcagaatgaacagagttattatgggttaagaatggcaggttaattctgaatatatctcattggacaaatacagttagaaaacagagtcacattaaatttagggctctgtgatactttctatcaggatcttagtatgagtaaagcaagcatagtatacatgactggaaaaattagtttccattttgaagggcattgtatgcgaaactgcggagtttggattttaccccatgtgacaggtttttgtgagtgtaaagcaagatgtatatggcagcaatgtgatggatcgcttagagaagcactaatgtttggcagggagctatgaagttgttgcagaagtacaagcaaaaaatggtgagtgctaggtttaagactatggaagccaggagaagtttggtatctgtgataggattttgtgacctattgattgcaaggttgagagatagagaacaaacaaaacaatatggaaatttagattttggaagatttggagcattatatcataaactgggccctctttagggagtcctcaatggcctttcttcctgccattgcactggtcaacacgtttaatagttaccactacttagccatgcaacacattttatttctagtttaatgcattattattgtacaggcataaacaattatatacaaatacatgagaagtactttctatgttactttctgccttataggcttctgttgaattatgaaactgataggctataaacatgatcttaagctttggaaaatgttttctaagaaagataaatggtgaatttaatattaaataaatttccccaggatataatgcctttatctcttttttattttctgtactctttggttttcataaatcttggtttattattctgtattctcttgagtatgtggtttacatcccacttattgggtaggtgatttctattttatggcttaaatgagggaggaggatttttgttatctggttaatcctgattatgggaaacagattatgtaacagtcaaccacttttagtgatctcttaagaatcttgaagaaaatctaattttcaaagatatgagtaattattcaaatataataatattgcaatttaaactggtttctctttattgtggtttattggtctgaggataataaagtactgtattcagtagtcaacaaatatttgactcctactacatccaaaactctgttctaggcacagaacacagaatgtacagaatacacaaaaataaacaaaaatccctaccctggggatgtggtttacattcaggtgaaggcagacagacaaataaaatttacacatatgcacatacacaaactaaatataaatatatacacacatatatgatacattatactattttgataagtgctttaaagaaaaataaagcagagaagaggaataataataaatgaggggcatgggggcacgaggggagtggagagtcacagtataactagagaaggcctcagagaaaatatacaggtatttgggaaaaattggaaggaagtgagggaaataaattacagtgatcagaggaaaatacttgacaggtataggaaacagcaaatgctaaggttctgcggtggcctaagaaaagtgtccttgagtaacgaagacaaggatggcagtatgggtgtatctgaagagggcagcaagagtgaaagtcagagaaaaaacagggagagaacagtcattgcaggaatgatgggccattttaaaatgtcgactttaagcgacatgttgaggcattggagagtttaacttgtattctttagcagaaacaaggctacaaaatgaatggaaaaactaggtcttgaacctaagtaacctaagtctctaaactttgccagtgcaattcacataatatagtgaagcaatcttagagaattggaagtttgggaaatttaggtcttcatcttgcctttgaatagttccaaagctgtatagttggctgagtattttctctgctctgagtgacctaaatatgtaatataagaagttccttcttgcttaaaattcctcattctacattctcaaaactttgaccatatatagagaaagctaggaatcatgtaaatctttttcctatagataagatttatgattatctttgtaatattacgaaataacagcaagttacaaccctctagaaaattaacagtctattctataaaagattaatgctaaaaagcaagcaaaccaaactagccccttttattcactagtcttaccataacatttgaagtttatgtatacagttaaagttgaataatagaacaaaatatattcttgtattttcattctattgctcattagtggagaaaacagaagaaaaatgagttgtatttatttctttccttttacttttttgaacgtcacattattctttaatatgagctctggaaattgattctactgtatagagtaggccacaaagtttaaaccaatctataagggagaaaattcatgttcatttcctttaaggatctctttgctttaaaaaatcttggcagcaaaatgttaacttttgtgtaagtcttatctcaggtagtaaaaacaattaaaagtacctgccttagtccattttgggctgctatgacagaataccagagatggagtagtttataaaatacataactttatttattgtagttctagagactgggaagttcaagatcaaggagtctgcatctggtgaggttcttcttgctgcatcatcttatggaagaaaacataagagcagaagaccgtacaaaaaggggatgagataagggtcaaactcatccttttatcaggaaactactctccagataacagactaacatttgtgataatggcattaatcaatgatagcagagtcttcatgaactaattacctcttgaacatcccacctctcaatattgttgcattggggattaatattccaacacatgagcttttggggacacattcaaatcatagtactaccctgtgttaatctgttcttgtgttatttataaaggaaaacctgaggctaggtaatttataaagaaaagagttttaattggctcatggttctccaggttgtacaggcccctcacctgcttttggtgaggggctcaggaagtttaccatattggcagaaggcaaagcgtgaacaggcatgtcacaaacaagaggggaagcaagagttgagagtggaggtgccacactcttttaatcatccagctctcacatgaactcagaggaagaactcactcatactgcaaggagggcaccaagccattcaggaaggatctgcacttatgacctaaacagctcccaccaggccccatctccaacattgggaatcacagttcagcatgagatttggaaggaataaacatccaaaccatatcatacccaaagcagttaacaatcttgggcaacctcttaggtccatccacaaccacttgccctacctaatttcgcaaagcatttttgaaatttgtgttcacagtatatgagaagggaaaggatgctatcttaaatgttatgtactgtttcattttattaatgtaatcatatatgacccaatatccacagccactgatgtcaattttgatcaaagttgcttttaaaaaatacaaatgaaacttgttttctttctggaaacaaatatggatttatatataattctagctcccaaattctttccgtctctgctcaaaatgagttaccaatgcctaacatatcagaatcaccttagaatttcataaaaattacaaattcctgaatacacaacccagaaaagataacaaaatatctgagaatgaagcctaggaatgtgtatttaaaaaatgccaaatttttataaattttaagaactatcagcttggagaatgtgtaggtgcagttaatccttattgtcccaggaaattggcacactgaccctgagtagtcggggctctaggatggtacactggtgcaatgagaagaacttatatactacttctgactttcctgatttattgcctactttttcaaaatatgtaaatccccataggtggctaagcgagcactttcaggttatttggaaaactgaacagggagtttagtgaccactgaacttcactactctttcagaaaacaaatacattccagtggccttagagaattcattaacattccaaaacttatctgcgggtagtagtttacactggaggacctagctcaatctctataatattgtgtgtcatagaagtatattaatggttacactatgtagttccaagtgttaaagattttatagttaggtttcactgttcattacttttaaactaacaatcattttttcacatctagtttgattttcttttccttacaagatgacagattttctactttttcttatctttttactggcagcttcttgtctccttttattaatgtttaaatcttcaatttacagccctaatatacctatataatgatagcttgattcttttgcatctaagggtggaaatgaaaacataacaacattttttgctctttttacttcccatttctttaaatataaattgaaaatattagaagagctagatccaaccactaaagcctgtcatcacatggacacatagaggggatcaacacacattggggcacacattggagggtgcaggatgggaggagggaaaggatcaggaaaaacaaccaatgggtactaggcttaatacctcggtgatgacatagctgtacaacaaccccctatgatacacatttacctatgtaacaaacctgcacatgtacccctgaacttaaaatagaagttaaaaataataattaaaatatataataaattaataaataaaagcacatttttcaattatgtgactacaacagaaggattatatcttcaatttccccactccaccttgtttgaagatagcatgaaatcttggagtctataaatgtacattattttgtttgcagaattataccaaattttaaatatataattatatggtgacagaatgtatacattatatagaggaaaaatataattaatttgtatgaaatatatggataacaatacagttagaataataaagaacatattttattatatttcggtacatatttagcttttcagcgagacttggttccttcaaaataaatcagtcattatatctacaacatctgggccatatagatactcaataaatattggatgaatgagtgaatgagtgagtgggtaggtgagtaagtgaataaatgctaattgcagaactggaaaaactgatacatcagtgatgttggaattttttaatttttttaaaccaaaggaagcttttggtctctcaatatctcatctgacttcatatactataccagcaatcacaggcaaagtgttataattaaaagcaacctatgttattttatatccaataggtaatacctagttttccagagagcattttgtaataaaaaatatttctcaagtaaattcatgatgacctgaatagtatttttcacatcactgcatgagtctgtgcacttaagttcctttaaagaccaactttttcatagaacattagaattcaagtttgagaaaccctatatgccctgatacttctgcttttgcaaactatgtataggtacttcttgttattttatatttctgtgtaagaaaaatagtgaatcttttctatataaacctttatcatgaaaaaggaaaaaaataaaacatgtgcattaaaaaataagaaatatcaagaagtacttgtttaaatcccatgtcttaagataatttgcctgtcctatttgacatgttagaaacaatactaaatagctgacactgtgaaattccagtgatgtttaaaacatagatgattatacacttttttctatgtgtactatttttatagaatattttatgtaagaaagggaaagtaagtataaactctcaatttgtctaaaagcaaatgaagtctttaaaaacttgtttaaaattagcaatatcataatatttcaaatgctaaaatatgaattaaaattctgtctttttaaataagcatttggagtgatacaaaagtcaagaattgatggtaatagtataattatttatactgctataggggtaagattgcataatttgtaatcatacaatttatgttgcttgaaaataaaatcctgcactctgaatttgatctacaaagacatctttcaaaatcctgggaaagtgatttttagtctacttaaattattttgtgttaagattttaatacgctgtaagtatcaataagctgtgtagtttatttggagtgaaattataatttatgcctacatgtatcaaattttcaaataacaatacatgtcagaaaaaaactttttctgcatatagaatatgccattgattttatgtaaactatttcagtaagttgtgactgatgtaaaaatcaaacataataggattattatataaacagaaagcttatatagattataaaaatagactgagctagttgttctctgaagtcattatttgtaaatgaagatgactagaacgttgacctgacaataataaatgaaccaattgtagcctattaggaagatggattaaccagaaaatttagattaagccaataaaatctataccaatgattggctcccagtattatcaattttatttgtcccatgtccaagcttagtacttatttacaaattcatcttctatttatggactgaatctgcattctagttttaagaactgcatactccttccagggttcatatcacccttcctcacctctttgtgctttgccattaacttctcctgggagcttccttgccataacttccccaagcctcactcaccaacaaacactaatattgtcttaccaaaacacactgtatcacttaagaaccatctcaaagaccatcacctccggaaacttcaattgtgagcccctcaatggggaaaagcttttgtgtatgtgtgtgtgtgtgggggtgtgtgtgtgtgtgtgtgtgtgtgtatgttcccacattagttgtggaatttatcttaatccaaccagaattatatatatatcatcattagataagccccttccacaggactattctttgccttctgaaaaaattattttccaaattatattcttttgaatgaagttcagcattcttctgaaattaataattaggggactaatatctatatagaaaaattagaataatattatacaatcagtgttttgacttcattctagctgaagtgtttttattcttaaggtgagaaaaatgatagtattattgtgaaatcaaggtaagaaaaaatatatatgatacccagcgttatccttcaatcatagtagataactcagtaaaaattgttctccttctatttcttataacttaagtgagaaaaaaatgaaaagaaaggtaagcagatactgtagcttagccaccaagtaattgattaagttgattaccctattgggaaaaaatatcattatggagttgtaaaggcttatgaagaatgttggaaaaattgtttttctgtcatttagtttttactatttatgagagaaagtctggattagaaaggtgggaagaaggaagtatcaggccttacctgaattacttgtttatccaaggcaacagtgatagtagaagaactgggagcctcactttaggcaggtagaaagttgcagaggaaagagtttccacagtgctatcctgaggcacagtcagacaaaccctcaaaaatcagtttcaaacaaacactctgttattattatcataactctagtagtgctacagccactgagagaagagactatgtcttcggagaattttctatgacaaggagaaattcagaaaaattatactgaatttagggagtattagaagagtttaacttaatgaaaggacagttgcttcttttcatcttgcttcaaatgacattttaaaatattttcctaatctataaacatgtgacatcagcattttagccaaatggctatgttaatattttattgtttaactaggaaaggctaaattcacttgataaagagagcatgttcactatattcacttgataattgttctgatactgtattgccaattctggaggcaatacctagatgggatttctccattacacaagttccattgataccagtctgtcaatattattagcataaaagctcataatgcgttttgagtaaacagttgaaaggatgaaggcataaattaggggccactattctccctttctctaccttgctctccctaataattaaacctaaatgacttagaaatagagacatctaaccctgataaattatccccacacatcaatatttcctaaaatttatttttaagatttgtgtttctgccaataaatttttaaatatagatttgctgtcttttcaaattatattttattgggatatccttaaatgatgttaaattgttcttcatttaatgccttttacattagagacagagatacaggcatcaacagcttgaaattatcattgtttccagtaagatactgttgagatgatgcagcagttggattgatagaaatataaaaaagttccaaaataataatgtgcaatcaaaattattattaaaccatggacttgagccaaatccaaatagagcatttctattcacacaagtgtcagctgggtttctggtgcttggggtccaagacttcagaactcatatgcacttcctggggcattcatgatgctgttggtgatggacaggtggtctcctgcctctgtgtatccatcactgcccttagatggccactatcttgcaggagaaatggagtctaactgcctcaggtgctccatctgtccaaagagaattggcttgctaataactctgagtttcctgggcttcctcacctatatactttttattgcatacattgaaaatgagactctatccttttatataagtttgcatggggctgctaaccatacattgatatgttgtatcagagtaaaaatttgtgtttctaatatttctaacatattcttgtgaaggtttaaagataccttttccattgggcttccaaaatttgtttcctgaattccctctaataattatgttttctatgcttaatttttatgttttccctgtattgtgtgaatagcagtcttgttaaagtgagaagtagtttcactctcttgaaatactaggttgattttctattctttgactgaatctttctcagtgctctaaattttttcctgcaattttctttcaagacaggtatagtatttgttttattaagtgtgaaacaacatgccttattttgccaaaaggctgtaatataataagaaaccttttggaaaattgggtaagactattttttaaatgataaattcattgtatatgtttgtcagtcataagtggttgttgatgatcctgcagtgttttgtacaaaactggtaaatttggtgccaagaagcttcataggtaggtgattaactagtagtcgttttgcttgaatgagaacataatcaaccttttaagtttctattatcatactgactatcaaataaacttctgaaagaaaaaatgatagttgaagaaaataggactaaatatttctcctgtcttttttttaagagactggattcagtgcaaaagcaaacaaatagctacttattacatcataaagctgtttattggaatgcattagggcatgtggcaaatccagaccttatcgggatgccgtagggagaactccttaaaggatgctggctgcctggcttttcccattgtataatagttaattaggtttcctccagttcaggcatacacacatattggtactggtagggattttctattttgataatttaaaataataaaaatggctttgtttctataatgaaaacatatacatatgtaggttgtttatatgcaaatatacaatgaatataagttgtaatattgatttaaaattcctcttagcgacacagactaagcagtcacccttagtctgtgttgctaaggcctattttcttctgtgtgccccacagttagtgttggtatgtccgcttcttgttcccaggccattattgttatttgtgggtacgtacatataacctacattgatgctgaaatatttaaaaggtcttacaaaatgttcgtatgttaaaacaactaacaataagggaaaaaaattggagtaaagaagtccataagataagaaaaatataaaactaggattatggtttgacatcactctttctggcagccaagatagagttcagacagttacatgatttccagtgtatattaaagtgcttagagacacaattattcctggaactgagagaaatgtgtttccttttgtcttcataaagaatataccatgtaagccactgaatcacttacaggtttaaaatctggcaaaactgcccggtagttcataaaaatgacaatctctttacagtatgttaaaaataaatttcatgttcaagttcctcaatgtagctaaaggactgatactaatgttcggtttagtaggagcaattctgtgccatgtgattgcttatgagtgcgtgtttatgagtgtgtttggggtagaaagaggtgttcggatagagctggggttttaggagatgattctgatttttaacagagatttctctggaaaaattagaaaaaattttaaaaaattagaaacttcatgatatctagaggtcactaaaatctcaacctttgcttatacctatgtttatatttcatctttaatgtcaggtgatgacatcaagtgatttatttttcatttttcttttttgtacttttggctttgttcttatatttctttaacactttagtaagagtcatctatgcatgcatttttatatttattctctcttgaacacacctacacaaaaagttacataaatgagattaaatattatgtgtttttatctggtagtatttgtggttttgttgttcttctttcttttttcttttttcatcccatcagcatcccttctcttattcttggcttctatcttggtcattttttgtccacagtaacattttcaaataatattctgtgttttgcaattctgaatactctgaacacagggtaagatgcttcatttatatcttaccatcaaagggttcaaaagcatacaagttactttttttttttttttttttttttgagatggagtcttgctctgtcgcccaagctggagtgcagtggcgcgatctccgctcactgcaagctccgcctcccgggttcacgccattctcctgcctcagcctcctgagtagctgggactacaggcgcccaccaccaagcccagctaattttttgtatttttagtagatacggggtttcaccgtgttagccaggatggtctcgatatcctggcctcttgatccgcccaccagatccaaagtgctggggttataggcgtaagccaccgtgcccggccggcatacaagtaatttttaaaatattttatatatatgtagctacaacctctagagcattacatcatttcatctttctcattccctatttgatcttatgtcaaaaagcatcaggccagaggataggctttagggtcaagggacaaggttgcaattttgattttgccatgtaataggggtttagtttagtttgggcaagttatttagcattactaaactataattcataatatgaggaaagcagtaggactttctacttggttttgttagaattaagtggtcatcacagtgtctgacgtatagtaaacactatatattaatccaattacaattttccaaaactaggttcaaaaagtgaattaattaaaaaatacataattgtgtggcaactaagataaactactagtgggctttttaacactgataaagatcacttggctttccagatgctttaaataggttaaaactgagaagcatgtaaatccaagtatatacttattttgttagtgtgacaaactcatagattttgtatatcctctcttcaacataccctgcctcaagatggcctttgtaaatttgtttatgtgtgtgcacgtgttttcttttttcttttttcttttttaattgacaaaaattgtatatatttattatgtaaacatgatgttttgaaatatatatatgtcatggaatggctgcatcaaattaattagcatatgcattaccacacatagttgtcatttttgtgatgagaacacttcaaatctactttattggcatttttcaagaatacaatatattgttattaattattatgtaaagttttattgttactcataagatggttgaaatggggccaagagagcaccatgtgatatgatggtgataagtcacttattccacaagatgctgctcagaaattgtttttgctcttggtgattaaggacttgtgattttacatactcagaggacaaatttgaatgaaacttatgttgtacaattcatctggtgtttgctgtagtaaaaatttgtagaggaatagctgcagtccttctccccatatcttctggcataaatataaggggctggggtactgtcttccccatagtcctcagccctgtgtcttgcacattatctatgctctactgaggaggtactatgtgctcagcatgctgcttgacactgtggaccatttaaataccaggagaaatttagaggtttggtaatagaaaaagatacaggctatgaacagaactaagaagtaaggggtcacagaaggtaaagtcttccttctgttattgagggaaaacatagctattcttttaggcccttttctttcccaggtagaaactctgaagttacaacaaagctggggacaatttttgaactcatataaatttgtgccagcaactaaatgagttttgctgttcaaacaaaaaatgccagtcactccattcttgccaccaaactgtacatagtgagaggttttaaagacttaagttataaattttaaaaatagtggtttttatcttaaaattatgttggcctttctgagatttaaaactgccacattgttaagaaagagaccattactgaaacataaagtttggcttgcaagttcacaagtcctttctctgcttcctttcctccttaatataggtcccctgagctacattggaaggtgtaatcttctctcttagaactgtataaatacagtaagccccagtaaaaacagacggttggtgtgatcatttttaacagccccggagatgtccatatgctattcagtaatgtggcatctgcatagccctttagctgtggagtgtactttaaacataagcaatttttaagcaacaaggtgtcaaactattcatccatgtgaagcaaatcagtcctgctgcacccctgagtacaatcagtgaaaacccttagagtgctcttaaccacccatcctccccaggtgcacggcatgttcttttaatacagttacattattgtgcctccaagtcagaaaaaaaattgtgaggtaaaatattcattcaattaacactggagtcactaagtcactactgtgctggtgttctccaccagtcacaggagcatttatgtggctggacagctatctacatccgctcccatacagttatacgctgctgagtctaatcgaggcacattcaatactaataagtaaaaataaactttatggaataagagaaatttaacgaagttaattataaaaatgttcaagacaaaaataagtgaattaaaggcaaaataagtgaattctttagtcttgaatatctaactgaaacaaagtgttacagtgttgttctaagacctctcttttttaatcctcctccatccttagacctttaacatcaagcagactaaaaagagatctaataggtagtcatatatcccgaaagacacattattgaaaaaaaaaaatgcctacaaagtagttgttgccaaaataatttgcgggaaatcaacccaataagcaacactacaaaaataagataaaaaatggctagcctctcaaggtgtttttggctgtgttattaaatgttcttttatttgttcatattggcttatggatccacccaatcataagccaaagctcactcagtcatccattcattcatgtactatttattgcgtgcctactatgtgccaggcactgtactagaccccaaatgatatggcagtgaacaaaaaatgcttggtattaaggaacttatattctagtggtaggagacagaaactaagtgaacacataacatatcatgtactgatcacagacggcgattatgctgtggggagaagtaaagcagggacaatggatagtgaatagatgaagggaaagtcattataattttgactagaattaacatggatgacattgttgatgaggtgatactggagcatatgactgagataaaagtaaaggaacaagctatgtgggactaggacatgggtgaagtgagcagaggagggatcaataaattccaaatccttgcattttccttgtttgctccacaaaaaaacgaaaagatgagtgtggttgtgtctcagggaggcagaaaaagagtggcaggagttgaaatcagcagtggaggtgatccatatcaggctagtcattgaaggaactttggcttttactctaaatcaagaagcttccagatggtttggagcagaagaatgttgtaattttatttatgttttacaaggattgctaactagcctatggagaataaatgatgcatttgtatgtgtgtatgtgagagagagagagtgtgtgtgtgtgtacacacacatggcagcaaggacagaagaaaaaacatctaggatattaatgcaataagtaaaatattatggcactttgttttttgattctgtttgctggtttgtgacagagtctcactctgttgcccaggctggagtgcagtggtgtgatctcggctcactgtaacctccacctctcaggttcaaacaattctcctgcctcagcctcccgagtagctgggattacaggcacgtaccaccatgcccaggtaaatttttgtattttcagtacagatggagttttgccatgttggccaggctggtctcgaactcctgacctcaggtgatcggcccgcctcagcctctctaagtgctgggattacaggcatgagccaccgtgcccagttcgtactttggaacagggtaggagaaagtgtccctgtttgtgataactttcaaaaatagagttcctttatttgttaatttatcggatagggtgtgaaataaagggagaagtaaagtatggtttcaagatcctggcctgagcaacaggaaggacaggtgtcctttactaagaaagggaagactgaagaagatgagaaatccagatttagacagaaatctaaagatattaaatcttatgttaaaatgcctagtaaaagcctaaggtggagatgcaggcaactgggtgaataaaatgaaagtttagggaagggatccaggctggagattaaaaataaattcaaagggatcagcacatggggaagatttaaaataaatcatggagtgagtgaaatcgagaaaaacgaggtccaaatgtggagtcttggattttccaacattaagaggtaagaaatatgaagataaaagagtacaggagactgaaaagaaacagctgttcaaataggagtaaagccaggaaagtgtgatatcctcaatgccaaatgtatcaatcggggttcaaccagagaaacagaagtagtagtaaatgtatattaagatatttatgcagagaattggcttatcagattaggcaaatctgaaatctgcagggcaggctgtcaagaatggcaggctggaatttttggggatgagtgaaggatacagtccacaagtggaattatatctcctcttcctcctcctcctcctcctctccccgctcctcctcctcctcctcttcatccttctcatttttcttcttcagacattctcagttttgatattaaggctgttcaactgattgaatcagacccatccagatgatcttggataaagtctctcttttaatgtcaattatttataggctttaatgacattttcacaaaaacactgagattggcattttattggataactgggactatatcctagttgatacataaaactgaccatcacaccaactaaaggataaatggagggaatgatcaaccacgtcagatagcatagccttgagtatgttggatttagctgctaattcatttgtgaatttgactacagcagatttttattttggaatagagctgtatttgtttcctatggctgtcctaataaattaccacaaaaataggtagcttgaaatagcagatatgtatgctttcacagttctggaggccagaagtttaatactggggtttcactaggttgagataatggtgttggcaggccatagtccgtccagggcctctaacctgcctcttccagtttattgtggctgccatgcatttgttggtggccactcaaattcaatctgtacctttattttcacattgctcctcttttcttgtgtatatcaaatctcatctacctccctctaataaggaaatgtgattggatttacggatccccccctcccaccccacagataatccaaaataatctcccatgtcaagatccttaatttaatcccatctgtagagacccattttccttgaaagataacttatggttccacatggtatctctaggtggctatctttcagcctactacaagaagcaaagcctaactgaagtggatccaggaaaggtacctatttcagaatgtttctgtaaaggtgagcaaagaaagagagcagcagctgaggcaagggtgggaactgtatctcccagtcaaactcacagaacttccttcttttacatgcaaacatccaacaaacaaacatatatgattacagtttcatatatttcactctctggccatgtatatctattcatttctgttacatgtttaaccaaaccacttatggtaggttaatttgattattttgcattgaaaaagaaacttgaatgaatctgaccagcaagagatagtttcctgagtctaaatactttttgacaattttgttattttgtttttacctttgtctacaagggtaagtcgttgttctcaaaaatcacagtgaataaattttcaaagcattgcatacatttgtccagtttgacttacaagtcaaatctcttatatctgaatgtgattccccctatattgtattccaaaactttgaattactttactattacattctttaaaaacatatattggtattgtcaattaaaaaaccaattcccatgtgcttgtctctttatttgctttccaaatcatttaagccctggtcatatctatggcatacattataaaaagatcagagggaaaagagagatgatagaaaaaagtcttacttttttgtcctgtaatccatgacaaggtcaaggaaacttattctgaattcccatttctattacgcatgggctgtctgacatagtaggcatcaagagcagtacgtgatacatgtgtaggtgctcaataaatattgatgaatgaataagtaaatgaacaataaaattaccgataagaccttttatgttatgtttattattctatcgccattaaaggcatttataagcatcataatttttaactggcatatatatatgaaaatgtatccttttatatgaaaaaagagtaattactcataggattgatatagtgtagcagcttaaaagagaatatttcttttgaggaaagcatatggtcaaagatcttgtctgacagcatttggctgcacagtgaaattcgggctctgcaatgagacatgctcaatgtagtgatccctaatctgggcttttttagatttataatcttgaagtaattattttatctatctactcatctggaaaactgggctatctattccatatgattttgttaattaataatggtattgcatataaagggcctaatgttgtgccagctacatagtattggctaatatcatgatcatgatcacaggcaaatatcttttcttcaggtttgatagtacaacttgtctttttaactttttatacataaatattattctctttcacttgaccaattttctgtacaaaatttatttaagaaccccttaaaattcacttaggaaatcagatggagcatacataggaagtatataacacaatattatcagattctgttcactttcttttgctttttttctatactgtaccatgtgcagataatcaattgttatttaagtcctagactttggctctggaatccagatccccttatctaattaccttcttgggtttaccacatggatactttaaaagcagtatgtttaataatgcttttaggatatttccaccccatctttgcccaaatatggtccttgttagtcttccctgttcagcaaacaccatcatcatccatctaactgggcaaaccatgaatctagcagttgttcttgatgtctccttcttcctcagtctctgtcttagttagttcaaactattataacaaagtgccataggctgaatggcttataaacaacagaaatttatttctcacagttctgaaggctgaagtctaagatcaggaggccagtgtggtcaggttctggtgagggtccactttcaggttacagaccgccaactcctggctgttccctcaaatgccacaaagagcactagcaagctctctatggtcccttttaaaagaggctaatttcattcatgagggcttcacctaaatcaccttgacctaatttacctcccaaagacccttttagcacaatcacattggtgggtaggatttcagcatatgaattttgggtggatacaaacattcattacataacaccctccatgtccaacttctcacaaagatattctctctaaataagccatcctcagaatttactccaacccttcttcaaatttcagcttaatcaccatttcttgaggaagcctccccttactgttcctcctccctgtctccagtgcagatcttcctgacatatcttcttaattccatgtacctttgctttgcagcaattacagaggtaactttcacattaacttttgaaatgatttgatttatgtttatctaagattctttgaagatacatggcatctgcttttgctcatcattttatcttcagaagctagggtttttcaaaatgtcagttgggactcattagtgagtaatgaaatgagattaatgggtaatatgcagtattttttcttaatgaaataggctaaaataaaataaacttttgtcaaagagaaaaaatgtagttatgatagaaaaataaaggcagccaataaagaatttgttttcaaacaagtcactgctataaggaattggaatgtaatcctacagggaactctggaaggcagcatagaattcatttaggttctgtacctgacaactttcaatcagtcgtgggctattcccagaacctttaattctcaggcactcgtagcccactatgcattcaggtagttcaggccctgaggaaaatagatacagatactatttgtatctacatataaatgcagtagaaaggcaaggcctgaggaagttacagtaagggcaagaagtagggaggagacttaaccacaaactggctgttttaggtttcactttatgaattcaatttaaatgagtatgtaagcgcattttgctgtttgaaacggggaaaaaaaagtcttagttgagtgatctccgtttaattatctttctctgataagaattgaatctgaacaatgagaacacatggacacaggaaggggaacatcacacactggggcctgttgtggggtggggggaggggggagggatagcattaagagatatacctaatgttaaatgatgagttgatgggtgcggcacaccaacatggcacatgtatacatatgtaacaaacctgtacgttgtccacatgtaccctagaacttaaagtataataaaaatatatatataaaaaaaggattaaatctggatttctttaaccttctcctcttgcaatctgtatttttaaatcattgaattattttcaaggtatttaattattttattcctttgtattgtgccttctgtaagagtcccagatatttaaggcataagaatacaagtatgcttcatgcatacacataatattagaagataactgcaaatttcccttgttatctacagcagattgtttctaggacctctgcaaatacccaaatctgcagatgcccaagtcccttatttaagatgaagtagtatttgcatataacctacatgcattctcgtgtacactttaaatcatctctaaattatgtaaatagttgctatacagtatttgttctttatttgtattatatttctctttctcttccttttgtgtgtgtgtgatggggtctccttatgttgcccagactggtctcaaactcctgggttaagtgatcatctctcagcctcctgagtttgctgggattacaggcaggtactcccatgcctggcatatttttcattgttgtgttgcacatatatatttgaaatctttttgatccatagttattgaatctgcagatatggaacctgtgaatatattagggctgaccccatcaagggtcaagatataataaaattaataatgttcactatttcttcaaggacattcttaagtgaacttagcttttattttctttcatactagcagtgttaagtagtgaagaatgcagtgtccaccagtaaagtctgtgcccagccttgatctgtgttgaggtacagcacttttacccatgtcagcttttgctccatcagtacaaatatcaacatagtgaaggcaaatatatcttactattattaggaaaaatatttggccttgaagaactccaaaaagtcttggggtgacactttgtggactattggcccataatactgtagcaggacgagccgcagacaaaacctctcagacaccgagttgtagacggtagggctttattcagctgggagcattggcaagctactgccttaaaatccgagctccccaaatgcacaatttgtgccccttttaagggctcacaacactaaagatttcacatgaaagtgttgtgattgatttgagcaagcaggcagtacgtgacaggggctgcatgcaccggtggtcagagagaaacagaacagggcagggagtttcacagtgttcttctacacaatgtctggaatctatgaataacatcagtttctaagttatgagttgatttttaactactgggtttaggccaggcaggcccaggcctgttttcgggcctgacaccgggctgcctgtctttggttttactgccttgttgttttttcttaaaacaggtactgagtataaaacaatataaaacaatatgagaaggtctctctcttccctcaatacacaaattttctaaacatatatatgaagcattttataataggaaacaaacgttatcattttaagaagatattaaatgtttaattgtaaactgtctttacttcccaaataagctctttttgacataccatttatcaatttatctaaactagtctttaaaaagtgtttatatatttaacctataattatgtggggagtaacaagctccacactgtgggacttcctaaattaaaaagtagttattttctcatattttttactttcaagtttaaactgggattcgttaaaagttaacatgaagaacaacatattatgaattagtaaagagactaaaagcattatgtagttttaaacatctcttgccttttggaatcatttctacactaaagaaaacagatgttaatgatgataatatcaaaaaaacagaaatggtgatcatcatcatattaggcttgttttaaaacagtaactgtttaatttgaagattccattttgtggtttatcaaagtaccacacaagttatttttatgcttagttacataatcctacgtattgtgggtcagtgcttacgatatcagcaaagttatttaatatatttacaatgtctcacattatccacctatttattattgaattagagtgattacagccacttcattttgttttgttgttgttttgaaatgtgttctgataaaaggaggttcattttgatcgtcaaccagaaaacaaaacatgataaaataaaaataaaactcaggaaattcgacaaatttcttgagagccacctacataaggcattttgtaagaagctatgaagtatacaaagatgtcgctaagtaacctgtaatctagtaaagataattacactgtagtgtataagaggaactatgaaacacaccaataaaatcttatgagagctcagagaagggaaaaattactttcaaagaagaaaaaatatgtattttcccttaaatgataaaatttgttcttatgtttttgctttcaaccattctttaaccatcagattttttcaattctcttatcttcgcattattaaacattttatacatgctgttcaaagtattattatcaagtacagtacaggcttctaaaaatatgctaaagccagatgtaaacagttgaaacagttgcaatactgtcttctctataggaaataaatataggtaatcagtgaataaagctagaattttaaaccgtttacttggaataaactgtggctgaaagccccatgggccgcatgaatacagcagccaggggtcttcagaaggtcctgtatgccagttatgccccatcactaacaggcagagtaactctcactgagcaatgcgaacataatattcatgttttccacttataatgtttaatttgtgtaatacacatacatatgtacgcacaactgaaaaatttggaattacaggtaaacttcattttcaagtaatttgaccattcatatacattcatcttctgtacacttgcaaaggtaagtataaaaacctaattttctgtggcagtttcataggctactttattgaaagtggctattatgcctgtttcctattttatgctcatttcctaataaaaccaacaatatatccaactacacagtattttaaagagagactaattataatgattactattgtaagaaagtgattctacatgaatatttccatgtttctgtagagcctgggcttttttagcaaaagctgatgaaacttggttaaagaatgtatattagtccatttctcacattgctgtataaacaactacctgagactgggtaattttaaagaaaagaggtttaattcactcacagttctgcaggctgtacaggaagcatggctggggaggcctcaggacacttacatcatggagggaggcaaaggagaggcaggcatgtcttacgtgaccagagaaggaggaagaggaaacagggggaggtgttacacacttttaaacaaccagatcttgtgagaactcacccactatcatgagaacagcaagggagaaatccacccctatgatccaatcacctccctccaggcacctcctctaacactggggattacaattcgacatgagatttgggcagggacataaatccaaaccatatcagaatgactgaatatcaaaatatgtcctagaagctacaaacggagcattgttccagagagatttacaaatatatcttccccagagccattcatttatattccagtgtgatagagagagaacttcccctccaatttccagagaattgtttacattctagagtagggtccttgtcattcttggggtaggatgggctgatatgccactgtccttcgtgggcttcaagtctcattctcctgtttaacaccactactagcattgagtaatatcaggctctcatcacatcaccttgtggtgatcagggcgcaggagccaatgctaaggtgctgtgtgaataataaatgctctgttctctgattcatagactcatgtttcctgtcagggtatctgtctgcctctgtgtgtttttttgtttatgtatccatacacctatccatctatctggttagccagcaatccattctaccatccatccatccatccatctaaacttaccaactatgacttacagaactggtttagattactcatacatcttatgagtttcttctcttcttagctttatcaaacaacactcaagctatgacaattgaaatggtattaccatttcataaaacaaatattgctttttaatttttacaaattttatctgaggattttaaaaataatacttctctgagtatactaattgaattatatttttcttttctcattgcttatattgcattctcattcaccaacctcagaattattattaaatattgcaaagcaaatattttaaaaagtactttaaaggaaatttttaaaaatatatattaatacttacactgatccacttagaagaaatacatatcaattacactgatccacttagaagaaaacctgtgtacttaactttattttcgtaaaatctgaaatttaatttaaaatcgagaactatttttttaaattaagacaatactttggaaataatattttaaatatatatatatatatatatataagagaacccactgttatctatgttacattaacctggaatttactatatcaaggaaattgtagaaaaagaatgcagtggagagagagttaaaacactagtcaaacagacaagacaacaccacaaatataggatttttactagaggtgcttttttccccccttaggaaaagtatggcttctctttgggaaaattgagattggtcacacttcagagcctttgataagtactttgatgttcaataagaatgaaaaaaacaatgttgcttttgcaaagagaatcaagaaaataataccagtttcagcaaaagaacattgttttgtgtactttaacacacactacaaggaatgtaaagaggccctttttattaaactggggaaaacattttttgcttaaaaacaaataggacaccagtagaaaaaaaaattaaactaaaacaaaacagcatgcttattgctttgtgtgtaataggtagcaaatatttttttaattgaatagaaggagtgcaacaaataaaaagctacatagaggataccattttactggaaggccaaatcgtgtccttctagtaaaaatgtatagttaacagagagtgcaatttgatgtgtgaataaatgaattattttgcaagaagagatattttgctaaatttgaacaatgacatccaagaaatgagatttctttgttgttctgctgggtttttcttttaatgtaattttgacaattttgattaaatgtccaaattcataatgtgataaattattgtggatgcaaaaatgttagtaaaatatttttaagagttttaatgaacctggtagatttagacagtaatagagttctgtgactccccaaaatgaggggacttgcctcttgatatcagggaggaaatcatggggcaaagctcatagaaatgacagctgtagctaagagcacctttctcctctaaagctgactgcagaacaaaaggttaaatgtagttgtcaagtttatagacagggaaatacttgtagtaaagtgaaagtaaacaagcatttaaaaagcttcaaagagagtcaaatccacaattcggggtgatttggatgaatttctctaatatgctaatctgcatggactaagtccatgggttagaggaaagataagctgaatttagggtgaaggggataggaacctctggacaaagggacaactttggctgatgatgcttagggtagagtaaggatagttttaggaggttctttcaatattgagagaggtttaattgaagaatatgcaaaccaaactagtgagattatgaaaaagagttcctagaaatagcacaattgtttgggtagggaaatattggacagaaaaagaatatggaaacaatgcaagaatcgttggaatttagagtgcaaataaaaagaataatctgaggaccaagtaaaggctggttaaaccaagtcaatggaacaggagcagccagcataatttcttattaaatagtttggatggtgtatcaggcctttattgcctcttgcctggattattttaacaattttcccatgaagttgtctgccttggacataatacatctctgatctatatccattagactacttccagagtcaaaagtctataaatcacaagttaacgatctatgtgattcaatggccaaatcctcacgcttccccatctgaaattaattcccataggactctacttggatttctatttccataactaaattacctcaacatacacttgttacctgattatatacatgtctgcagcatgaagttggaaactttgttaacgttacgatttttcttttcaatgtttttttctttttcttagtttgccaaactaaagcacagcagaacaacaacaaaatgttctttccctgaaacagagagagcccaggctaagccagagataacaaggagttgagactaccaaaagaatgctgacttctaaaggttgggctaagagaagagcttttatgtttaggtagaaacaggatgctgattttaaaaaaacttcttcattcattaaacattttccagatgtgagattgctcatttcattcgtctcagaagcttattaaattcccctacactatgttggaaattgattttcacttctggaatacagtgatctggaggcagagatgtgacatgggagaggaagggaaggtggaagaaaattagatattttcctaaagtgctattagcaagaaaaggtaaccaaagaatgagattaaacaaagcctttctggagaagatgacttgtgttggtggtaggggtattgagatgaaagaaagataggaataccttcagcagactgataattgtatacactttgaagtgtattttaaaaatagctgttccacgtttaatagatggggattatttactgttattaaaaataatatagagaagcagattaattgatgcatttatgtttattgagttgatagaaccaatattatggaaacaaactggcaaaacttttcttcccttttgggcgttcttgttctttcttgcattcttttgtgattgtttccaaaccaatgacttcttggtaactataataaaggtttatattttacttgataaaatgtaaatttaaatagtgttttttagaaataacctactgtggggccaggcgcggtggctcacgcctgtaatcccaacactttgggaagccgaggtgggcagattacgaggttaggagtttaagaccagcctggccaacatgatgaaagcccgtctctactaaaaatacaaaaattagctgggcatggtggtgtgtgcctgtaatcccagctacttgggaggctggggcaggagaattgcttgaatggggacccgggaggtggatgttgcagtgagccgagatagcgccactacactccagcctgggctacagagcgagactccgtctcagaaagaaaaaaataaaaaaaaaaaaaataagaggaaaaggaaaaaaagaaataacctattgtggtattgtggtatttttcagactcagaatttcagtccaggaaagggaataatactaatgagtgacattaaatgctcttttttaatctggaaaataagcagcaaatggctttagcttctaaattttctcgtcattttttttttcctttcttaccagtttgacctaaacaatcttagaatgtatagtagctcacagctcttcacagctttgtttatttttaaattttttttagtaatccctctttgaactgacttttacctttcattgtctatgattcttcccagactcctccatgcagggatcttgatgcagattcttccatcagtacctccagatattaacctgagaatggaaaatattttgcaaataataattttaattctccctcctctcaaaaggaacatagtttacccgaaatataacttaaatttaatgataataattaactttccaaattgccaataattccattccaaatatttcataacttattattaacccaaaccattttctctatactcttatttccctaaagtgtacacaataatcagcattcacaaggaaaggggtaaactgtttgactttactaccacttttaattctagctgcatttttaattttttcgagatagttttacaaacacaaatacatacctattgtattaatttctttctgatttttttttttaaaaacttttattaccagaggcctgttcatattagacatcaggtctgtgaagtagatatcaattcaacatagggatctatgtactgccaatgaataattgatccatgaagaggcaaaatcttcctaaatttcacagcttactatcagagaaaataatgtaaatagccataataacaaaaatggactttctaccctcagtgctcctatgattggagggaattcagttgctctgcataccccctttccttcctttagaaagaagatctggccggaagtgatggttcagtgtcgagtcctttgacaaagaccatcttaacttatttttattgtttcacctaagctgtgttttgtggtttcgaaagtgtctagcatgacctgtgaatctattacagttcaaaatcaattctattcctgtttccatagttcacattcatttccgtgagtattagggtcttcataaaacagcagttttttctgagtgttgatcctagctgattgaacgtcttcaagaacaagccactgatccttgttacacaaattgtaaactcagtcgaagtgagcttcggctgcaggttcaacactgcttacttaatgaaagcaaggaaaagtctcttttttccacatgttagtaaagggtttcaacaggctaaaaaaaatattgaataactctacataatggagaaaggcagtaataagaaaggaaaaacagaaaaatagaataagtagtctgtgaatcctttggagaatttactgaaaactagaatttcttacaatgtacacaaaatggctgtcaccaatgcaataagactttttccaaaaattgttctcacaactctaagcaactgaagtgttgcttccttcatcacatcatgtaatgaagtcaacagagtataaaatattccttgtgaaggaaaacttgatatcactataactttaagaaatattttgagggtgggtgtaagtttgtatctgaaataaataagtggttactaagctacaaacagatttttagccaacagccacactatctaaaatgttcaactctcctccatacatagacacctcctctccccttctctgctttattttcttttacttttacatactaaatattttatctagcagtaagtgtatataatacattatatatttatcatgttggtttcctgaatctcacatcagactgcaagctccttgaaggcaaatatgtattcctttaggttcactgttgtttcctcacctcctaaaataggacctggcatataattgtgctcaatcattttttcaagaattaatgaatgaggcagggtgcggtggctcacacctgtaatcccaacactttgggaggccaaagcaggtggatcacttgaggctaagagttccagaccagcttagccaacatggcgaaaccctgtctctgttaaaattacaaaaattagccaggcatggtcagcatgcctgtagacccagctactcaggaggctgagacacgagaattgcttgaacccgagaggtagaggttgcagtggctgagccaagacagagccactgcactccagccttggtgacagagcaagaccttgtctcaaaaaataataataataataataataaataaaaaagaagaagaattaatgaatgaaactggagagtctgctgcaaagagaatcctgaggttttatacttctcttccaaagaataaaagctgtctatcaattctagaataaagcactagcttttgaaatgagtaaagggatcaagaaaatctagtgctacctactggcagctttcccaatggtgggagtagcagttttaaagattcaataaacaatctccttgacataaaattcaacaatggcaaagttaagtgcaggaagagggcatgagacctattccccttatgaggaagagaatttattattaaaattatgtacaattattgtggtgtaatgataatgataaaattgatgggctttgctttattaattgtttatacatattgtgcagggtgtatatatgcttactgccttgtgtaggtggggtgggacacagctctccactgatacctcttcttctggctcccctgatattccactagaagggggtaatgagagattttgatacaacaagcattatcagttttatcttgtttgtttattccacagatatttactagacatgcaaagcaatactatttagtagatgcaaaaatagataagtaaagacctataagtttttggtttccaaagtcaaatgtttttatggtttattaatattgagaacactgagccgggcacagtggctcactcctgtaatcccagcactttgggaggtggaggcaggcagatcacttgaggtcaggagtttgaggccagcttggccaacatggtaaaactctgtctctactaaaaacaaacacacacacaaaaagttaaccaggtttggtggcgcactcctgtagtcccagctacttgggaggctgaggcaggagaatcgcttgaacccgggagatggaggttgcagtgaactaagattgtgccactgcactccagcctgggcgcagaacgagactccatctcaaaaataaaataaaataaaataaaattgagaacacagaaagatgagcaggtttgtgtggaaaatccttaaatctgtttgacaaattgagttgaaagtgttgaattccccagattacaaaagaacaacctgttaataaagcaatgctaaatgtattggaacctaattgcattcagaaactactggaaagagttttattgtctcaaaaagggaaagtcagaaatgagattttattaaattttggggtctgggatccaggagtttaaggtggatttttcaaggcagactttttcaggtgagcagactgttgtctctaaattgatctgcaagaatttcctgaagcaaacagtagagttatttataggattacagtcttatcttttctgtgtataggtttactggaacaaacaagacaactgtggtcccagttctcagaggtagcttttgagacctccacatgcacatgttgaataaacaattggaactcagagggttagtataaaatttaggagtaatcactatatagattatcataaagatctggagatggttctgttcaagattgccaagggatggaactgaattcctgtacggctgctccccacttgaaaagccagacacaagaatcaagagttggtgggaagaaagaggtttattgaagtgctagcagctgaagagacagctggagtcaggtctcaaaaagccatctcaaattctcaggctggctaatggggtttgaagaggaaggcggcatggaaactatgtgcaggagtgatgtaggttgcaggtctgcttgtcattttccagtggctgtcttgaataatgaaccatctggaggccttggtgtcaacttgcttaggtcagggtatggattaactgtgcaccaatttcttctcagaagggagaaaactttaactgccatctccactttacgcctgagttgctttaagattagcctttggaattctcaagcaaacacgtagttagatatatgtatagcaagaaaaaaaatgaggcagggattactttttaaagcaagctagcaaattggctgtactggttactgggagagagcatcaatgagaaaagaaatagattagcacagagtattgagaaacctcaacatttaacaggttattgttggcagacgagcattcagtggagattgtaaagtggttagaaatgtatgaggatgaacaggagagggtaaggagggtacttcaagaagcaaagagtgatcaacaaggccaaatgatgctttgtgttaaaatcatatgaggactttgaaatattcatttagtaacttcaaggtcattattaatcttagcgtgagcggttttggtgatgttattgaggcaaaaaacagagaaggttgaaaagtagtgaatggataaaaaatgaaggtagttcaataatttgggatgagaaagagaagaaaaagataaattcataatgtagaaatgtgagaagtaaaatttttaggcaggagagatttgaatatatgtatattctctgcttccattatcactccataattttataagaaaaaggtaaatacaccctttcatcctctgtgatttcttccttccttccttgtgtctattgattctttcatttactataatcagcaaacagcaggcacagaccatggccctaaggaacttacagaagttaactcatagaaggccaatatgttgggaaaaatgtgaataagtatataaatatcctatcattgcataattagtatgaatgcagattaagtttgagtttttctgtaatactccaaggcgaagagttacgctgccttctaatgcaagtatttggctgaaaattggattgtgttttgaagtctctgtactaaatttcctccagacatagctggcatatacagggacaaaaacttttgacctggagctcattagtgcaatgaagcattcaagtgaactagcaggtacaagcctgaaacaaacaaacaaaagaaaaacatcaattgtttgattaattgtaaatgcggaagttgagggtagggaagtaaaatttcaacccatcaaggaagtagtcactttaaaattcacctgaaatgactatttcaaaacctgcttccatttcaatgctaaaaatatttcttttccccaaaccccttaaacggaaggagttataagtgaactagaatacacataggaagtcatgctgcattctcatgttgctaattggaattttgatgaatataatataaaagcaaaacaagagcaaagtgtttccattagttcactacccatgtttctgcaccttaatcagagcgttgttaatatttaaatatgcgtttgaagccccaagtgtatagggaggcatggaagtttcattaataactataatttatataaaagaatatatgccaaagacaaatgctcaaatatggagtttcataggaatttttcaaacgtattttatagctcagacatggaaaaagaaattgcagcaggatatgaacttatgcttagctactaagatacactatggcttatcatttattgagaaaagtccagatttttgtcttaaagttatatttctccatcagttatataccacttttttttttcacataaggctgtttggaaacaggcaaataggaaaaaaatctgcaggaaaaagggacattgacataatctgaaatgccttgtattctgcagatttcagaactatacagctttcaaaagggacataagggagcagagagaactgccactctagagctgtgactcttttctccttcagtagtcatgctttcaaatgggtccttctgcagaggaatgacttgaagtaacaatcaccattccctcttcacagcagtctgccacagaacaaaacttcctggaataatgccagttgaaatgactaagtgtgtcttttctatacatccacaaggatacttacctagtgccttctgggttctaaaggagaggatatagttcattgttaacaacagctctaagtctctcttactatgtgaaacttactcttttattaaccagaggaaaggaatcagagacttccaacacattacaattatattcaaacatacttccattcttaggatgagctctgactcaaatattgttttatgctaagtactagtatggagtatgccttcaacattaaattcactgtgaagaaacatttttaaagtaatatgataatcagttatgagatgccactagatatcctcaaagctattatgcaaagagcgagaggaaactttaaagcaaaaacagattaagttcttgcagttttcataagggggttggtttagaattcctacagtcaaataagctgtgactgtaatggttctttgagttgatgcacagattgtgcaaaatcagccctacacataagcagctagcatgtgtaaaaagtctacctgactcaaaatatgagtcccactaggctatcacacagtattatatcttggaactattgtataagaatgaagacattggccaggcacaatggctcacgcctgtaatcccagcaatttgggaggccaaggcgggcggatcacctgaggtcagaagttcaagacaagcctggccaacatagtgaaaccccatccctactaaaaatacaaaaattagccaggcatgatggcatgtgcctgtagtcccagctactcaggaggctgaggcaggataattgctagaacctgggaggtggaggttgcagtgagccaagatcgtacaccgcattccagcctgggtgacatcgtgagagtctgtctcaaaaaaaaaaaaaaaaaaaaaaaaaagaagaagaagaagaatgaaaaaaacacattcttccaatgtcctacaagacccaacatcataagtactctctgctccctttcacaatgaatttcctacacattgtattccattcctggatcactctactgcaggtagaagctactttgctgttcactggaacattctctttacaatttcatctaaagacctttgcctgaaatgttctcccaggcaaaatagcctggctaactctgttagctctttcgttgtttccttgaagtttatcttattaataagcctgccccgattgtattattgaatagtacaactacccctctcctcctttattttttcttttcctttcatgcaattttattgagatataattgccaaataatttttataagtttaagatgtacaacacgatgatttcacacacacacacacacactacatcacacatagatatatattgtgatatgattaccacaatcaagttagttaacacatctatcatctcacctatttgccattttttgtttttttggttttatgacaggatatttaatataatatctactcccttaccagatttcaagtctataggagtgttattaacaatagtcactgtattagtctgttttcttgctgctataaaaaacttcctgagactgggtaatttataaagaaaagaggtttaattgactcaccgttttgcctggctggggaggcctcaggaaacttacaatgatggcagaaggggaagcaggagtgtcttacatggtggcatgtaagagagagcatgtaagtatgcaggaaaaactaccatttacaaaaccatcagatcttttgagaattcactcaccatcacaagaacagcatgaggggaaactgcccccataatccataatccaatcacttttctccctccacacatgtggattacaggtccctcgcttcacacatggggatgagatttgggtggagacacaaagcaatatcataagctatggggatctaatgtacagcattatatataaacacattttataatggaaagtttatatgcttcgaccagcatctccccatttccctacccactgtcccctggcaaccaccattctattctgtttctaggagtgtccccctcctaattcttctttaatctgagttaatattttttgtagcacttatcacaatctaacataaaataaaatttccatgtttattatgtttattattgtttgtctcatttcctgcatgagacaccacctccaccatgtaatctctcttcgtaggaatctttgtcttctttgttcactgttgaatcccaagtggtgaaaactctgcctgacacattgtaggcacttaataaatatttatggaatgaatgaattaatgaaaactatgaactatctttttatctcattaccctgaaatgcactagttacatactctcctatactaagtgttaaaaagaattgatttattatagtaacttaatttcctattaacagagttcctactttaggttcaggcactgacaccaggaggtccttaaagtaatgcattttgataagtgaaataacccattgacatacccactagtaactacttgcatattgaatttatcaaattacctaatttgtattaaagagagcaaggatctgagataatcaaactaagaatgtagtttttgatgaggagacttgagaaaaagtttgctgctggagtgtggtggaggcatacctgggtgattccagggcacatccaaaaggaaggagagagggctaggtgttgactttggttttggaagctggaaagaacatagttggggaaaataatctcaaaaaggggaggtggaacagaaagaaaaagccattccctttttacagttgtagtaggtccagcctggcttgttgcatttcaacaaggcaagaaaaaaaagaaagaaagagaaagaaagaaaagaacgaaagaacgaaagaaagaaagaaagaaagaaagaaagaaagaaagaaagaaagaaagaaggaaggaaggaaggaaggaaaagaaaaagaaagaaagaaagaatagaaaaggaaggaaggaaggagaagaaaagaatgaaagaagaaagaaaaaagccttttgttgtcatcagtgtattaggaaatgggaaacacacatatcaaccacagggaaaaagaattacccaaacaggaggttcattttaccctgctcctttcagtgaaagaagagagaattaaaaaggaggattaagtaggcatgtgcttagagctctgatggaaaaagcatttaaaggcagaattcacattccttaaaaggacaaatacacggcttttttctcccaaattatccatcaaggtgattttggtcacatgtgattcattagtttagagaaccaagttacttggctgtatttcagatttgaaaggagagcaacagtgggctgtgttaaatacatatatgtatttgcaccatttctatcctgatgacaggtggcaccattccaagagccaatgtttcctttcaaactatttctgagtacatttaatgatttaaatatgttcttaatcaatttattttttcctcccaaggtatcagaagtcctgactcaattcttcatattaacatatgcattccttactaagaaaccagaccataactaagaagggatttaggtatgagaagtctaaagctcattaccttaatttccttttttataggttaagcattgcaggatcatttttgagattctaatttttgatgtaatattttttaattaccgaatgtgggctttttatatctgaggtgatttttttcttttaaatcaatgtgtccattaaagaatgtattattgcacaccagatggaattaaatgaaccattgtgtgaacttggcattttcagatcgggttacctgaatgtaattacctgcaggcagtttccaaatctgctgttcataagggattagcttgcgtatagagattctcttccattctcctcaggttttttttttttccttgaaatgcttttagtcattttggcttattgtaccatcatgctctgccactgataatagtgaaaattaatcctgaactaccagaattgatgatacagaacaagtcgacagctgtttaaaaaacaaacagacaagggacagcttatagaagagaacgttatgattttgtgccacataaaatttgaattgtctgccacaattctaataatactgaaatttggagaaatttctctatctattaaatagagtttctttcagaaatttatccccaaactgcaatgctgcatttaatttcctgttgttattttaaaatcacatcagttgaagaatatgaatgtctacacattttgaatcacattccaatttattttctttgcgagtgagcagaattatatttcctgtgagtcatctcttcatatagggagtataccctctgggtggcatttattgctggtgtgtcaatcaccttcttattttatctctttaagtagtgaagagaggttatgtgtctgtttcctgcattgatgttaagtgcacaattttctctcactaaataaatatatatttaaacaattggaagaatgggatttcaaaattccattttaaattctcagcagtaaatcagttttatctttccctttaaaagtgaaatatatatatatatatatatatatatatatatatattactactttcttcaagcagttggtgaagagcatctaacctgagactgggaaacatcaagttaatagaaacaatataatttataattttacatgatttcatatattatttttctgttagccttgtaaactttccaatgactcaagtgatttaaatgatgtgtgaatttttttagtaaggagttgaataattagctttcagagaatttaactagtatcattctaaaatacatgatgacctggaaaaatataataataatgaacataaccttacagaaatgaattatggaataatgatagataatcaaatatatgccaccagtttgtgaattaatgttagattatgttgaaaataggtcacttccaaagaagccattgttttcattgttattaatgtagacttgaaattgatattatatagttagtttctaacttgcaagccacaagataaagatttaggctacttaaagcaaaaagtaatttgctgaatgtatgctggactcattaagaggagtctcaagaattaaacctcgaaagccaaagggagcataactgctctggaagactaggaagcagggatggcaggaatgatcacatagtatctttttttaaaaaaaacagctttattgagatataattcaagagcataccactcatccatttaaagtatgtttcaaccattccttctatccttgtgtttctcattcaagagtccacatcttagagaagcatctgttgtccaggcttatgccatatctcctccttctgctggtgtcagagctggtgaggggcaaggcatggctggagtcacagcatgagatgagatatccacaggcagccacctggatttactattctgacaagcaagatataaaaaattaggcaaaatttatttttagtaatatgctgataaatatgttgaacaactcgttctctcccacccccaaaaaaccctgtttgttttgttttggatttacagatttccatcatgtaaatactccaatcgtaatagtaattttaagctaccagtgtgacagtatgtggagttgggtagggatgctaatcattggttcttgtgagctggaacaagctgattacagcacactacttagtatctccccaaaagaacatgggtactttcaggaaggggaaaatgaatgctagccattcaaaatgtacacacacacatgtaatgagcaaagatcttattgaccttaaacacagagccattcaatatgttgtttttcataaattagtgactcagtagataagaatttgggtgcagagatgttagagactactcttacgttttatttcataagaaaatagaggctactgtcccttgtcaatttcttaatttagctcaggaactcaaatggacacattaaaaatattaatagtaaaattgtaaactgttttggtagggagaattctaagatgacctccatgacactcacctttgttttttttcccccattaatatgttatattcatggcaaaagggattttacagatgcaattaaggttactaattaggtgactttaaaataggaagatcacacaggtgggcttgacctaccatatgggtcttttaaaagcagagaattttctctgactagtagaggaggaaatcagagagactcgaagcattagaaagactcagtgcaaaagaggcatgcattgcatgtgggaaggacctgagagcagcctccaggaaaggcgctaggagagccagaccaactactgactgaaattcatcaaggaaaacatggcctcagtcctacaactgaaaataacagaattttgccaaccgttagaataagtttggaagtggattatttcttagaataccagataagagtccagcctacccaataccttaatttcagttttgtgagtccctaagcaaaccatccaggctgcccagacttttgacctatagaactgtgagataacaaatcggtattgttataagctgctaagtgtgtggcaatttgttatacagcaataaaaatctaatataactatctataaggaggtgccttaaataaactttggcactacaagcatctgaacaaacaaaaggatctgtatggaataaagcgaaagaaaggcttttaaagaacattaagtcttaaatcaattgttagaagaagacaattggagtaaggaacatgaagtaagtggaggataaggggtggacaggtaatcatgtcagcgatgattattggcataaaaaagaaaccttactaacggaaatataagaagacaggcaagattgcattagagagtcataaaagataaggtcaaagagctgaggttggtaaattgatgaagatctaaaattctgtgtcaataagtgattctcaacactttgaggaattttaacccatgaggacattttagaaaatgaacaccagaatagcacttcagaaaaactgaatcagaaattctggcatatgtgacagcatctacatttttttaaacttctgtaagtgatttttgaggtgcagccaaggttgaggtccactagtgggaattctggaattcacagatatctaaggactatctatggactaaagctatgctagaaggtacagcctctctccctccctccctttctttatttcttctttctcaatgtaagaggaagacatgagtcaaccatagctgaattataatattgctgggtttttttacagcaaaaaaatgaagaatattataaaagtcaaacaatagaaggtgccaaacatgattcctattgtaatggaaatttatgccatattatttcattaatatagtttttaatctcatgcaaactgtttaaatgtatatatctgtgatattttaataatgtcccaagtttgatttccctagaagcagactctgagatatatattaatatataagatatttattagaatgttctcttgatatccacatggaaggaaggaaagatgattttgcagaaagagctgtggagcactccaaagatagatgtcacccttcatagttgccccaaattgggcaagctgatgtggccttatattcctactgtgatctataattgaaggtaaactctccttgaaaaaagcagttttcctcacctgaagccatccacaatggagaatgtccactgagagccatcgtcacacggaattcttggcagctgggagaataagatttttaatcctgagaaggggtggtcaggactgcacatcacagagcccactacaaatgtctacttctagctggtaaacatacaggatgcatttgcttttaaatgtatttccctaattataaaaaaaagcctgatatctacaaatttgttcaaaatattttaccaaggatcctattttcaaaatatgtttgaaactagttagcaactagttatacaggtgatggtataatttaatgagataagaaatatggaaagaaggatatttttagggaagaggatgtgtacaatcgttgataagtagagtttgatgtatttgcataaaaacaaaacaaattttaaaaatacacgatttcatgatttcatgtgtcattttagattcagccctatttttgaaaagattgccaatagttgaaactttttaaacctaatatattcttacctcacacagttgtcagtttttttttctttgaaatactttttttattcacttctgggatattatattctctaggttttcattttcctcattctaaatatctttcagatggaagtgacagattctttctatgcttttagatatcagaaatttcacatttgtgattaactcagttctacaattgacatctttaccctcctcccaaacaatacagggacctagaatattttaattccaattaaagcgttgttacttataatttctattcagtgatttattttaatttttacttaaatattatttttatataatcaatactttctttagatttatccataagtttaatatttttaattaaacaatctttcttcctgcattttctgggatattttttcttatttctttttttttcttttttttattattatacattaagttctagggtacaagtgcacaacatgcaggtttgttacatatgtacacatgtgccatgttggtgtgctgcactcattaacctatcatttacattaggtttatctcctaatgctatccctccccgcttcccccacccaacaacaggccccagtgtgtgatgttccccttcctgtgtccaactgttctcattgttgaattcccacctatgagtgagaacatgtggtgtttggttttctgtccttgcaatagtttgctgagaatgatggtttccagcttcatccatgtccttacaaaggacatgaactcatcattttttatggctgcatagtattccatggtgtatatgtgccacattttcttaatccagtctatcattgatggacatttggattggttccaagtctttggtattgtgaacagtgccgcaatagacatacatgtgcatgtgtgtttatagcagcatgatttataatcctttgggtatatacccagtaatgggatggctgggtcaaatggtaattctagttctagatccctgaggaatcgccacattgtcttccacaatggttgaactagtttagagtcccactaacagtgaaaagtgttcctatttctccacatcctctccagtacctgttgtttcctgactttttaatgatggccattctaactggtgtgagatggtatctcattgtggttttgatttgcatttctctgatgggcagtgatgatgagcattttttcatgtgttttttggctgcataaatgtcttcttttgagaagtgtctgttcatatcttttgcccactttttaatggggttgtttgtttttttattgtaaatttgtttgagttctttgtagattctggatataagccctttgtcagatgagtagactgcaaaaattttctcctattctgtaggttgcctgttcactctgatggtagtttcttttgctgcgcaggagctctttagtttaattagatcacttttgtcaattttggcttttgttgccattgcttttggtgttttcgtcaggaagtccttgcccatgcttctgtcctgaatggtattgcctaggttttcttctagggtttttatggttttaggtctaacatttaagtctttgatccatcttgaattaattatcgtataaggtgtaaggaagggatccagtttcagctttctacatatggctagccagttttcccagcaccatttattaaatagggaatcctttccccattttttatttttgtcaggtttgtcaaagatcagctggttgtagatgtgtggtattatttctgagggctctgttctgttccattggtctatatctctgttttggtaccagtaccatgctgttttggttactgtagccttgtagtatagtttgaagtcaggtagtgtgatgcctccagctttgttcgtttgaattaggattgtcttggctatgcaggcccttttttgattccatatgaactttaaagtagttttttctaattctgtgaagaaagtcattggtagcttgattgggatggcatttaatgtataaatttccttgggcactatggccattttcatgatattgattcttcgtgtccatgagcatggaatgttcttccatttgtttgtgtcctctttcatttcattgagcagtggtttgtagttctccttgaagaggtccttcacaacccttataagttggattcctaggtattttattctctttgaagcaattgtgaaagggagttcactcatgatttggctctctgtttgtctgttactggtgtataagaatgcttgggatttttgcacaatgattttgtatcctgagactttgctgaagttgcttatcagcttaaggagattttgggctgagacgatggggttttctaaatgtacaatcatgtcatctgcaaacagggacaatttgacttcctcttttcctgattgagtaccctgtatttctttctcctgcctaattgccctggccagaacttccaacactatgttgaacaggagtggtgagagagggcatccctgtcttgtgccagttttcaaagagagtgcttccagtttttgtccattcagtatgatattgtctgtgggtttgtcataaatagctcttattatttttatatacatcccatcaataactagtttattgagagtttttagcatgaagggctcttgaattttgttgaaggccttttctgcatctgtggagataatcatgtggtttttgtctttcgttctgtttatatgatggattatgtttattgatttgagtgtgttgaactagccttgcatcgcagggatgaagccaacttcattgtggtggatatgctgctggattcagtttgccagtattttattgaggattttcaaatcgatgttcatcagggatattggtctaaaagtctctttttttgttgagtctctgccagcctttggtatcaggatgatgctggcctcataaaatgagttagggaggattccctctttttctattgattggaacattttcagaaggaatggtaccagctcctctttgtacctctggtagcattcggctgtgaatctgtctggtcctggactttttttggttggtaggctattaattattgcctcaatttcagagtctgttattggtctattcagagattcaacttcttcctggtttagtcttgggagggtgtatgtttccaggaatttatctatgtcttctagattttctagtttacttgcgtagaggtgtttatagtattctctggtggtagtttgtatgtctgtgggattggtggtgatatcccctttatcgttttttattgtgtctatttgattcttctctcttttcttctttattagtcttgctagcggtctatcaattttgttgatcttttcaaaaaaccagcttctggattcattgattttttgaagggttttttgtgtctctatctccttcagttctgctccgatcttagttatttcttgccttctgctaacttttgaatgtgtttgctcttgcttctctagttcttttaattgtgatgttagggtgtcaattttagttctttcctgctttctcttatgggcattgagtgctataaatttccttctacacactgctttaagtgtgtcccagagattctggtatgttatgtctttgttcttattggtttcgaccataatattttaaaatgtgtcttctttcttcctacatggaacttattaagatttctaattctgaggacttgcatgttttactaattctaaaagtttctcaatcattatctttttcatattggttctgactcattcactctgctctaattctggaaatgcagttggttctatgatagactattctttctagctgtacatctcttaacctgtttttcatatttttcatttcttatctccctctgttgttttctaggtaatttcttaaattttacaatatagattattaattttctattttgttatatgtattatactatttaattaaactacagtttctaattataacatttttcattactagaagttctccctcttattcagtttcaattattcctggtaaattttgatagtatactattttttagtcatatttcaatttcctcatttttcttctttaaacttattaaatgtgcttactatatgatcttatctgatgaaaccattattaacattctttcttattttgatactggaaccttttgttcacttttgtttttttgctggctatcactcacagtcattgatttgattgtttctttagagatttttaattgtgagttagttgaacatttttgtggatttatttgaggcctgaagttgaagtgagttctcaagagatacattttgtgttactccttttcttcactggaggaggtcatgattaactgggtaatcttaaaacttctttggcttgtgtttttggatgcacagatgttgcgaagtccagctgccaaccataaggtatgcgtaatataaataggtatttctaaagcagtttttaacagtcagggtttagtagaggaaataggaaatactttgtatttcaagcagtaaagaatataataaatggaactaggtgctcagaaaattattggaagtgccgaagaagtggaaatcagggggcatgcctagactttcaaaatcaccccatcatggttacgatacagaggtcctgaataacttttgttattgccccaccactgggctgctacagataccttatcctcaagaagctagtttctagacatttaaacatggactgcagttgctgcaaatattcctggtgcttgtgtgaacgttgcatctgccacaggaagagtgcttcatttctgccttctatacctggtataaattgacacacaggaccatggcttccagagaatctaaaaattgagcttttagattctccaatagagaatagaaggagagtaaacttctccaatagaaggggagtaaactgaatgttgagagagccaatccaattattcatcactttttttttttcctttttcttctatgtgaaggcaagatagggagacaggcatgtgtacccgccactttatctattgtttgtattacacctcatgcttctttatatgcttttgatcccagctattttcttctgttctgtcctaagcagttaaatctctaggattgacccaaggaagtcactggctttatcattcagttacccttacgaacttgacttttcctatccaatacagattttctgaaatccctttatgtttcatcaggctcaactgtgtatatagaagatgttttaaaatactggatctggtagttttacttatgatatacagaatgggtttctatcacatctgtttgctaaatgtacaactatgtcttaaggacatttttttctttttatattttttgatatcttaatggccagtacttcttagtctcctttgctaattcctcttcttcccagctgctaagtgttggaatttcctaggaaccagtcttcaggcctcttctcttatgtatttatattcttttcctaaatggtcttattcagtatggttttttaaatgtcatctttatatgctggtgacttccaaattaatatattcaagttagacctttcccttttgctccagatcatttatacaaagactgcatgatattccttcctagaagtttataaaacatttcaaacagacattaaaggtccaaaatataaattttactttctccaacctacccacaatggattttccctcagtctttttcacctcagtcaacaatacagtaatgtgttcagttagtcatacaaaaccctaaaaattatcttattctcttttcaggctgtctagtatccaatccaggaacaaatcctgtcagttctatcttaagtagaatcatttctcaagactctcccttgtatagtcagtatacaagactattgtatatatatacaatggaatacattcagccataaaaaagaatgaattaatgtcttttgcagcaacatggatggaactgtaggccattgtcttaagtgaaacaactcagacacagaaatataaatactgcatgttctcacttataagtgggagctgaataatgtgtacacatggacatagtgtggaaaggtagaaaatggagactggaagggtgggggtcaagtggggggatgatgagaaattccttaatgggtacaatgtacattgttctggtggtggtagatatgcaaaaggccctgactttactactgcacaatatatttatgtaataaaattacacttgtaccccataaatttatataaatagacgtgcccactatcatactagtctcaaccaccatcatctcatacctgtgcttcaataataggttaatagaaatccaagtaggtgactgaagaaaactaactagtttctcctctactgtcctcctttaaaacgtgtcctggccgggcgcagtggctcacacctgtaatcccagcactttcgcgccactgcactccagcctgggtgaacgagcaagactccgtctcaaaaacaaaaacaaaaaaaaaacaaaaaacatgtcctttagcaagcaatatgcacttttaaagatgtaaatgagataatgccacttatgagctaaaacctccaatgtctttccaccttatttagaatgaactacaaactctttatgtgatctgcccctgtttatctctgcagcatatcagtgatatattttgaatttacccctttgcatgccccattctagctgcactgacattattttcattgtatgaaaaagaaagtccatttcatctgggatactctttccccagttctttgattttcccactccagtactttattctgatcctaaacaaatgtcatcttttaggggcatttccttataacactatctaaaataaccactcttgcacagctacctaatatcttatacatatgagtcctttatgacatttatcacaatctaaagctattacatatttgttttcttttgtattatctacattttcaaatttattccaaatttcatgagaacaaagttttggttttattttatttacctttatggcctatatatatgttgattaagtgcatggatggatggatggatggttggatggatggatggatggatggatggatggatggatggatagacaaatgatactcaggtggagctgctcaggatcagtaggttatgtgggaataatgtatatcaggatatatacaggattacagatttgaaaggcatgaattcatcaatcattcattggactggatgaaatcgtccagggatagcacagcaaggataaaactctagagaaggccgatacttattttatgctttctaaagataaaaccatgttgaatttttttcttgctgcagttttagtacctactatagtccttcatataggagatgttcaatcaatttgacttatttaataaatgaattaaaaattggaaagaatatcccaccaaagggaatatgaagcatcaattagagacttaagaggagagctaaggaagtatgagttagttgaaactagaagataaaggggtttcaagaaggaagaactagtcaggaatctgaaaaactacagaagagtcaaataagataatgtctcaatacaattcattacacatatcaagaaaactggaggcattgacattatgactattagaagacatttgtcgctatactaaatattaatacattgaatttatatcagtaaacacccttagtctatagtatttaaatgctcccttcattgcatgctggcatttcctagttttgaagaatgtctctatgtttttgatatctgttaataataatatgtctaagattcttctttagattcaagatctgagtcatgttatcaatacattaggtcatgctatcatgaaagaaaactaataatagtttctcaagatcctaattaaacatttggaaagatagtatgaaataactatttggaaactaataaagagatgactctgttattactgaatatcaaaggatggcaaatttgtgaataagtccccagatttgtctgcaacagtcacagtaaaaatttagaattaacaacagttaaatctcaagaggataccacattaagtgcaactgttaaatattttctcaaggacacagaccttaacagaaaatggtggctactaaaagctgactactatgcaaatatcttggcaagacattgggtatctgagtcccctacaggacacagctgtgataatctttacaaacgtaggattctgctagggataggaaaagagccaggctcactggagacttattgcgaaaaaaaaaaaaattgtactttttgtgcagcttctgctctctgaataatctgattacatctccagggcaatttatatggatcactaaactggccataaaatattataaaattataacctattattagttctgttcctttactcatataaacatttattacaggtaaaatacctggtggttgtgttagacccagataatactaatatttaatcgcattaggtttaagaagaacaaacaaaagtgctttctcctgctcctttatattcaggcttgaaatatcatttaaaataacatagtagtgcatgtgattctgtttaaggggaggttcacaaaaccctatctctcctagttctgatatcaaagttagggagtgaggtggaagacccttatttctccagaaataagagaagaatcaggagttaggagactccatctctgcttcagatctgtccatcccatcacatgggtgattaccaggcaaggttcttcagtgtccttagattggagagagaatatctgcactgattatatatttagttaattgctacatacatgtattgaaagaaatattttcatttcttcattaaaacatatattttatttagtatttgttttaacacatattaatttttaaagtaatgccagcttattataaatatcaaataaaatagaaatttacaaaataaaaaccaagagtcctacctcagttctaccctactcttcaacgctactctccctggatcactactgtgaatgggatgcactttgtcttccatatatctgtttagatgagtctgtatacacacaattccatgcaaacctataggaaggccatttactccatatagacaaccctgtcagaagaatctttcacaccttctctttcttttcaagtatatttcttctcaaatcttctaatctattccccttctctgaggtgttgattggaagaggatccagacaaggtagtgatagattacagaacacagcagctggggccattggtgattttgctccctgaagtcagattactgaaaggcacattctcatagctgtctccctactcttgtctcttttcagtaggagtagccagaaaaattatcttaaaaagtatatcagatcatttgtcttctctgttcaaaactctccaaaatctcatttcattggcaacaaaaacaaaaataatacaacagcctcagtgcctgctgctatctaaccccccccccatttcactcattatctctccagtattatatcctctgcttcccccttttccacttcattctggagactccagagacactatgttccttgaatatttctctctgagaaaatagacacaatcacaaaaacaattgttttattctctctgcttgggagttattctctctgcttgggaaattcttctcccgtatatagccatggctcatttcctgacctctttcaagtctttgctcaattattacattcttggtaacgtggacccagacctctactcctcattcaaaacagcaatcatggcctcaacactcctgataccacaacctgattctttctttttgtaacattgatcacatacaagataggtagtatatattgtacctttgtacatatttgttatgtgtattatctggcattctccaccagaatataatctccaaaagtatatgattttaatcagcacagccctagagcctagaagagtggctagcaatagcagccattcaacaaacatttgtagaataaatgaatgaatacatacacatatataggagttaatatagcaaaatgcattagtgtgcaggaactagagtcagactggtagactctatcaattatcagctgtaaatataaataataattgatccataagtatctaaaacatactttacagggttcttaaaagggttcagttagcaattaggtaatagttgtaaagagacacaagttatttttttctggtcagttcttcctctttatggaactgttcttcttttccccctagctattagtttctataaaattgtcatgttcttactctctaatagctttcattttattcagagtcagagctcgatacttacaagagccccttcagggtgaaagctaattggtctacatatagcatctaacttaaactgagaaatataagacttgcctgaaattttgaacttcagaacacagaatgtattgccaacccacttcaacgatagtaactataagaagtacaactcaagtggaatcgctgtcttgtttctgaacacatggacaaaatttgacttacagaagaaagacaattaggcccactcaaagataagagaagttaaaagccagaaaaagagtgtgtgtgtgtgtgcgtgtgtgtgtgtgtgtgtgtgtgtgtgtgtgtgagagagagagagagagagagagagaactgggaatgtttgcattcctacttccagttggttctaagtcctagctgcatcctgtcatacatatgtgtaagtcatttaatcccctttctgtatccacgcagccaataaattgctcttcttttttccaaagaattttaagttgtttctattacttacaaccagaggagtctaatatataccacatgttttgctaggattaataatattaaaattaaggcagtaatagggattatgtattccctgtagtatctacaagagagctgttcataaagaaatttgttataatgttatattagcaaaagacattccaataatatgtcacattgttttaagacatgccaggagatataaattagttaagaggcataggaatatgttcttgggtacagactctttccacaccatcctttgagaactgcctctctacgttacccagaaagctatagctttcttgttttcttggacctaggggctaaaactaaaactcctaatgagacgcctttctttatgcagccttttcttctccccaggtaattaatcacatgctcttcagaaggctttgcttgaaacagtccctttttgatgtgctgcgatcaccaccagtcataactaaatgtaatagcaatttctccaaccatactggctttgataaaacatgctttattcctagaagattaggccattcattcatcatgtatttgatgataataataatgataatgatctgttgactgttagcttctgggtgctctaagccttttttagcttttaacacaaattacaggtaggcctcccagccacctgtccctttaggaaagtaaacagctctctagaaagccttctgatatgtttttttaactcattctagagtagcactttttaaactttaatgtgcagttgaattgctccaggatcttgtaaaatgcacatctgatttagaaggtatagaatgaagcttgagatactacaaccctacatactaggtgatgttgatgctgctggtctatagactgcacttttgattaacaagttccaaaggatttattatgtactggtcctgttcagtgctctaatgtaatgtcaaagttccataaacttttcagtgtgtctctcctttacaaacagtaacttcccaccatacatttttttaaaatcacatgtggcaaattcaaaacctttttcttgtcttccccttctgagaactgaaacaaagaacccctgtcatacaggcatggttcttataccactactagtatcctttgtaaagacaatacttaaatatccactgggatgagcaaatcaaaccatttcctcatgtgtggttgtaaaggcatagaagagtttattttcattgtgcattatctttcagacttaacttagatcttattattcacctggaaaatggaaaacacttgcaaagaaacatccctggcttctctgtttttgcacttttatattttatttctcctaatctgaaagtttacttatgagtcaataaagtttcttctttttatcttgtatttaagtcttatacaaggagaacctaaaaaaaaatgttattcactgatccagtaacttaataataatagcatcatttcttgtgggggaaaatttacctttttcagttttgaagtgccatccccagacagtgatagctagtacaatagatgcagttcccttgtttgtcatagactctactggaataagagataatcaaaggatatactttcttttaatgtggacatattgccacataatgtctttgccctagggaattcatagcaagatgtagaaagtagctcttctaggtcactttgattccagtccaagttgcttgtgattaatactgctaacatcaacagctgctctagtactaatgtgaaatacagaatggtttcagtctagttcactgtagacaagttcccacagcatgcaaattattaatgcccttgtagacagtgttaggactctaaatcgttttgaaactgaatgccagacctccctagagatgaaccctatgacaataagtcagcttcactggagacttactgtgaaaaaaaaaccgtcgcactttttgtgcagcatctgctctctaaataatatgattagacctctaggacaatttatatggatcactaaactagccataaaatattatgaaattatgatgtgttattagttctgtccctttacccatataaacatttattacaagaaaaggatctggtggttatattggaccctgataatgctaacatgtaatagcattgggtttaagaagaacaaacaaaagtgcttgcccctgaagaaagcagtacagttttagtcaaaatcatgacctattaaaatttctggtcttgggaggctgaggcaggcagatcacctgaggtgaggagttcaacactagcctgaccaacatggagaaaccccatctcaactaaaaatacaaaaaaattagccgggcgtggtggtgcatgcctgtaatcccggctactcgggaggctaaggcaggagaatcgcttgaacccgggaggcagaggttgcggtgagctgagatcacgccattgcattccagcctgggcaacaagagcaaaactccgtctcaaaaagaaaaaaaaaaagaatttctggtctttagctgctgtttttcataaacaatcaatcatgttaagttttttctaatgtagctatgtactaatatactaatttaattggtgatagcaaaacatctctatcattttaatatgtcaatactcacatttgcaaacaatatgtatatagttgatgtcattcactagatttaactgtgtgacgcagtgatttataactaatacttaattagcaatacccataatttaaaaattttgtgtgatattcacatatttcaatgaaaaggaatctctctgacactttaggcaactcagaggtaaagtcaatgatctaataacaggaagatggacttttgcccatactgtagtgagaggtaattgtgtcttttctgagttctttatacttccggtgtgcggtgggaagaaagagttaaacacctgtctaggcacccttgattacacacacccaaattgaagagactggattatctttgtactagatagaatatgttgtcatttggtaattttacagatcctaacaacatgttttatattgtcttaagcacacttatttgggcacaggcaatacaaacctagcataaaaataccaaccaacagtaacaacaataacaactaaactttgtgcctactcccaatgaaacagaaaataatttgaatatttcaaattttaagtttttaaaaattagcaacatgtgttttgcttcttgttttttctctctctctttctttcttctttcttttttttttttgagacagggtctcactctgtcattcagcattcaggctgcagtgcagtggcatgacaatcagggctcaccacagcctccacctcctgggctcaagggatcctctcacctcagcctcctgaatagctgggactacaggcacactatcatattcggctagtttttttgtagagacagggtttcaccaagttttctaggctggtcttaaactgggctcaagcgatctgctcacattggcctcccaaagtgctgggattataggcgtgagccaccacacctgtccttcctttcttatcaaagtaattttttctctaaaacatttcaaaaatatagacaattacaaaaaataatataacacatatctatatatttgccaccaagtttaaacagctattaacatttgccatatttgccttaatgaaaataaaattgtagatacataaaagcgtatatctgtcccttctcctctctttctttacagaataagttggtgtaaataatttctgtgcagtcttttgaactgtattccttttgtatacccccaaatttataccattattatattctatattttaagaatttatagcaatgatattctatgtttttaaatatttctttttttctttcaacatattttttatgctaatgtaggtagctctatttcagtcatgtttactgctatatgacatttcactggaagaataagccacataaatcacagctttctggtaatgtggttctacaacgaatatctaggttatttaggttttttcccactaaaacaagcaatgcttcatcaaacatcatggtatatatgctctcaggtatatgtgtgggatattctctaggataaatgcctataagtgtagctactgatacagggtatgagcatctgcaaattccctaggtgttgacaattgctccccaaggtgatgtgccaattgtcactctcaacagtagcatgtaagtccctattttgcctcattctaaatagctcctggtattgtccaagaaaaaaagggtgattgtaaatgacatcatatttgttttactttccccctgaaatatcagtgaaggttttgtgtatcatttatattacattaacccttactgttgatttttcatatcaaagtccagttttctatttctttgtttggttctttatttttatttatagttgtttctatattttaatattgattattttcaattaaataaattttaactttagtgtaaatattttgtaaaagatgtggcatccaaaaattattgaagcaattcaaatctttacttatcccttgtggggagaagtttcttaagtaattatttcagtttatattactagtacttttcatgtatctcagtattaagtgttaagccacaattcttgtaattttataacattccatagagaagtaaataaatataggaaagaggatttacttatgttgcctgagataaacacgaagaaagtaaataattttttttcttgataatttgatggatttttagggttttatttttaaacattttgaaaggttgaattttactgtacttgcaggccaagaaattaaccttccgcagtttcataaataatgccaagagacatgagattcctgtctaaggaagtggcacaagtttcatgtttgcttcagctcccctgccccactcccatcaccaccaggaggtgacacagaggacctcactgaggtgacacagaggagcccacatgaatgttgaacacatcacagatttgcattatcgctgaggaaccccagccttagacaaccccaatcttttataataagcaggaggaatgactgctctttgcttcgaagggagacactatctttattatattggatagcaagcaaacctgttctttgctttgaagggaggcattatctctatcttccaagatcttctctatataagcatccttgaaaagctggtcataaacaaaaaagtagttatggcctctgctcacaagatatacagaaatatgagagaccaatgaagactaatctctcaaaacttgtggccggacaaataaaaatgtttatatgagtaaatttaaacgtttgctttacattgaattttgtaaattacatgcaaactttttaaaactaaagctttccattcaaactagtatttgtacatttttcaaaaataatttaaaaagggcttgaaatacaccctttgccttccctagtccctgctccaccctttgccttccctagtccctctcctcagaagtaaacactttgaactcttaggttttagttttctgatttgttatctctaacaatgtgctggtaaattaacagctggctctccaggtttagtcccaataacaatgttggttgatatattttgtttatataagatacaaattaaatgatgaagtatatgtctaaatttgaccattcatcagtgatgtgaatttttttttgctacaatacataacagtttttgaacaggaagcatattttctcatttttttggtgctatttatattttagtggccacacaaatcacacagttttaaatggaatcaccgttattgacagtttctccatgactttcctaaatccaatcaacaaagcaatatatcaagcccttatatgcggtgcaggatgatctctgtggtgtaaatgttctcgattacaagtcgccaatttgccatagcgaagcatgcagttgggaggggacgtgcagtagcattccattgcatagcatgctgccatatggatgcaataggtgtgaatcattctcaagaatgtagataacagtaaaaggtagtaaagtaatttggaagtgacaagtttgaatataatttttataatataaattttgtatttataaagttttacagtttgatttttagtcatggctatgtttattaaccagctcacaaaacttctgaaaatttaacatttggatcttgtgagcttgttcaagctggctctatcacaccactgactacctccataccttaaaccagtatgcaaaccactactttttgatttatcagttctatacattatcttctgatttcctgcaataatgaaaatttggctcatttatgttattttttctctccctgtagtagcctgtgtccaatatgacccccaaagagccttttttcctggtattcagctctttgtgaaggctcctccctcacaaaatgactgatctgtgtaaccaataggaaacaattgtatgtgactttaggatgaaagagtcattgtgatttcggcctgactttcttgaatcacttgctttagaggaagctagctaccaagttgtgagaacaccaagcagccatacagacaggtccatgtggtgagggtctgaggccttctgccaacaaacagagctcctacctattctggaggcattgcttcatgttattagcatttattgttgctaacaagaccactaatgccaacctgattcttatttctgtgtcagtgactgttatgggttgaattgtgtctcctccaaaaaagatatcttgaagtcctaacaactggtatttcaaaatgtgactttatttggaaatagtgtccattcatatcttaactaattacattaaaatgaggtcacactggaaaggatgggccagtaatctaatatgactggtgtccttgtaagaaggacccactgacgacagagacacacagggaggatttcttgtgatgaagaaggtagggattggagttatgtagctgcaagccgagaatgccaaagtttgccagccaaccaccaaaagctaggaagaggcaagaaagggttcccctgcaggtttcagagggaatatggccctgaccataccttgcttatggatttccctccagaactgtgtgacaataaatttctgttttaagccacccagtatgtggtactttgttataacagccctaggaaacaaatatagtgaccttgtttctttctctcaggaaaaaatttttctttatctgtattagctcattttcatacagctataaagaactgcctgagactgggtaatttctaaagggaagaggtgtaattgactcacagttcagcatggctggggaggcctcaggaaacacaatcatggtggaaggcgaaggggaagcaaggcaccttcttcacaaggtggcaggaagaagtgctgagccaagggggaaaaaacccttataaaacactcagatcttgtgagatctcactcactatcacaagaagagcattggggaaaccgcccccatgattcagttacctccacctggcctttcccttgacaagtggggattatgggtattatggggattataattctgatgagatttgggtgggaacacaaagcctaaccacatcacctatttatcttttgttgtttgcagtttcccaaaggtgtgtctaactgcaattttcctttttgatttttttgtgccttgtgctgtgtaactagtatattctagcacatgaaaacttttaaattctggaaaattctatgacataatttgataacttcaacccattatctcctctcttttttttttttttttttaactttctgtagaaaaatgttgaagctcctaaattggcccactatgccccttttctgtctgtctttctttttcttaaagttcttttttgtcattctaggctattacttttttaaaattttgttaatcatttaaaatttctttgggttcctgctgttttatttctttttaattttcagatgttcattttaatcttacctttagggagccatatatacttgaatctctctgaagtgctaattagaaggggaggagtttttttggttgttttgtgtaagtgtattctggtttctagattattttcagtttttggttccttctttgattttaagttgctctttttctcaaatgtctgatgacactagttcctctttaaagtgatgcactacacactgttctctgatatttctatgggtttactgactggtggagaggtaagaggtccactattaagctggagtcacctaatgtcccgaagatgaaagagtttgtcttaggagcagtaacatttatacctagagctctcagagggctttctctttggagggaaaattgaatggtaaatacctggcagcaacatggggaaagagatgggagtcttaactgcccatatagattttcatttaatactccagtgcttaggcccatcttttacttgtacccttctttatgcctggcatttccaaggcccaagactctccttgggcttctcagagtatattgtgggtctatctaatttattctgttttgtattcttgcaacaattttaacagaatctcaatagggaaagtagataaacagcggtttaaaatcttgaaccagatatacagaaatctttcttttttcaaagcacattttaattcagtttatttaaatgataaaaacatatccataaaggcataacatatataatttaaaatttctatagtaaacaagataaaaggtccaaaatttcggtagatactacatatgaccaaatgtaaaacagcatgtcttccattttgcttatttctaaaacttttttttcccctttaaacaattgtaatttgtagcctcttagtccttctactatttttttttttctttgagacagagtctcactctgtcacccaggctggagcgcagtggtgcaattttggctccctgcaacctccacctcctgggtacaagcaactctcaggcatcagccttgagtagctgggattacaggtgcccgccaccacgcccggctcatttttgtatttttggtagagatggggttttgccatgttggccagggtgatctcgaactcctggcctcaagtgatccacccattctcagcctgccaaactgctaggattataggcgtgagccactgttcccaacctttagtaatggtttttatgtgtacatcttcttatttgtgatttcatcctgaaactcaacatgacatgacataaagtggagtagaccaatggccacaggctgggaaagtcctggatttgcctaggagttgtgggatttggggcaaggtatttcagctttcagaaccttgagtttctctatcatgaagtgagatattgaactgggtgaaatattatgttcttatcagactttgtgattctgtggtttaaatagaaatattttattcttctaaatatatttttgcaaaaattttaagtgtaatttttgccatagaatagaacaaaggattttatccagatctactctcttatcttctgaattattatctgaatcttctctccttctattccactattatcttggtccaagctatgcaatattgtatcctacccctctataatccatctctgtatagcactgtgagatagcatcttatactgcaaatcaaatgatatcactctactactaaaaactcttcggtgatagcagtaataaagtccaactccttaccaacacctgtaagtccatgtaagtccaacacctataagtccatgatctagaccctgcctaattttccatccttagccctttgcactagctaaatttgctaaaaccaccatggtcatttttttcttccctcatatatgccaacttttcctgtccctgctgtctttctgccaagactgctctctcttctgcatttcccagggctatgtatttcccagggctagtttcttcagaacttcgcttaaaatccatttcctcatttaaaaagagaaaaaaaaacttattattatcattccccctcctaaatccatggtttccttaatcatactcttcacaatttgtaatgatttgttactttggtgagggcaagaaacaagtttttcattgatcactttatcccttgtgcctggtatcatttctgggacaaaacaagtgtgtgataaataattgatgaaagaggaataggcactaaaatgaatgatttgtatataaaacctagtattaaaatgaattttattttaggaaaagtgataactggttatgcagagcaaaatcaactatggtgcaaagaaataaagaaaaacaaattgcaaattattatgtttccttcttaacttgtgtatttttttattcaaactgcattaaattaggcctgcttattttcagattttttcaggctgaccttgcttgaaattggaagcatttttagaataatttatgcatcaagaaaagggtataatgctttagtgatgcaaggcccccgagggcagagtatcaagtaaaatattcatgaagcttaagtgcaagagacatcagattttctgtagtattttaacactgcatttctgtacaagggaattgtaaagtgcaagaatatgagagaagataaatattgaggacaataaagagggcctgtaaagtgagttcttgcctttccgattttacagctattattctcccaagtgtgaggtgactgtgtgtgtgtgtgtgtgtgtgtgtgtgtgtgtgtgtgtattgggtcatattagaagttattagaagttcccttataataattataaaattaagaaataatataattggctatgtgggttaccatctgattttcattcacatctgactatttgaattgggatgtgttttctttaattattttgtatgaaaaagaaaagatggggcatagtgtcatagtagttgcatacgttttgtaagaaatttcaagttctcccagatgaaagataacctttgtttttcaacttgttttccactttcaactgtacgcttcataagacattcattatttcccaagatgttcaaaaaagatacagtgaaagggcattgggaaatatttaatatgcaataatctttagagtccttcattttgaaaatggtctctaaaagttaaattagtgataacataaaaagaaatctttccatgtaaatttgtctacaggtatttatttatctttctgatgtcattgattcctttgttctgattattcatcaaaaaaatttttttaaatgtttggtagatttggggaatcaaatattatgttaaagatagaaagctctacctcatcttgaagactttggagaggatgctgatctctgacctgtggctaaccgtcagattttaggtcatcgtgcaacatacaaaatattagattatagaatgtgtaagcttagaaattagaaattagtgcagtctacaatatcttcattttgtaatattcttgaacatttaatctgtttagaatataatggtctattagtatctcagattaataacatcttgcttcattatctttctttttgaaatgtttagaccacatttttctttcagagcagtagccataacattgtctgaaatttcaaatgaagacctttccaaagtaatagttataagtaaattacacagtcctccttgatgcatggagaagccttataattgttccaagtaaattcagaagtaataggtaataggaaggttatattcaccctgatagcccttacaagactggtcatcaacattcagaaccatgttaattgccaacactgtcatgaatggggtatttatatacctaattttgctgcatggccaaagattccataaaaataagactttatggaggtagacatgactggaacatagaaaccatagcataattaagcagaaaattccaattacataacatttatgtatttatttatgattcctcaactgtggccatgggtggcttctttttcttttttcccccctcagctttattaaggtaaaattgacaaataaaaattgtatgtattcacagtatacaaggcaatgttttgatatatgtacctattgtgaaatgattaaatcaagctaattaacatctattgttgcacatacttatattttgtgagagcattggagagcttaaatcagcaatttctaatttttgcaatatattaaatatatattttatattgtatatatttaatatatttacagtatatttttataatatattattattaactatagtcatattatacagtagatctcttgaacttattcatcctgcctaagtaaaactgtatcttttaaccagtatctccccatttccaccgccagccttctctagctcctggcaaccagcattttaccctctacttgtatgaatttgatatcttttagattccacatataagtgagatcatgtagtatttgtctttctatgcctagcttatttcacttagcaaaagttcctccagttttatccatgttatcaaaaatgacagcatttccttctttttaaaggctgagttgtattctagtgtgtgtgtgtgtgtgtgtgtgtgtgtgtgtgtgtgtagctcacattttcttcattcaatcatctgtcaatgaacacttaggttggctgattccgtatcttggctattgtaaataatgctgctgtgaacacaaaagtgcaaatatctctttaacatactgattttatttcttttgtatatatactcagaagtaggattgctggatcacatggtagtccaatttttaattttttggggaaactttttattgttttctataatagctatactaatttaaatttccactaacagtctataagcattcccttttgtccacattctcaccaatacttgttatctttagtagtagccactctctctggtgcaaagtgatgtatcactgtggttttaatttgcattccctgaatattaatgatgttgagcgttttttcatacccctgttggccatttgcatgtcatcttctgagaaatgtatattcaggtcatttgcccatttttcaatcagtttatttgttttcttgctattgagttgttcaagtttcttatatattttggatattaatagtttgtacggtttgcaagtatttttttcccattctgtaggttgtctcttcactgtgttgattgtttcccttgcttgaggaagctttttggtttgatgtaatcccatttgtctgttttgttgccgttacctgtgcttttgtggttacagcccaaaaaaaatccttgcccagatcaatgtcaagaagccttaattctatgttttcttctagtagttttatagtttcagatcttatgtttaggtcttaaatccaatttgagttgatttttatttttagtgtgagataaggattcaatttcattcatctgcatgtggatattcagttttcccaatgcacatttattgaagagattgtccttttcccattttgtgtacttggcaactttttaaaaaaatcagtgactgtatatgcatggatttttttctaggctatttcttctgaccccttagtctatatgtatgtttttatgccaacaccatgctgttttaattgctatagctttgtagtatatatcaaaatcaggtactgtgattcccccagctattttttgccaaagattgctttgactatttgggtattttaggtctccatgcaaattttaggattatttttcttttttctgtagttaccttgaattaaaattagtagtttgatttcaaatgtgaaacttgtgacttttttatttatggcaacagatttttacaattatataatgaaaagcaaagagaaaattatatttgaggtcgaaattcctattactattacatttttagaaatgcctcatggttatatatgtgtgtggaaatgagaacaaataggactggaagctttgacttcctgctccctcttcagcacaatactccaaaacagcatttcctcctttctctctcacaattcatcttcttttcccccttctctgatcttgctacatttttatttttattttttgttccacactgattgtagcccaaaggtgataaatttgtgtggactaagtgcaagaggagattggggaaaatttgtttcattgttgtgtcattaaactcagttttcccaccaaagcctgttctaataatttaatggccatgaaaattggttcttttttagagtaaaatatctttcctggctcatttgaaagttgccacattcaatgttgcatttttatctgaaattcggaaataactgaactttcctaagcgaatctcatctcaacagatttttagtataatatcaatgtcagagagatttgaatagactggattaagaaagccttgggtaaatgttagaatattacaaacctgtcatacctctttattattctgtttaataattcataaataggagtcctgctaagttttgataaataatatccctgtagggagcttactgagctgtcattggtatgcttgccttccaattttcctgccctgctcctatcagagaccatcttcagggttagtggtaacctagcagcatctttcggtctttccttgcctcaccactgcggcgcggagctccctggagtggaactggctttgcagacccttcaccagcctccactcagctttcactctcactttctgcttgctttcacaccaggagtgggatctaactctcacactaccatgggaagctgaatttatgttgtactatttcagaataaatttcaagttgttaaaaaaaattaataacttttgaagtacttaaatattatcatttaggcatttttgctaatttttcttggtgtttggcaatcaaccaccaggattaataatctgatacacttttttccttcaaacacatttaatttgtaagtacatcaaaacataattttattacaccttttaaagtttcatgtctttattagtaagtataaaatagttgttgcaaaaataaaaaatataggaacagatgatatgtcatacttttattttagacttggagaaaaagcagagatttcctataagtggtagttgagaaaaaattattccttatatgattttcatcatagtgtttgacgttacacttaaacactacactaagataatagtaatcataacactctattaagtctactgtatgccagttattcatataagcgctttccatatatttgctaatgtattacttagttaacaaccctgtaaggtaattactatttgttatctcattctacatatggggaaactgaggtacaatatatttgtgacttgtttaaggtcatcaagttagtaaaagtagctagattcagtcccaggcagttgcactccagagtacgcaacttaaacactaccttatactgcatctctgttgaaaaaaatgaaagctggttgctgcattgaacaatatcaaaaatttattatttggagaaattttctaatatctgtgtctctaaaatatgggtcagtgacgtttttggggagcaaagttcttggagatttaacatgtcatgataaatctgggtctttatatacttgtgaaatgtttcaatccataaaccagaaaattggatacttactttgattaacatttctgtaatggcacaaagatttgctaagaaagcatctttgaagactggcattttggctgtattgatgcataaaattttctaaccatatatctactatattgcttatcttatttaagtaaaactattccaaaagttattttatataacacaaggtcaaactatgctgacaaaaatcattactcacttcatacacatgttattgaaggtaatatctgtttaattctattctatatcctaagcattttgcaaaacacatagcaatgtatatttgaacccaagctgaaagtgaaacatcagtttataaagatgagcttcctcaaatttgtatgtcataattacatattagaagtgcaatgaagtacaaataaaatgaataatttatagttagtgtcaatgcagttaatgaaaatgtccgaagcaaagtgtttaaatcataactaatcctgcggggctcatggccttcacctatgctttagaaaatggataaatgccatctcctggaatggcctccttggaaattattctttggaagatgaggccccagactgtgctggggttacctctagaatttgggggacattggcactcatagactgcttcccacagaggaactggagcattcatcattctactggacctctgcttagcatattctgggtatatatcagcatgggtgcagaagaccaactacacgtagagggaaaacaatcaaataaaatataaaaagatgcttggttttataaagcagtaaatatagtcttctattcctagtatatgtttgcaaaaatattgttttaaaaatcagatctacatagaaagctgcacagaatggacaataatgggtactcagcagacccaggcagggcctgccttcttggctggctatttatttatttatttattagcttggatattcttctctcttgctgctgaaactgcctctaaaagcaaattccattcacatcttcgcttgatagatgcagtcagaatggcaggcgagaaagaactatcagagttcaaggagaatactaatgcctcttcatatatacaggcacattttcacatcatgtgaatattgtatgaagatgtcacaaattatatgttcacatgtacatatattatcattttcacatgaaaatgaaatatgtcttatctcacacaggagaaatgaaagtcaaatgcgtagtttgccatctactccattacttggggctttctataaaatgagctctctaaacctgtattttcaactgaataatctcaagaggtaacacaactgcatacttttttttcttttaccatccatgctgatacttgaatgaaatgattaataatttggctgtattttgaatattttctatatttcttttttctctctcattcatggaaattttcagaatattctcaaataaagaaagcatgctgaaaaaaagttacactagaatattgctccttctagccccatagaatttagcagagttttgcacataatagaaaagcaaaattttaaaaatggaagagtcatagtctcctaattgtattccttcattttacacaggagaaaatttaagcttatatatagtatatgactttgctaaaagtcaccttaatgtaaagtcacatattagagtgagcatccagctctcagtgttccagggcaggattatttctagtgcagttcttttttatttaaaaccgaaaacaaataaactaaaaaatcctaatggaacaataacaataaaaatgccttctctatgccttaaactcagataagtagacaaatattataccttaattatgataaaataaataaatgtaagaaaataatatgtgtgggatgggggtataaaatgatttatgtttctttaaaaatatgtgtggagttgatattcataatctgatatatggtgacttaacagaagaccaggtatcagtggcatgtgatacgcacatagtgtgctcagaacattttacatcttgtgcagaggaaggtagaaccattttgtttaaagaaaacccagaggattttagaaaattacctaaagactgctgagctgtcagcaaaaatttaaggcttccaggaaaagtctgtcatttatctgtaaaacacccatctaccactgcctgcagcataaaggacaaacttcttagcgttatccatgcaaccttcgttaatctttcccaacatgcccagttgcttttctccccaatcacttcaacagaacctatgctttagcagtcctcaagaacttttagttcctagaagataccattgcacatgtcattccttctgttggcaatatccttccaagacatcaatcatagatggttacagaagatattgcagagaatatgaagaattggaaacataatcaagtgcaaaatcagtaaacactattcaggagataagatgcagattgtgatccaagctttataattattttgtaggggaatcagcaaaaagcttgagaagtagatagtacaaggcagggagctattttttttaaaaaaaatccctccctgcctgtttgagtatcttctagttaacacatacatactagttgcagtcacataacatataatttaattttcataataaccctaagatataggggctaataagtcttttttgaagaccaggaagccaagtgtaaagcatcatacctagtaatcagcagaaccagacaccaaatcccagtcattgttgaaataattgtaaccttaaaaattatttaatgtttatcactgtattagtctgttctcatgctgctaataaagacatacccaagtctgggttatttataaaggaaagagttttaatggactcacagttctacatggctggggaggactcacaatcatggcagaaggcaaaggagaagcaaaggcacatcttacatggaggcaggcaagagagtgtgtgcaggggaactcccatttataaaaccatcagatcttatgagacttattcactaccacaagaacagtatgagataaactgccctcatgattcaatgttccacctgtccctgcccttgatatgtggggattattacaattaaaggtgagatttgggtggggacacagccaaaccgtatcaatcacatttttaaaacacaggtcatgcattcatgttaatacgtacaagtacttcaaaccttcttttcacagcaaatagttatttagttggtagagagttttatagaaaatttggctctgcatgcaaacagggcctcacagagtgacagcacacagacagttgttagaaaatcccagcatctgatccacagctttgcagattttatgattgaaattggtaataaaacaaaatggattagcctttgagactgatcaaggttattgacattcacaagtgtctgatatatacacttctgaattattcatttacatttacaattagaaatacaactatcaagcagaccagaaatgttatgggcattattctctacttgttctctttgtaggcaaatctacaaattacaatcagaactttgtttcatgaaaatggagttaagtcagtgataataggaagggcaactacaatgctccatgcattgtgctaagctgcatattgctaaactctatatttgcattattttatttagtttttataatgttattatgtgaatattttatagataaagaatgggagactcagagagtttaagtaatttgcctacatttacatagccaataaggattagagccagattttaaatctaaatttatttaacttcagagaaatagatcttaatcatgacccagtgctgcctaccaaacatgatataagctccttgaagtcagggagaatcataacaacattaacagctcccaatggaggagtgtctctcatatgccttacactttcattcatcctctatgactcactctaactctcatatcaaccctgttatatagatactcttatcatcattttacagaaaataagacagaagctcgaatatgaaatctaagcccatattgctgacaagtagcaagattagagagcacttaattcctgactttgaagcttgcagtcattctcttgctgtatgctataattccaagccaggcattctcatcagagggacaggtggagatcattgaatcataatcaaggttcattgttgtgaactttaaaatagttaataactatattcaaatattaactattttaaagttcaaagtttgaagaactctaaaatagtattatctattttaaaaaacctattaaagaaggaaaagtaccaggaaccctggaaaaattaatcttgttgccctgcaatcagagccagccaggaaaagaagcagtacacagagtcagaaacagctacatgtgaaaaatcacatagtattaactattttaaagttcataacaatccaatcagtgcaagtctataagtattcacatttcctagataggtaagcttagtgagaagttaaataatctgtccacagtctcacaactagcaagtggtgtccctgtaaaacagaccaggcagtctggctccaaagtcctacactctattgaatgatcttaataagaaatgacaactagttttatggcctgatgcattcaatttcattctagaaatatttatccatgggcaacagaatgtctccccaatacagagataagaaaaatgatgcaaagtaaatgtattcctaaagagcaagactatttttgtagttgtagttgttgttgttgttgtagaacatggtggggtacaatggagatgcttggaccaaagcttgactacctaccctaatttcagtcttgcctccttaagacttgatctctatcagtttgatggaatttgagtatgcataaaaaagatgtattgtggtcaacagaagcaatcaagaagggcagaaataaagcggagttgtgaagagctacatgtgcaagtcctgaaaatatcattgtgtctgggtgagattcaaaaagaaggagaacaaaaacagttccccaatgggatgtgctttagaaagccaggtgaggctgaagacatgactcaggcatccttgttgtaaaactggctttgaggtaacacatagtagtgagcgtggacttccatggttcatacataagaagattctgtggaaactagatattttaatcaattctaaacttaataggagagctgtcaccagatgtaacttctaccaaaagagaggaacctattaaagaaggaaaagtaccaggaaccctggaaaaattaatcatgtttccccgcagtcagagctagccaggaaaagtaacagtacacagaatcagaaacagctagatgtgaaaaatcacattacagaaagcttagagaaagaatggctaggagatcagataacaataaaatgaaaatgccacaaaagaaaagagaaactgtcaaaatggacttcagaccacacaatcacagatggtgctgataaagaagaaaatgggcatccaaagagatcagcacagcagcccaaggagctagcaataaatgtgagaacatggaaaatgatgaaagtagaggtatataagtaagaatgataatggaagaataatatagacacctaaaaaaattgacagtgagtttaaagcaagaatggagttgagaaaaattccaaaggtgttttaaaaatcatgcgtaatacaagaaagataataaaaagaggaaactctgctacttggggctgaggatgacatattaacaatggccaagggaaagcagtaggcactattttactccatttagcctcctccttagacagcaaagaagataatgttcacagtagcaagaaaatgagccccatgtataagagtaggcacctacaaactttgataacatccagtattattgtgaggacttgaaattgacattgttgaattatcgatggtttattcatgttattgaataaatgtacacacaagcacacacatgcacacacacacacacacacatatgccagacactgtattaagtaatttacaattattaacttattttatttttaaagcaactctacaaagttgatgatctttctaccattatggagaatagaaaatagatattaaatatgaggataacttttttcccaagatctacttgtccagtaacactaagccttttaaatgaggttctttggcataacttgttttcgttgaattcatgttgcatgaaagaatcttatttatttttcataatttcttataatttaaattgcactaatcagttgaataatcttatgctgtttagacattaaactgactaattattgagaaataaagattatgtcacagaagctaagaatgacagacttgtcaagctacagaaaggactaaatgtaagatgaaacaggaaagaagcaaatttttttgagggaaagaatcccataattctggtagaaaagattgagtgttccctgaggacaaagattatacattaccaatccctgtatcaccattatcgtatacagtgacagtgatttatagctcaaaaattaggacttttaaacacttaacgtgattttaaactacgctaaagtaggtataaagttcagattatttactcccctggggtggctcatccgtgtgtgtgtgtgtgtgtgtgtgtgtgtgtgtgtgtgtgtgtgtaatctttatgtatatgtaatatttatgtatatgtatatgtagtctttatgtatatgtaatatttatatatgaagatttatatatatattttataaataagatatatatatatatataatatatataaaatgttcaataaggcctgtaaagtgaccctagacatattgtgttgaagacctaaatgcctactagatatttttgcctggttgccccctgagtgtgtgaaactgagcttatttttaaatttcctccacaacttatttcttctagatattctacatttataaatcaggacaattattgtcattattattattatcatcaacatgtaaaaacctcaatgatttaatgcaagagaggtatatttcttgctcatgcttataaggctactctggggagagtgttttctcctctcctcaacattcttattcctggatccagactgtttccattacttactactgtggaacaaaccaccccaacacttggtggttttgacataacagtgctattatgacttcttatggttctgtgggaggaatgggctcagtgaggggggtttccactccatttgatgtctgctgggattgctgtcatctgacaccttggttgagctggattgtccaacattggtcacttgtgtgattggcagttaatactgaatgttgactgggggctccagtggggctgtctgctggacagccttcatggagtctgtttacgtggattgggtttctcacagcacagctgaagaatttgcagaggccatatctcaagagcaagtgttccaagagggaggaagtggaagatgccaatactctttaagactacacctgaaattggcacagcatcatttctgctatgtcctcttagttaagcaatcgatcttgtgattcacgaactggaaaaacaaactccacttctttatcaggagaagtaaaagaatgtgtggccacctttagtccatagactgaaaaaacagccactatctagaatttgcttgtaattttatcagtttaagaaagagagctctgcaggacctcgcatcagcaaaaaatatatttgccctgaaagtgacacattttacttcaactcacaattccttggccaaaattggtccaatacctacatgctaccacagaatgcaagaaagtatgatcctactacagatcttcagagaacagcaaaagaatgtaactccagtttgtctcttactctcaaaatccgctggtgccctcattaattattacccagaacatcacaaagactgacttgtctctcttcctctagctgagcttctttctaatttattttacaaacctgacccagaaagaaagaacactgtaaaatataaacattattgtttaaaaatcacataaaatcataaacatataaaacccgtataaatataaacttacctacttatcatctttcactaactcaccacatttgttgagcacctccaatgggtaagacactgtgctacttcttgccatcacaaattttacatttttaattttgtccctctgccattgttatcaagtatagaatacttaatatgattcataaagtatataaaaacaagggccctggcctagttctccagcttcattttaggataagcaattttatttcttgctgttcttgttaatttagcttagttcttttatgattatttttttctcaaagaataaatttttttttcaattattcattctactttaagaaccactaatttttggtgtctgcttttattaccatttgtttcatttatggaaaatgcttttatgatttttttctaagttactgaattgaatgcttacttcatgtatttttattctaactctcctaatcataaaggcatttataaaatgaattaaacagttatgaaaactttggctgcctctcatatttttatatgttgtagattcattctaattatgtacaaaattatttatagtagcattttattaaaacataacgtgtaaacaaaaaaagttgtacaagaaagacagaaatcactgaaattccatttctataactttgatacatattttttcatcagaatcagctatcttgttcatatttttgagtaatatggggtcaaacatttacattattttgcaattatttttatgtacaagcattttggaacagtttttatgacaacaaatatgtgtgtgctttgtgtgtctttttatttcttttatttctttataaggacaaatgactatttgtctctaaggtactaaggttgattttaattttttcactaatgaaaataatttggaatatctatatttaaattcttatatggcctgttttcaattttttttatgtttttatagctaggatttagggatcaaatgatatttaagtctgaaggtttttcatattaagtaatcattttccctcttacaggttataacaatttactctcccactaacaaaaaatgaaaatgtctcttttctcacctatcaaactatattatcctgctttttaatttttaccaaactgacaggttgaaaagtatgtacatttctttgattactaatgccactgattattttgccttagctaattatttatttcattatttatgcatatttttcttattaattcaagaggactccatgaattaaaaaataatttaattattaactccatgaattaaaaaatattctgtcatatatgttgaaaatatttattcccaattttttcatttttctttaaatttttcctatttttgggggaagttttgaatgttttatgttatcaaactattaattttcctttttatagtttctgctctggctgttatatttagaaaggtctttcttttggtttccaagtttattttatttatattgctacaaaatatttcattattttgcagcaatatagtttatattaaaatttatattgctacaaaatattgctacaaaatattttgttattttgcagcaatatagtttatattaaaatgtttttctttaaatatgtaaaggatcttgattatgtttgatgtaggtgtgaaataggaatccagctttattttatctgtcacaacttggttgttcaaaagtcactaattgagtaatccattccttcccacctttttgtataataaaaatttcattttgtgtttgtgctatatatattttgttttattgacctattttgatgcaaatcatataaagtttttactgcagaaactttgtgatatattctaattacaattttggtaaggtaaatccaatatatttttctttttcaaaatattattattcttttttattttaaaggagctttataattaatgatgtttacaaacaaagtctttaagatagtttcattggacttatcaaatttgtagatcaattttggagaaaaatggcatcttcaaagtatttcttcttctaatttagaaagaggacactaacctgggtattccagataggcaattatatcctcagtaagaaattatgtctttagttcctatattaaatgttttgtttttatcaagctttattagctattactttaaaaatattaattaacagtagcaaaaatgactcttttcttgttcctgattttaatgagaattgcttcagcataaaatgatcatttattttaaattggtacattttaataagttaagaaattgtacttctgtttttaagtactaattgttaaacaaataaacaaattgtatataccaaagagaacatagcatattggtaagcatccatggaacattgacctttatattagtaaatgaaataactgtaaatattctgaaattctgagcatgttagaaaatagataaatggggaaaattcacattatctgaccataatgcaataactctagaaactaataagagattttaaaaaagaaacaaaaaagtgctgataaaacatttaaataaaggtcttgaaattttaagaaaagattggattacattgtaccaaattctacttcagcatctacccagatttttcttctttgatctagtaatgaatcatatctggaacaaataagacttagttactacgttatttttaaaagtaatactgaattaagtctgctactactattaatacagttattttacataagggaggttaattttctgttttctgctatttttgtcaggttttgaagtctgtttttattggctgtatttaacaatgggaagaaagttaactgttgccatgataatgctgtgttctccatcactcaattagcagtttaagtaacaccatttattatttatcatgagtctatggttgatgggatgttctgctgaactggatcaggtttgactcacctcagctgggcttgctcatcatctgtggtcaactggcaagtcacctaagatagctgatctgggataccttcagctgagataattcatccctctttcaaatgtgtctctgacatccttctttccaacaggctagatcaggcacacatcctcacatgtcgtcaggggtccaataaagttaaaccatgcatgtgtcttttgaaacttgtttgcaattttttcattttttttttcatttgaaagtaatttttgtgagtacatagtaggtgtatatatttatggggtacatgagatgttttcatcacaggcatgcaatgtgaaatcagcacatcatggagaatgggatatcctttccctcaagcatttatcatttgagctacaaacaatccaatcacattcttagttattttaaaatatgcaatgaaattattattgattatattcaccctgttgtgttatcaaatagtaggtcttattcatttttttctgtagccattaaccatccccatctctagccacccgctactcttcccagcctctggtaaccatccttctctctctgtgactataagttcaattgttttgatttttagatcacaaataagtgagaacatgtgatgtttatctttctgcgcctggctcatttcattcaacataatgatctctgggcttggctatggtatttgcttagcaaatgaaacagtagctccaacatcatggatagcgctactgtttcatttgctaagcgaataccatagccaagcccagagtcagtaatgggaaggcagtaggcattacaaaagggcatagataaggaaggtgtaaaaaaaaaaaaaaaaaaaaaaaaaaaaaaaatggggtcaataatacaatcaagccaccatttgaagcatcacttcttttatattctctgcaatctcttaaataatataggaattatctgttccatattacctttgcaagtcttcttaaagtcttgacacgtaaatcttctttaaaaatagcttttaaaattcattaacagaatttcattcctagacatttcttaatgagacaacttctttatagctgcgataatattttatttctacagttgtttattttctactcttaactggtcttataagaaacttgttcattttaccaatgttttaaaagaatccgttcttggatttatttatattagtgttatgttcctttttttctaatgtattcatttcttccttttgccttttgcttttatgtattccattctctatcttgcgaaataatgtattctaacctttccagcttcttgaatggaatacttagttcatttattttaattttgttgtgctcaataatgatatttttaattacttgaatatttcatctgagatcaatttggctttaccccataggtctgatatgtagtgtcagtatttctattttctaaatatgtgagatatcctttttaaatgaatttatatggtgaaaatccttatttaaatattttatcagtagttttaaaaatatatatctgttattaatttctagtattgcattgtggtcagataatgtgaactttcctatttattttgtaacatgctcagaatttcaaaatatttacatgtgttttgttgcaaatataaggtcaatgtttcatcaatatttaagagcatgctatattctctttgggatatccaatttgttttataatttgtaattcaattatattatttatgatatttttcatatacttaatttttcacctgttatcagttatagatgattagtgccattttaaattttttttactccacatgcaattttgtctatattttttctgtacttctctttgtctatatttctttgtttttctttgtatttctaagattttcacattgtatatttgtgctgctttttttagtgtacaaagttttatcaaatgtacttttataacattttgcatattgaataatttttctccaaattctattttatctaatataaccattgctatactggcttcttttttcttttttcattacaataggtaacacttattgacatctatagtgggacatgcataattactaaatttttttacatgcaataattcatttagccctcaagagaaccttataaggtatgattatcatcccatttactgagggttacagttgagtgaagcagagggaatttatgtaagttgttcaaagtcacaaaactagtaagcaactgagctgaaatttgaacccaagctctctgtctccaaactgaggttttggcaactatagtctgttgcttctttataaatatgctgcttggtcttgtaagaagtaagctatttttctctcttgttaaatttgctcagtcttttcagggctgtatgaagtctacaaatgagcccatcaaaggctctttttaaatgttactgtgattattattattattattattattattattatttgtaggatttccatttgattctattagagcctatctctctgctgaaatttcctatctggtcatgcatgttgtccacctttttaatagagccttcactgtattaatcatgattctttaaaatatcctgtgttttgattccagcatatggattatatctgcatctagttcagtgattaatttatgtcctaatagtgggtgttattttcttgcttttttatgtgtcttataacatttgaatgaaagacagacactatgtaaggacagcagagactgaggtaaatagtattaatgtgtggaaacaggcatgcctctcctgctgctagtttttttttagattatattttattttaagttccaggaaacgtgcaggatgtgcaggttggttacataggtaaacgtgtgctatgcaggtttgctgcacctatcaacccatcacctaggtattaggccccatatgcattagctatttatcccgatgctttccttcccccttcccccaccccacaggccccagtgtgtgtttttattggagatgggctgttaaatcaatccagtcaacagtcaatcttgatttacactgctgttgcttgttacactcagtgcaccacaggtttccaatcttctagtgaaatcttatgcttaggttaggtgttgggtcactaaagagaatttgtaacttttctcgatactagattttcctgtgagcctgtgcctcagtgagtatattttttataccgttgcttctctctcaatggtagaatgccattacttgttattcacaccacttactagtctgcttgtgggtgtgtggggagttgttgccgggggacgggttgtggacagttcttaggcttaggcaggcagtgtgtccctggattggggatctggctttcttggtgatcctactcatcctcctcatggcagtcaaactttgtcttaaatgtttggcaggtctcatgcttgggggagattttaccccttttggaatggttgatttttttcttttaccctttacacagtttcattgagttttcacctgtttcctgagaaactatagcaaagctattaagctttgcttccccttccatagtgccttaaagcttttgttcaataagctatgtagggaagaaaaatctgggcaagggtttacccctttctcacaacagaaattgctcctcttctcaggcctgcaccactgagagaagttttctctgatctttcattctgcctccagtcttcgttgtaaacacatggtgaggtctgtgaaagatagcctgcaagttgggtggaaattgcctttgtgcctgtgaatcccagtagttctctactcttatgagtgtactcttacaccatatactatcatgcaagctctatactcatgcaagctcatacttggattaggcaatttattttaaaaattaaaatttccttacctgcagcggggcacggtggctcacacctgtgatcccagcactttgacaggctgaggcaggttgattgtttgaggccaggagttcgggatcagcctggccaacatggtgaaaccctatctctactaaaaatacaaaaattatctgggcatggtggtgcatgtctgtaatctcaggtactcaggaggctgaggcagaagaatcacttgataggagatgaaggttgcagtgagctgaaattgcaccactgcactccagcctggacgacagagtgagaccctgtctcaaacaaacaaacaaaaatttcttacctactttcatcaggacctcaatctcctttcatgctctactccagctgcatcagtacacatgtgcctctttgtccttggaggagcctgtctttccttacatttcaggctatgagatctacctgcaatcccagccctcgatgtggttaagaggagtgatgattttgtccattacagcttctttttttcttgttgagaaggaattaatgctctttccagacatctacatcctaagcaaagactggaaatctaatatataaaaatcaaactacctctgttaatgatatatgtgttttttttctaattaattcttgttttgttgttactgttgtgtgagtgcttgcatgcttatgttctctttcttgcaatgtatgtatttaccttcttttgtgacatagaacatatgaattttgtttttaatttctctagtgaatctgtttaagttgatttaacatgtacttaaattaatataccttaattatgaaaaacaatactacaacaatctgtttttctttgtgcatgaaaattaaggcacccctttacttcctcttcatatattctcttccaaaactatcataagagaaaatattagttaatagaaaatatatgtatatatagtcatccaaaatattatttttaggcctagcttcatatatgtaattgcttccaacttctcttccaatcattttatacttttatattctctattcttcagttctgtatttttattcatctcatagtcatctcagttaaattctcttgccaaagagtaagaaaaatatatatatgtgtgttgtattcattgtagtttgagaatgttttcctattgctttttctcatgaataacaatttggcattcttagttttttctttctaaaaatctgaagacatatatacattttcaactgacatctgctgctaaggagaaaaatactaaagctacgttttcataaaaatctgaaactagtgctatttttatttgtttgtaggtaatctgtttttgtgcttagacacatgtggaaaaatttttataactttggaattaaaaaataatcacaaggttaggtctaaaaataggcttttttaaaaaaatcaattttgcctgtgacttagtgagctcttttaatatataaactatcatacttgggttagaaaatttttcttccattatttctttgagtattgaatctattttcattgacctattatttttttctgaaaaatcttattttgtttttaaattatatttagagacaagagtcttgctctgtcactcagagtagagtgcagtggtgtaatcatagctcaccgtaacgttcaactcctgggctcaagcaatcctcccacctcagcctctaaaataactgggactaccacccagtcaaatgccaccacatttgactaatttttataaatgttttgtagagatagggttttgatatgttgcccaaactagtcttgaatttggggcctcgagtgatcctcccacctcaacctcccaaagccatgggattccaggtgtgagccactgtacctaaccctcttctggaaaatcttaaggccttagattgcattcctgtctttataggtcatatttctcattattctcttctttttgaccttttctttgcaacttgagagttttaaaagttcacttattgtgtaacttattcattagtcctgatatatcatttgcattctttactactcccaactgttatttttattctgcagtagaagtttgtctttattcttttttgttttcttttctcatattatctcatcttttatatcattaccttcctttcagcctattctctttgttggttctctactgatgtttcacctagattttcattgtttaaaggcattcatcagattatattgcaacatttttattgaatgcagccagaatttatgtgaggtatgtactacctctgagacttgagggtgatattctgatttgtttagggtgcaatgagtttttgtgtttgtttatgtttctataaaccatccaggcccaatctttatttttgtcaatagttaaagaaagtgaagcatcttttgcctcctctacaatccatttagttaagttcagtttttctttctcagacctagagttaaagatcaaatagatatgttcagcatttaatcaaatttaccatgcatagtaggtattccatgtataggtttttgacagagatttactaaagttatttggtctaattatgacagagcatttattccagacactgtcttgtttatactacttatcactcagtgactaaatcttccaaaacaaaaattattgtcatctcaccctctctacttccataaccttacggtggtttctgctttgagtagtagtctctggatatttgtgaaagagtgtaactgagaaggcagcaggtagtgaataagagaacaaagtctctggatactaataaagatagttctcatatagttcaggatagcttgctgcttacttggccataaagctcttacagcctaaagttaggcataatcaaaggaaatattgttgcgggaagtcagggaccccaaatggagggactggctgaagccatggcagaagaacatggattgtgaagatttcatggacatttattagttccccaaattaatacttttataatttcttatgcctgtctttactgcaatctctaaacataaattgtaaagatttcatggacactaaccacttccccaatcaatacccttgtgatttcctatgcctgtctttactttaatctcttaatcctgtcagctgaggaggatgtatattgcctcaggaccctgtaataattgcattaactgcacaaactgtacagcatgtgtgtttgagcaatatgaaatgtgggcaccttaaaaaaagaacaggataacagcaattgttcagggaataagagagataaccttaaactctgactgcctgtgagccgggtggaacagagccatatttctcttctttgaaaagcaaatgggagaaataatgctgaattctttttctcagcatggaacatccctgagaaagagaatgcgcacctggggataggtctctaaactggcacccctgggcatggtcatctcttatggtcgagactgcagaggtgagatagactccagtctcctatagcactcccaggcttattaggaagaggaaattcccgcctaataaattttggtcacactggttgatctctcaaaaccctgtctcctgataagatgttgtcaatgacaatggtgcctgaaacttcattagcaattttaatttcacctgggtcctgtggtcttgtgatcttgccctgcctccgcttgccttgtgatagtctattaccttgtaaagtacttgatgtctctgacccacacctattcacacactccctccccttttgaaaatccctaataaaaacttactggtttttgtggcttgtggggcatcatagaacctaccgacatgtgatgtctaccccggacgcccggctttaaaatttctctcttttgtactctgtccctttatttctcaagctggccgacgcttaaggaaaatagaaaagaacctacatgaatatcggggcaattccccgataaaatatattatatagggagactcaaagcatatttctaccttccctgtactaatttgaaaaagaatatatatggttgataaatatatatatatatttagaataagtattaagccccaatgttatgcatactcaaaggaattatacaacataaagagaatcaaagtatatttctactttccttggactaattcgtcctgttctggttgtaagtatgggatatgaaatacatagatgaaatgtatgcttttgaatctatccccaatctcaatttagttgtttcaaattatttgagaatttctcatttatctttctctaacttgaattatggagcctgtggctttatttttttttttttaagtttttttttttttggtcagttgttgaaatttttaaacagatatttggaggaggtgtatcagagccagctagttttaagtctcagactggtcactcttaaaataatcccacccagtcatgccatcatcaaatttagttgcctctctccttggcttaaatttaatacattttttccccaatctattggactctttagaaatgttttaaacaaaaatgactaatttattttttaaatgtaattaattttgttgattgaataagaatgtttaaaaatgaaacattattgtgaaaattaccacatccttggtttaaaatagcctgagaaaggaaagcacagccataagaaataaatatacgaataggttaatacagaggaaattgtgccagacaaagctggttgcttttttgatagctttacagccttagtaaatgaacagagtggagtagacataatgcatcttgacttctagcaaagtactggagacaatgtcgtgtgaaattttgattgcaaaattaatttgagttggcttgaaaaacactgttaaaggaaatataagctggttgaaaagacatacagagaagagtgttgattaatgtcagtgaactaatgagttgagtgatatctccagttaaatgtcacgattgtgagtgttggattgaattatttttgttatctgttgaaaaaataaataacatagggttgattaaattagagcagaaaatttatcaggagacaccagtgattacagaaaatctatataaagacatgaattcatttcagagaaaaaccagtgaaacaatataattttacttaaagagtccatttttttaatcacaaaatggaattctatgaagtatcaatgcttaaagaccttcaaactacagaatttctcaaaactaattggaaaacaaaattaactatctcagtaaggctagaacatcattttaatccagttagtagctacattttatcccaaccaataaagtgacagttaattcttacctagaggatgtggttaaatgtataattattatttaccagaaataaaaaaagtatctagaaaatcagtaacctctagaaactcttgggcacaggagagggagaaaactatggaaggggaagtaattatgttcttaactatgttacattcttaagttacattcttaactatggggatatagtaagactctaaataactaaagtttttttttattatactttaagttttagggtacatgtgcacaacatgcaggtttgttacatatgtatacatgtgctatgttggtgtactgcacccattaactcatcatttacattagatatatgtcctaatgctatctctccccactcccacctctccccacaacaggccccggtgtgtgatgttccccttcctgtgtccatgttatttttgaaatatccagattaaatgtagttaagtaaaacaataaactttttcaatgtaggttttttaatgctaatgaaaagctagtcagcatggggtaaattagattaaattagattaggtaaattggaataagaatcaaatgatcacaatcataaaatgggattagtcttactataagtcacacctgcaaaaggaagaagataacctggaaaaatttaaagagtcttccactttacgaagtcgtagtgagttggcaagttttaataatttaaaagaaaacgttgatttcatctaaaaagagagagagaaagttttagttattgattcaacatgtatttattgaataccttaaatgtgcactatttttggttttgtgagcagtcccaaacgattaaaacagagtgacttgttccctgactatcttaaattatcgcaaactgattggcttaaaacaacggaaatttattctctcacagttttggaggccaaaagttcacaagcaaggtatcagcagggctgcactccccctaaaggctttgggggagaatgattttgagcgtttcagcttctgttagctgtcagcattctttgatttgtggcaacatcactccaatctctgcctccatggccatgttgcctcctcttctgtctgacaaatctccctctaccatagtcttaaacaaacagttgtcattgggtttagtgcatattcatgtaatctagaacactctcccctctcaatacttaacataattatatctgcaaagatcctttttccaaataaagcaacgtttgtttccaaattttaggatttaatatctctgggtgaccatgatttaacctactacaaaagcattttctaacaagcagcttaaaataggtttcttttttctttgagacagggtcttgctctgttgtcaaggctggagtgcagtggacagtcatggctcactgcagcatcacactcccagtttcaagcgatctttccacctcagcctcccaagtagtttagaggacaggtgcatgccaccacacacagctaatatttcatttttttgtagagacagggtctctctgtgttgaccaggctggtctaaaactcctgagatctagcaatcctcctgccttggcctcccaaactgctgggattacaggtataagccactgtgccaggctcaaaattaggtttctattgctgcattaatatatacacagggccatctctttctcttctaattattttacaaatataaagagcatctgtaacacaatgaagctgttttccactttaggaaaagacagttttgaaaatgtgattaattatttgttgcaggttaggcttcatacagtcatattcccagtgcacattgtcctcaagatctccccagtttggcactgaagccttattgactctgtctctgaaagaggccttaaatgatcccccttccttctaatcctcactgaaattcccttaggttaagcccaatttatccaagggctatggtcttctacttgatgttctgtttttaatccttgatgctatccttctccttccatacaaacagtagatacacatattttcaaaacacagactttcttgtgttctctacttaaaaatctgtctagctttcagatacataaaggaaaagcaacctggttttaagagcatgcaatgcttcttcttaaatttccgatccctgtccttgtctgcagatttatcacttaacattcctctccttgcttcataatactacacacacagacatacacacacacaaacacacacaaacacacacacacaaacacacacaaacacgcacacacaggcacacacacacacgcacacacaaacacgcacacagagacacacacacacacgcacacacacacacacgcacacacagttccttgatattgcagtcacacagaattgttcactgtttcttgaaaataatcataaactgcatttgctcatgttattttttgagatcagagtgttcttccctcttttttctgctttaaggttttctctttttttgcacagctattaaaacttggccaactattatattttctctatagttttccctgatccttacacatcttcatagctccttacatgtaactctattactgtgtgcatcatatgcgatcgtgtttattttccctgtgtgatttgttttttagactatgaccaccttgaagacagaactgggtcttatctatctttacatctcctagttgtttgcatggttcttgacacatagcaaatgctcataaacttctgatgaactaaattactgtaaattaaagtcattgatacatttaaatggcacgatttacctatatctgttttataatcatagttaacaaattaagcaaaatacttctaggaccaggaactcaatatggagacactccattgtaagagagaaagatgcattgaatcgtttattcagaaagaacttattatgtcactgtaggcactgcacaaaggctaaaaatcccaaaatagaattgttaaaaaattagggtttaagattaaaggcaaaggaaatcatatttgttgagactattagggttgcttgaagtaaactaatgccaagtttaagtaaaaagattcctgctatatgatataattgttaagcctaagagaccagcaggcaccaggtacagttacattcagatgctcaagcaatgccattagggaactgcccatgtttagccattactgtgttctgttattccttttttttttgttttgttttccctctcaggcagattctactcatgtggtaacaagactattattctagatactgtactcatatttaacagtctcagggaaagagtgaagccttttactcaatcgttccagaaaatatctaatggatgaagggaaggctctaactggccttcgttggaccacttacatttctttgaaccaattactctggtcagaagatgaacatgtctgatctttcaggattagattcacatgcaaaataatgttacaattcaaactaggaaaaataaattatatatttttaagagactggatgaaaatactccatacatcacatgtgcttttctttttctgtatattggtatatacataatcactatttctttttttttttttttttttttttggagatggagtcttgctgtgttgcccaggctggagcgcagtggcatgatcttggctcactgcaacttccgcctccaaggttcaagtgattcttctgcctcagcctcctgagtagctgggattacaggcacccaccaccacacccggctaatttttgtattcttagtagagacggggttttaccatgttggccaggctggtctcaaactcttgacctcatgatctgccagcctcggcctcccaaagtgctgggattacaggcgtgagccactgcccctgacccaccactatttcttttgtaattaaaaagtacatatacactttatattttgatgtagatgtaagaatagcctctgcttcaaagacctcattataatagtattaaagacacacaagtaaacaaaggtaacaataaaatagtaatacatatcaaatattaagtatctcaggaataattattccttctaaggaatggcaaagaaatttttcacaccacaaagttaattttgaattgggtcttcaaggaacataacaatttgaaaagacagagaggactttccaggaaaatgtaactacatatgcacaaatgacagtagggattatagtaagaacacttttattattattctacctcttcactctattcaatttccctgactactacaatgtccccatgttggtttctcctttcttgtattccaagatattgtgtcctgcttttgcttattattctctaccccttaagcttctcattgcttcctccttcttttctcttttttctgggcctccctctttgtttttacgatccctgggaggactcatttaattgactcctaaatggtttctgtgtctctagtgtcttgtagacattagaggcacagaaaccatttttcactgtctattttccactcggcatccaaactaattttccataaacattgcttccatcatggatatgtgctttaatagcattggaatcagacagatcttaagcacaatacaatagtatatataccagataccagttatatgactgtgagaagatagtaacttctgagagtctcactactaatgcccaacttgtaagataattatgaaaatatgtacaacatatgtatcactctcagcagtgctagccactagatagatgtgcaatatataagtagataatacttttgtgggtatctatattactcctttgcccataaccaacagtgaaccatcatgttcctttttaagcttggtggtggatacaggtgttcactttaaaagtctcagtctcagatttcaagtcttcaacccatctcctaagctgtcagaggcctttacaatctttacctacctcctttattcagtcttatttcctatcatttccccacaggaactatttgctggccctttaatttctcccttacctcagaacttgctaatatttatcactcttaaatatatgtttttgcttgtgctgttcctcaaactagaatttttctgccatcttttgttatcctctctcttcttttagtttaaataccttctgttctctaagttttttttttccaggacaacctagaaaaaaatatctctttagtttctacagtggcagaaggtaatgtgatttaccaatttaattacttcatattacaatatagtgaccatttatatcagtgtatagtacaaatatgtatactgtggtcttactactgattatcttattcttatttattgcctctccaacaagatgttatcacccatagacaagaatcatattttatatatctttataacccaaagtgcctttttaaaattaatgtatcatgtttgttttcctggaacaggaactgaaatagagagtatgaattcatttgtaactgaatctttgctgtaatagttatccccagcatccttgctaatacagagaatgaagccttaatacctaaagcagccactgtatgtgattaattaacttctctcctatgcatcttgacaggtagtggctatgtgccattcttgggagaactgggaaaatggtcactgaaatcatttttgttgtttctagttccaatgagaaatgccagccgggaaaggctgctacagtatgtagcaaggtgcttttgctgaaataataaaagtatttgcaaggaaatacttgaaataagtgctaaatttccaaagattgatctacactacagaaggcttattagggtatattgatactagtatgtgttgtcttaagtggtacattgtagtttccatgccaattcttggtttaaaacgcagcatgcatctgttatatgccactttccacttaaatgcctaagacaggtagattgcactgtcaagttaggtcattataactccaacagatgttgtcatgtagatgaagaaaattcattttaaatgatatcatttataaaatgtgtttttctttgtacctaaaaaaggcaataatatgtcatattagctcttcagattcaggttgcaatcagtatggcatgttttgattaaacacttcacaatttcaaaatcagtgcaggataatgatggagcacatgtgaggaaacagcaatagcaggggtgtttacagtatcccagttgtttcaagcttaataacacttcatgttatcaatcagttacaaaggaataattggtggataggctgaggaaatggtacagtaagaaattgtacttattctaaactatagggatggaagtgcagccaggtcaatacttatttggttagtatattgtaactaatcatttgagttttgccagctggtatcttatttttgcttatttgtttaaccgcttttaaataagtatataattttaacaatttaagtcagttgaaatcccccccatagagctctcctccaaatgcatccctagctacattcttctttctggagattaaccagaaattggtggtttcatcctgtttatatgaatacattcctagaagataaaatcatattgtagatatttgtgacaaaattttcctcacaactatatgaaagagaacgaaggaaggtgtgtggttaggagttagctgtcattaaaagtgtgtaaattttgcacgttccctacatttattttccagtaaattttactagtttctttctaatcagttgggactaaagtcaatcgacctgtctctgcttctttcaatttcatttcccaaaagaattttagtgcttctctattattcttaactctgccttgccccaatacattaatcaatgctttgggtaacaacattagatttgtacagggaaggaccagggaatggcattccaaagcaacacatggaaagggcaagagctgaatttcataaaccgtaacctaatccatcactgcagctttccgttgcctctacccagactgcagccaaacatactctaagctgccactttagagtatctttaccctccatgggagtttttctttttttccctttttttttttttttttgagacagaatctcactctatcgcccaggctgaagtgcagtacaggatcttgtctcgctgcaagctctgcctcccgggttcaagtgattctcctgcctcagcctcccgagtagctgggattacaggcactcaccaccacgcccggctaatttttgtatttttagtagagatggggtttcaccatgttggccaggctggtcttgaactcctgacctcataatctgcccacttcattttcccaaagtgctgggattacaggtgtgagccaccgcgcctggccaggagtttttcactgtgatgttgtgtaggtctctggaatgtatgtttccctctgcagtttccccagtgttgattttaagggaggaagccagagcacttgctatttcaccatcacacttgtttgaagtgtgagttaccatgcaatgtttaaaacatgagttacacctttttggaggatgctgtagaataccgatttattttttgtgtgaaaacaaactctacctcaggttaatcaaataattactgaagaaaaggtttttctttattcaaatatttcagcacatgaatgaagaagaaatggtaaaagtaaaacatgaacatttggccatcactaattatattagtttgtagaggctactgtaacaaaattccacagaccaagtggctgaaacgacaaaaatttgactgggagttcaaaagcaaggtgccagtggattgggttttccctgaggcctctctcttcagcttgcagatggccaacttttccctgtgtcctaacatggtcttctttgcacccgatggctctctttatggtctaatctcctcttcctgtaactacaacagtctgattagttttgggcccacccatatgatctcacttaaccataattatcttctttaaagaccctatcttcaaatgcattgtgaggtactgggggttagggcgtcaacacctaaatttggggaaacacaattcagctcattaaatgaatggaagtcatacctgaaatcaatgacggatcgtatgactacaaaaaaaggagacaaacattatacacctgctgtttaaagtatacaacacaaaattattgacaaatattaagctgaattaggtcaatcttctagatttaccaatttgcaaataatgcaatccacagagcaagatgtggatatgggggattcagacagcacaatctagctcgggaaactacagaaaaaaaaaatgacccattttgtgacatataattgaaggaacaaatgaagatagatgaatggagaacccataaataaagcaattcaagatacacatgaactcataaaacataggtcctaatttgagtaaagaaagaaaattttaatactgactggttatttgatgacactgagaaactattctaactgtgcagctatgaaaaggaatgagatcatgtccttttcagggacgtggatgaagctggaagccattatcctcagcaaactaacacagaaacagaaaaccaaatgccacatgttctcacttataagtgggagctgaacaacgagaacacatggacacagaaaggggaacaacacacactggggccttccccggggtggagtgcagagagggagagcattaggaaaaataactaatgcatactgggcttaatacctgggtgatgggttgataagtgcagcaaaacacctttgcacacatttacctttgtaacaaacctgcacatcctgcacatgtacctgcacatgaactaaaaataaaaataaattattctaaatcttgggaagtatgataatggtgtcatgattatgttttaaaggacttcttaacttttagagatatataccagaatagaaataatattgtataatgtctgccatttgtttcaaatcaaatctgaccaaagtaggggcaagaaagagtaggcgcataaataaataactcattgataatgagttgataattgtttcagtaggatgatgaatatttgagtttataattttattctatttatatatttgaaaatttttatactgaaaagttgaaaaagctttatattggtattttaaactttgtaaatgttcactaaaagaagatatgtctttttagttgttttgcctgagttatgatgagctttgatgagtcaatcaggctgcctcttgagttttccttgtaaggttaattgggtgcactggagagctagctgaggttaggagagcaggctctggttgaaggacagggtttcggcttggcagactaactaccttctctgattattaaactttgatgccacccacattagcacagtattctagtcacctgtgataacctgtccagaagttgctctgatcgtgttcagctcaataagtttagacttcacacaatagtgcttgtcattttttaccctcttgtaccaaatatatttcaaaatatgtccaatccagctgttaatttgactgaataaaatattataataacacttctgaggattgagatgatgtttgaagtttttcaagagtcttttccctctggattagagaacatctctgccagaatcaaaatgagtctcaaaattgacagtttttactttacttgctacagtaacctggcattttaaaaagcattctggaaaaaaaaaatgaatcttctgattgtgtaataaaagaataagaatagaaactaagataaaatgattctacatgtatatcttgacttatgtctatattttataatttcaacttttacgtcaaaaaattgtaaaatgtcactaattttataaggtttaatttaacagatcaaagctcataggactttgttgaaaacaatgaatgcaaatcctcagtacagttccaggtgtgtcatgagccctccaaaaatgatagttacaatgactgtttcaaaaaatttataccttcaacaaaactttaatcctatttttatatgcctgtctgctctgaaaataatttaatatgtttaaattcctagaataaatcttactttaaccaaattaataattcttaaacttaaatttagatttcaatgaatccccaaaatggtttccacataaagtaatgcagctaatatcagcactgctaacagattacacagaaaggtctattataatgattgagtaaatattcctgggaaatcaaccttgttaaatctatatcctataaggaaaggtgcatatctgttttttctagtaaagattccgtaattgttattacaagttaatcagcttctcccaggttcatttactctggattttattaatttattacaggaaattattgggtaagtaaaccacaattataataaaatctcatacattttattatatggttcacaaactttataaacacctgtgatgggattctgctattgatatttaagtggatatttattaaggaactagagatacttctcagtaagattagcttagagaacggtcctgtttttgatctcttaagattccaaatttttattccaaattttctgatattgcccaagtgtcttttctgaatctatgtctttattatttggcttaaaacctttgtgcatctggtgctctattctgctgtgactttggagaaaggttacagtttgtttttgctgggaggaataacttcttgaatgatgtcccaactgaaaattatttttttggttggatagaacatccctgtacaaaacttcctctattatcccttggataattcctgctgtatatagaggtccaagattgattaatgattttatcttcagtaacctgtgatctaaattaccattggcaagacaagagtgatacctgtttttttattctctacattaataaaacatgccttaagaaatctatatacttcatatagaggatatgatttgccactaagcaaactctatgaaaaagaattgtgttttcatagtaaggctttattataaaccaaatatgaccaactttcagctaaactgtattatctaatcaagtttattccgtcactttacttgctattatcaataagacaagtaatatatttaaatatagaataagtaacaagcaacatgttaactgaattaatatattggtaaaatatagattttaaaagttttttgaaaatatttgaggagggttgcacttttgctccctctgattttactacgtatgtctctgactgtatgtaatcacacctagcttatgctgtcccttccattctctacacttgactttagaaagtcaaacgtagactggagcaaaaaggggagagatcttttcctaccatttagcagattaaaaggtagattggaaatgcatctcagtatctcagccataaatgtctaagggataataatcccgctacatatttattaaactaattacaacatattgcgcaaaataaaatactttgaatcagaatgacttatgaatggtcgattgcatacaaaagtgctggagatatggtgataaaaagatgattcagccatcacaaagctcaaaattctactgggagaaacaggtaaagtgactgaagcccaggataatatttcaaataataagtacagtgagatacttatttgagagatgcaaactcaacaacagtttggtaagtactttctctattctaatttgaatacattctagtcaattgagatacacaaagcatcaattctccccattggatttggatcccataaaactacccatttccccaaatagatagtgttttaacttaacagacctcataaaaagcttgacactaaaatgagaatttataaattgtgatctgtagtaagttaaatggtgcccaaccctgcgaaaaacaaaaagtatgtccatgaactaatccctggaacatgtaaatgtgatcaaatagggaaaagatatctttgcagatataattgtaaagaatttcaagatgagatcgttatggaatatctgagtgggctccaaatctaatggcaagtatctttattagagaaagacatacggggatttaaaacagaaaaggaagaggagacagccatgtgaaaatggagacagagattgaagttatgcagccacaggtcaaagaatgcttggaaccaagagaagctggaaaagacaatgaaagattttcccctagagcctttggatagagccctgcaaatactttgatttcatatctgtcctctggaacttggagagaataattttttgatgtttaagcagatgactttggggcagtttgttatggcagccattgaaagcaagtcgtgatctagtttgccttattttccaaagcatagataattttcaatttcaattaggaaaattgaaattccacaaaatgcaagtgcatacagaaatgtctatctgagttgcagttgggaaacattttgcatttaaaaaggaaaagttttaagatataaaagaaagtcttgagaaaacaagagaatatccctcatatatgtacaacttcttactaatagaagccttagatgtctgatcaatttcagaggcaaaggctaccattgactgttcattgaccattgacaagccatgtgtttcaatgatgaaataccacataacaaaatactctaaagcatattgtcttaaaacaactgttttattactaaggttcctgcggatctgatattcaggcaggattcagtggggatagcttacctctgttctacatggcgctcactgggatagttcaattagggtaagaggattgaagatggtatcatttgcatgtctggggctttggtcctggctgttggctgaggtgctttagttacccttttctctccacatagcctctaattactcaatattctaccccagcctttaaaaaaaattttattgtggtaaaatacacatataaaatataccatcttaaacattttaagtgtacagttcaatgataataagtacatttatattcctttgcatccatcatcacccatctattttcaaaactcctttcatcatgcaaaactgaaactctatacttagtaaacaatgattccccatttccctctctgtccagcccgtggcaactgctattctttctgtttctatgattttgaccatttcaagaaacttatgttaagtggaatcataaggtatttgttattttgtgactgattcatttcacttagcataatgtcctcaaggttcatccatgttgtagtatttctatcctttgtaaggctgactgataaggagagacttacttctgtcatttaaaaacttgttttctatatggcttatagcatttttgtcccttgcttcctgcgtgactgtcttcttttgtgtttagttgattattgtaatgaaatgtttatgtatctatgtcattgacttttgtatattttctatagctattacatttaacatcctacagttataacactcttatttagatttatgccagtttaactccaataatacacaaaactctctcttttacatttccatacccacttcttttggttgctgatgtcctaaaactacacctttacacattgcaggtccaaaaacaaaaactaataatttttaaatatatcagtttcttgaattaaaccattgttacaataatagtagcttttataattgtccatatacttacctttactgtgatatttatttcttcatatatgacttcaaattattgtatagtgtatttttatttccatcttcagaactcacattaacgtttcttccagacaagtctagtgttaacaaactcctctcaacttttgtatacctagaaatgccttaatgtctcccttagtttgaaggaaatttttgccagatataggattcttgcttgacaggtttattttctcttagcactttgtatatattggcccatttctttatggtttccaaaatttctgataagatatatgcttataattttatcaaaaatcccttgtatgtgattaatcacttctcttttgatgtttttgatattctcttttttgtcttcatcatttcaaaggttgataatgtggatctctgagctcattgtatttagagtttactgagcttcttaaatgtttatattcatattctttgttatatttgggagttttggccattatggcttcaaatatcctctcttcttttctctgtcttcttatggactccataatgcatctgtttgtccacttgatggtgtaccaatggttccttattctctgttcacttttctttaatcttttttctttctgttccttggattgataattcccatggtcttctctttacatttgctgagtctttcttctggctgcttaaatctacctttgaaaatctctggcaaatttttttcatttcacttgtactttttagctacaaaatttctttctacttttaagttttctatctctttatggacgtttataatttattcatgtattatttcttgatttcctctacttttcttttagttctttgagcatctttattacagttgttttattacagttgtccagtaggtcccccatcatgtctttttcagtgacagtttctgttggcttattttattttatttttaaatgagccattctttcctgtttctttggatgccttataatttttttttgttgaaaattagacatgtgactgtagtaatgtagtaactccggcaatcagattgtacttatttctcctaggttttcctaggagaaatttcctaggttttccccttttgttctaaatgttgtagactagactgtctctgtgcaaaggatcaatctgagatgtacgtaaatttaaggtcttctcaagtctcttttgagcctgcacctttccctgggcatacacagcaactttctaatttcccgtgtgtatgtggttgcttttaaatgtcttagtatttaatgtctacctccaaaaagaggaaaagagaaaaatgaaggtggcaagcaggcactggccatttaaatcccctggaaattacttcagccagaggggtaggggtgtgcaacaatggaggggaggtgcaacaacagtgactacctagcccttcgtctacaagtccgtgattagaagcagcagtaagcaatcagagcacagatctccaatatttggattataacattccttttgcccatgctggcttttgtgaactgcatgtaagttgctcctgaaacatattcatggctgcctgccattggactaagggtcaggataggtagctgctactgttttaagagcttaaattgatcaaaagtaaccataattttccttataagctttccactggaagtttcaagccttcaatagactccagaactccagaatatttatatcagatagattctgccagtgcagttgttgcctacatggggagacagatttctggtgctttctattttgccagcttcccaaaatcttcctttctaatcttgtttctctccttgaaagctggggagaaccagctgtaattctaatttttgttgttagtggactatggctgtgagaaatgtcctctggatggggatgccactaccccctacacagctcacatctcactcacaactttggttttcccctgctctggaccagcctttttttatttctttatttctttttcacttgattggcttccaaaaatgagaagagaaaacctgtgagatctcttaagattcatgccaccaaatcatatgtcatcacttctgccacattttactggagaaaactcacagagcaaactcagattcaagaaaaggggctgtcttagaccttttgagcttctataataaaataccttagtttgggtaattcataaatagtagtaatttatttctcagagttctagaggctgagaagtcaaggcatcagcagattcaatacctggtgaaggcttgctctctgcttcgtagacggcacatcttgcagaaggggtgaacagtatcctcacatggccaaaggggaaggcaacttccttcagttcattttataagggagctaatcctattcatgagggaagaaccctcgtgaattaatcaccttcttaaatctttaatacaattgagttccaacatatgaattttggagcgcaacaatattagggaagtggactccatctcttgaaagaagaatggtatgtgtgcacagggataggaggaattatctgtggccatcttgcaggcagactaccacacagtgctctgctttttcttatcattttctttgatgacatctgatcctttctcacaaatatctcctttgtaaaacactcagcacttattatttatatcagtcatttgggaattagtcatatgctgcctagtggaatttgttgtcattaaaaattttttcctgttttgtcatttcaaaaacaatcacaaactcttggaggttaaagatgatgttctatatttccttgtaccccgtaaaaccagcatagtaggtatttaataaataactgtcttcttaattataaattttaagtggtgggagaatgatgtatttacactaatgcacggtggttgtattattatccactagattgtttcttgctgcatatcatgcactgcattatttcttgctgcatatcaatcacttagtactgacctcctttttaaaatacgcctgactttctcatgcttatcttacatatatggttatagctaagagttgtgaatggacacagatatgggaagcatatttaggaggattaacaaaagagtaattagaagaacacataaatccacaaggaaaaaatgactctttttgaagtatgctagcattttcaacatgcctgttgagttaatgatttatgggagtttcaattgtttaaatgtttggaatactctgcaataaaataaaaattctcttcaaagttgataaaaatactcagaggcatacttcctcatctgatgattcatagttaccaatgaaacccaagaactccatgcacattttcagcaagagcaaggcatctgatagcaagagagctggaaaggaagaatcatacagtgacctagacaagtgtcatgtcggtcttagcatcagataaactgattgcaatggttgattgtactatctctagcgagagtaatttagaaaacctgaataagaaaccctctcttgttcatcatagggatgactcttggtgtgaacccaatcatattaaacaattgtagaatcaccaagctagacattttatgagactaactgatttattcctcatcttgaaataaaacctgcatgccacaaaactcctctatgctgctgagacttagttctttctttgagaaaaataagagccatttattcatgcaataaattttcattgtgtgtgaattgtatactaggcctgttccatgtgcttgccatacgtcagtgaatagaagaggcaaagatctttgcctatggaacttgcagtctagtaggggacataagttatttcgtaagcttcccctttataaatatcattaatccttactaataataatacttacatcaatgtttatatattttacattggttttctgataatataaaaaaaaattcacaaaataaacccaaccactaataagctgtgagttttgagtgtagaattcttttcattaacaaaccatttcattttcagatcgagaaactaaggtttttaaaaaactgattttactgaaaataaaatctaaccacccatcctaatgttctttacttctttatctgtctttcaaaaatatcttcctttctctatgttgagttagatatgtattcacaaaatctaccatactgtccatatatgttagatataaatttttgagctcatgtgaaagaaaccaagtttgaatagttgaagcaaaacagaagggtttattattaaaaaaaaaatgtgttttctcaaggaccccaaaacacaaagctgaacttgagaagtgagcgctcaaaactattaaggctgtctgcatgacccttgctctaattcctctctgaaatagtgtctcattgattgaggtaaaaaatgacagcagtttctagagctacactgcctgtgttcaaatcctagctatgtcatttgttagctgagtagcctggaacaggtaaattaatccctctaattctcaatttccacatctgttaaaattagcataattataatcatatcaggataattctgacaggattatagcaaaaaaagattaaataatatctaatgactggcacaatacctgcctcataaatataagtcttcagtaaatataaaccaccattattaaataggagatgttaagaattgagctgagctggggagggctgagctgccagatgtgggagtattcagtaagacaacaagccaaaatgaaagtaacgattaagcttttattccacttactgtgatagtataatcaagagtccagaaagaaagtgccagcttcacctgtgtttcattttccctacaaatggcaccacgcaagggtcagatgcattagtacagttttggataactgtcttactgctcagggaaccccaaacaaaaagttcctatggttttatggacctaagggcaggagaagaagcaaggggaagatctaggaatgggaaagtaccaagtactaagtcagaatggagaaaagtgtcctccagggtacccactcctcccaacaagcaggtcttggcagaggctcctggaaaggttcatctcagagtccccagtaaagaagcctctgaatggaggctcctgggctaagaatgcaaatatgtataaaacatggctggccaggggtcctaagtccttgactgcaactcccgtcagacactgcagcacattgtctgtgcaagtcagtttggggagggaagctttcctctgtgaaggcctcccaggcaaagcctttgtattgcctagggcagggcaaaatcatacagaggtttttgacttggagctggattccttgagaggatttctaggagaaatcctcccaaaagtttcaacagtttatatttcatttgtatgttggtggttctctttcaagtgagatataatatagatgaaaagtatctaacatagattaggtattactcttattattactatagctatggttgcttgtatataactgttcagattatagctccaataaaacaacttattttattctctccagagttaggtaatatcattattcctcatactgaaggcttttgaaaaatgttccttggtctttactatacagagtttaacctttctgctctcaggaagaaagacagttggaaattcaccatctaaatttaaaagggggaaaaatctcagctgatagctggtaacacagtgttggctatgtattgagatacttacttaaagcatcatataagaaatgatgtacaggccaggcgcggtggctgatgcttgtaatcccagcactttgggaggccaaggtgggtggatcacctgaggtcaggagtttgagaccagcctggccaacacagtggaaccccatctctactaaaaatacaaaaattagccaggtatggtggtgtgtgcctgtaatcccaactactcggcaggctgaggcaagagaatcgcttgaacctgggaggccgaggccgaagtgagccgagataatgccactgcactccagtctgggcaacagagcaagactctgtctcaaaaaaaaaaaaaaaaagaaagaaatgatgtacaatcactttaatgtgtattaaggttcttgtttaaaaatcatctaaatttgtttagtatccaataaaaattgaagtctcactttgtgccaataattatgtatttaataaatgggaagaggaaacaaaacagtaatttttcttgaacacgtggaaatttatagataattgctgcaataaatattatcatacaaaatatatatttaaaaaacttaactacaatattactgtaaaagagaggaacatgattctatattacagtgatatgaggtagcctggggtgggggcaggagatcaaggagagtttaccccaaactacaggtgtttatattgagatctaaaggatgaggaaaaattactttactaattcattaaagaattgcaggtgtcttaagattgttccagtcaaggaaaactgtatattcaaaaccactgattctcacatttggctctactttggaatcatcttcataactttacacaatactgatgcctagatttcatgcccagattctgatttcattggcatggggtgtggctttggtgtcgggatctttttttataactcccctagcggttctgataagctttagtcagtgctttagaaacaatgtttaaattttcaaggtaggagggttatgccttactcaagaaaccgtaggaagactcatatgatttgaattcaaagaatgagagggaaggcattatgacatgaattgatgaatataaataataacaaatcatgcaaattctggtaggccacatccaaagtttggcctttatcttgagaatactggaaaactatggaaagactttaagcagatgttataatctcagaatttatgtttgcaaagaaagactgtaaagagaagctatgaaattagcttcggctaggatggtaggaaggaacgagttaaatagattcaggagacatttttaaagaggtgaaattggcagagctgggcaaaggattggatctgagaggtggtgagactgacagcttgatttttggctagtgggactgagctgatagtagggatagatagtgagcttaatcttagagatatctgagctccctttgaggtatctaagcagagacagtgaagtgatagtgaaatataaggagattgctgagcttgagatttttattgtttaggagtaaagatctaaattgcaatagagatgctttacactaaccttgtcagtttcataaaaattactttactggtacaaaacatggtaaaaggcactgtaatagacagaaaaatgattcagatggtacccatgaccttaagtggttaattatttaatggaggagataggaaagacagtgagaatttaatgtgattttaaaatgaacatcttaaaatgtctcaaggtagaatggaatagaagagaagaaaatccagcaacttttatcaggttgtaataattaaatgctaaaatattattagaaaaaataataatattgtgatctgatagaaaaggaaagctaatagaatttgagggaggggaatgaccccgaagaatcatgaaaactctcagggatacaacatcatattaggacacggtgtctagttggaaacattttggtttttcattcagcttgaactggagaaccaaaaagaaagaagaataaagaggacagcaggagttttaaatcatggatttgtttattcaaatctgccatgtaccaatacaacaatactatgataagagctaggagtacaactgtggacaaggtagtcatcattctggcacatagtttataggttcatatcatatttattataaaaaatagtttacttgagacaatatccctagttagctttcacaaaggaaaccagtcaaaataatgactttattaaaagaggttaagtagccattctatgagtttgcattccctgtgtgttgaagcaagtttttttttttcttttttttttctttttttgagacagtcttgctctgttgcctaggctggagtgcagtggcaccctcggctcacggcaacctccatctcccaggttcaagcaattctcccgcctcagccccccaagtagctgggattacaggcatgtgccaccacacctggctgatttttgtatttttagtagagacggggtttcaccatgttggccaggctggtcttgaactcctgaccttaggtgatctacccgccttggcctcccaaagtgttgggactacaggcgtgagccaccgcacccagcctgaagcaagttttagggcagtggttttcaaccttggctatacattggaattacctggaaaggcttttaaactactgatgccttggttatactcctggggattctgacttaattgtcctggggtttggatggagcatcagaattttttaaagctttccattctaatagtcaacaaaatattctaatagtcaacaaaagttgaaagccacagttttaagggcatgttttatcactcagactactaagtcacccgaaaaatgagactgagcaaggaacaaaagaattctgattatataggaaaaataataacaaacatttctttagtctcagtgtgtcatgaacacttctaaacacttaacatattttaaatcagttagtggtcccaaaaactgtatgaggaagtcacttttactattcgcatttgagagatgagaaaactgaaacccaacagcacacgcaaagtaagtgttagaacaggtacttgaactcaatcagtcttcttctagagcttcttatctgaactggtatgctatattgcctctaaatgtagtgtaatggtaattttataccagaagaattataaaagaaaggaaaacctataaaaataggatatcattaaatcagttaaatgctagttgataatagagtgattattatgactgcataaaacatctatgggttatacatatgtgtatatagacatatatatgtatatatttattcaaatatgtctatatatagatatatgtatacatatttgtatatatatgtgtgtgtatatatatgctggttctcatgttttcttcatttgtaggaatcagttaacaagttcttgttacatagtatgaaggttctgttttcagtagtgaaacagggagataaaagtggttgaaccatgtgattttttttctgacttttcaaagacattttctcctgaaggaagctcaagtgctaaggctattccacataatctcaagaacgactactactttatagtaatgaccaaactgtagtaatagaatcttaggagcatataatcatcctctagggaacacattttacaaattgaacctatcttgcaggtggaaataccataaagaaaattatcattggagagattactggcacactgcattcattcacatgtcaaagtggaaaacattccaatttacttctataaaacatgtatctgagtcaacctgccatatgtattttttacactttctatccccttacagaatatctaccaaataaatgctgcacatttctaagtggctggcttttaagctgctttgcctatggctttttgttccctctttttctcagctgagaaatcaagtaaacaaaacattgtggctggtagcataggtcctcagtgcagtggatattttgtgtccggcagctggagcattggtcgtacagatgggcttcatttgttccatatgaatacaagttaataaatggagagaattccatttggtattcaattaagatctcccctgactcctgttattaaagcctacaaactattgagcataaaattaaaatcgagcagttcagctctttttgacattataacactgcctgaaaaataatgtaaaacccaagagtcacaagtcattccttacagcccatggcaaataagaagtggaaacattgaggaagaaagagtaaatatttaaaacttgatcattagtacacatgttaggagcaggctactgtgctcatgcaaatacatcaatccagtttgttgaacacaagatattacattaattttaacagaatgttacaagattattattgccaaagctccaatgaaggaaataattaaagcactaggcattttaaggtcttaaaatgacagaaaatactataggaaatcaataaccagaaaatactatagaaaatcaatatactgtaattgaaaggaaattgaattgggtttactttttttatcccgtctaaattttcttcagattgccagaccactgaagatagtgaatcttgttttgccatcagcagtgtgactttctctaagtctcatgtgctgcaagggccatctttattgttttttatttaggaagcactcagctgaatagacagtatgagattttgtgtgtgtgttctctttactagtcttggactcattgttaaaaaaaacagaaacaaaatcaaagacacagcagacaaaaacaaccacctccacataaccagagaagtcaaattaatgagaattcagacatcgaaaccagaggacttgttagataagcctcacacttgaacctaagtgaaattcttctagtttttatcaaacactatgcctgtcattcttgctatgcaataagaaacattaccagttgcagatacaaattcaatttgaatctatatgaatctaactcattttcattgcttattattttaaaaagttattataatcaaacaaaaaagcttgaaatgaacctcagggaggtaagtggatatgaacagaaattaaagaatgttaaaatgagaaatccagactgggtgctgtggcttaaacctataatcccagcattttgggaggctgaggtgggagaatcccttgagcccaggagtataaaacaaaacacttaacaattctgagtctcaatgtcgttgactataaagtagaaatatcttcccttcctaccttaaatagatcacatttatgaaaaagattcataagttataaaacaacacctcaatgaaaaatgctgtatctggactttaaaaagaagtgaattaaatactaattttacctcttagtatatatgtgatcttaatgaagtccttagttttcttgtctgttaaataataatggtaagggcaccttctcatatggtcattgtgaagcttacatgtataaaaagctcagtaccatggctgacacatagaaagtatttaacagtgttcaaaaacataatcaatataggaaataagtattattttatttccttaataatttcttagttataccccattatcatatgtgataagagaatgtactttatttctagttttccagataatctgtatcctaaacattctttactcccaaattcagtctttgagcatcctaactcttgacatccacagctaatatttaggaaacattaaaatttgtttgtacatttgaaggaagaactaagtaaatggaacttaccaatcctaaaatccagactgctgttattaagaagaagaacaactgtacaaatgctgttatcaaaggatgtatgagtcaggcggaaaaaaaaggagaacacagaaaggtgaaaagtctttgtcaagcagaggagagaaattattgtcttgtaatatatatgagagagtctagccaaatattaaacatttttaaaatgaaaagaaatattatacatggtatgaataatatttaagtcattgcctaggttagaagattagatatatttacctattctacctacttcaaatgcttttttgctgtcattgtttggaacctccaaatactagaatgctttagaattataaaaccattgaccatgttcagttatgtttaaaagaaaacatcattctgaggaaactggaaattatatatttataaatgtttgtccatagcattgttgaaacaaatggctcaggtttcactgttaatccagttgctgatatttttgactactcaatacaccaaaatggtacagtcaagttggtgctaatagatgtcatttatttacacaaactgacaataggttcaccaaagttaagagacgaatttaagggggacagaaaagaaattcctgtgtgtgctttggcagcttagacatacttaccacgaacaagattatatcttaaaagctattcgttaagcttaaaattaagttatatggttgtaatatgtggagaaagcacattggaatagctcttcacttaatgttatagatcactttttccaccaatattatttggtctaggaaagtaaaatcctcttgaggaagtaattagaaaaagcacacatcagggaatgtaattgaagatagacttttgttgacctcagaagagaaaagctcaaaagaaatttcgtaaagttttaaatatggcaagaggaccacaatgtctttgataattagactttcaacacatttggatttgctaattggatctaagttctaattaggctttttatgtaactaagaatgacatatcattgtatgaatttaatgtgcttttacagttgaaactaacaattagcagccttttccaaattattttaataaggaaaaagctggctctgctgtttatactgtgacattcccttctcttaagatatattatgtacattttcattttcttaattaaacaccttttggggagcttaaagggaaacttgggttttaataggaagcacctaaattgtttatttgtgggggagacttgccagccagtatgtagatgactttggaagctacagacaaaccgcaataaaaagaaataaatcacaatcatcaggaggaaacagcacaaataaccatttgcccctatgaccattcagttaatcaaaacagtctctgaatatgatgaaagatctgttacatttttaagtgtgcacatgcggaatatgttcccaaatgtgaaggctcatggatctgctttcaggatgaataataggaaatttcttctcaagatgtgcattacaacattctctctctctgtagccttgttctgtaaacagttatctgctaattcaagtcaaatcatctctttctttctccatatttttgattgagagtcatcaatttttatcccattcagatatatagacagtaatttaaaaactggtagccctcagatttgtacattccaagagataagacctatataacagcataaaattaaactactatttgggtgagtaaagagcagtgagtcattgcaagactttaagggaaaggctgctgccaaaatattccaagcaaattgataacactgccaaaaaggcaaattatattgttttatgtgctatgaatactttgaaaacaaagacatacacatgatttttttcaaataaaagcagttgcccttctaaccatattaaaaatagtgtcttttttcccagtaaaagccatataagatcaaattaaaaccattgaaactattagagaatctaacttacagtaattgatatattaaaaaagacattatgttagagttatatgtgctattatttttccaattagtacattactgggactgagtgattggtgtatacataagtcctcattaagtaaaatgtcctcaatgagcctcctaaagcacattgggtactgtcatgtgccatataatgatatttaagagcaagaaatggcatatctaataacttcatttcctatttaaaaagaaaacctgtgcagtactctttccataccaattattctaagagctatcacatagttctccataaagactatacagaggtgatgggactgttcttcaggcagaaaaatgaccaaagttgtcttatctttcagcttggttgctggaatcctgtcacaggtctgaatgggtcactgactgacaagaaattggagaataacatgcgtggagtggttctacgtgtagtaactgttctggtaagtattatctgagcctcgtggttttgacttttggaggttactttatcctatatttctttctttattaactgatgacataatcttaaaagagattttaacaaattctaaatacgctttctaagattttttaatggtcatatttcacagccttcaatttacgtggatcaggatcacagttttgcagacttttaactacagtgtatgtgttaggaattttcttagaaattttaggctcaatttccatcctacagttttctacacatgacaaagtaaaggtatgtctcaggccttctttcattaaaactgtagtgaacatagatagtcaacatatagtgaacattgaaactataaatgaacataaccctgaccatgccaaacaatggtagatttggtaaaatgtacattctctaatagtgaaatattaacaaactaagaatctttttctcgtaagaacctacttcaaagggaagctgttgtttaataggcatctactgtcgactgtattccaggctcagtgctgattactgagaacattgacaaataaaatgacagatataattctgtcttgatagaacttatcatctagtgattctgtgaatgttgaataggattacagtagtttccctttatctgtgggggatgcattccaagacccccagtggatgcctgaaactgtggatagttttgttttcttccaacacaatcacattgtgtagggcttataggttatagagtgtggatatgctggacaaagggatgagtcacatccagggcatgtcagtgggatggtgtgagatttcatcatgctacttagaacaatgttaaattcaaaacttataaattgtttatttctggaagttttcatttaatattttttggaccatggctgattgaggagtaaccgaaactggtgaaagagcaaccatggataagaagagtctactgtatacctgggaaagatctgttacaatttcatttacttattaaaaagtcaataaatggtaactgttataattctatacattatagttttctttcctaatagatacatacaataagatgttaatagaaatattcttaaacagtaaaatactcaaatgggctctgtctaaatagccataaaccacgaaggcatacattctcctttgctattccaatgtgtttaatcatgtgctagtttatagcctgtttcaaaacgtaatagtccatagttagtactttatttttcttcagaaaagtctacttgtttttaattttgaaaaagattttcctatgggctaggtaaattgcagaattagtaaataggagaggaagactttttgatacgttgatgctaattggatgttcatcaaattttataacaccagttgctgccctttgtacattgtttactacaaattaaatatatgcaatgtaattttattgtcaaaaaagtggatttgtgcatattttctatgaaaggacattcaagtgagtgacctattcttctttttttgtggcccataaattattcctagttattatttttaaaagggcttaattgcttttggtaaataattgtaagtatttcacaacttaaatgtgaattcgcttctgtatgtacctaagggtattgatatgcatttacattgatgcactaatattaaaaaagacagatatttaaagtacagcaaattattaatagtctttcctccagtgattagcatgaaaactccagtgatgattgcagtgaaagacggtatatgtgctttgttttcctttgagaaaagaaagcaaatctttaagtccaattaacctcagtcagttttaagcaaatagttatttcgcaattactatatgatagactcagtaatggatataagagaaataatatacagaccttgtcctcaaagtattcatagaatcttgttaggttgatgcacatagagaaaaacagctcagattgattaaatatggttgacccttggtgtctgtgaggcattggttccaggaaacccccacaccaaaatctgcaaattcttaagtttctgatataaaatgatatagtatttgcatataacctatgtacctcctctcatatgctttaaagcattttagattactcttaatacctaatacagtgtaaatgctatgtaagtagtggctctaccgaattatatatttatttttgttatttttattgggtttttttcctaatatttttgagcctcagtttgttgaatctatggagttgagtctagatgcagaacctgtggatatggagtgttaactgtacttactatgtgcaagctactctactaagtcttttgcatgtattgtcttattttgtcctcacaatattctcaagaaataggtaatattctgatctcaagaggaaactgagacatccagaagttgaaatacatacatgtatgtgtgtgtgtatatatatatatatatatcttatcattaagggaaggggttaaggtctagaatcagacttcctgaatttgaatcctaactctgctacttactatctgtataatgttcataaatacatgaacctagaagaaattgaagaataacatgcaaggagcgattctacgtgtggtaactgctctggtaagtattacctgagccttgtggttttacagacagtaagtagcagagttaggattcaaattcaggaagacagattctagacgttaaccccttccctcttaatgatacattatactgtctccagtcctactgtgataagtgtgagaactgaggtgtctatagaattttgtttgacttgagagttgaaaatgcttacgtctgaataaggtgaaagtgagttttattgggaaggattgtaggtacaatcatgttaaattcatttccaggctgaataaaacaattgctattttgttcatgaaatagtagcacttcacacagtgttaacacctgcataccccaggttcaccttcatgactcttaataatctctatttcctgcaagcttagccctgcacagatattgaatatggttttgtgactggagacatggaagcagtgtttttttttttttttttcaagtcttctatgatggacttatcagttgggtgccagttgagtaacaggttgttatacttattacattactacaatatacaatcattgtgtttaataattttgcatgcttcctatgtctttctgtaactactctgagaatggaaaccagtcattcccttcttatttattttctacaagtgccttttcaggtctagctcttagttatatggccttgcaagcttcttctactcaacactgagaaccactctcccctcaccccacccagcaactcccgaatcttgaggctttacctcactaaaccctgaaactaggatttaatctatactcaacttgatgttgtcacctaaacgcaacctcccacccccttatattccaagtatttacgtccaacactttccagaagagaaaagggaaaggaccaatgtgtacatgggaagaagctatttcctcctttcttctattgaaactgaaatctagtcttagctctacccactccctcttttcttaagaaattttatattatcaattacaccaggttaataaaatggatttttcttaccaaaattttgaaattcccattcttatgactgttgatattttattgacttgaaagaaataacttcatatttattttaaactacacaattcagcactctactgtttgtgatcccatgggcaaataagtggtgctctcaaacatttcattgaagagttaaatagaggtattattgacgaagatgtaaatagtgttaaaggaatcaacaaggagtgttgaatcaccagaacctacctagatgacttacatgaagactgataaggcatgggaggaagcattattactagacaaagcaatagagccatgggagagagaccatcactcatagtagtagtgagctacagtgcagaaaaagaaagagaatcactgccaataccaaaatcaggctatgaggaactgggaataagggatacactgatctcactcctcttatctatctcttttcatggtctccaactgcaaatccaaccagaagtcagaggttatgggagcctaagtaaggaagaccatgaaagttagtctttcaggacacagaggaaggcagtgaagccctcagtgaatccagaagaaaagtagagaaaaaccaacacgagcatctaccatttgataggacctattataagaaggttatatatattaacttatttaatccttataaaatttcatatgagtggcactaattacattataaggataaaaatagggtacataagagttaactaaatttctgcctccatatagctagcaggagccagacataaatttcaagatcagagatcctggttccacaaaccatgtccttagccactctgataatcttccttctgaatcagaatggactcatgttaggtataaatgaaatttgatataattattgagatgtgaggattgcatatgttggattgataacttaggagaattttcctaaatttcttcatatatagatttctttgtattcaaccatcaccaaagccacagaaatatgtcttagaaatggaggaaaagaaagaatgataataaaagcagtctctactacttggtgtctcttctaatctctttgtttccataatttgcccactgatctttacttcttaccaagtggtccaagtgtattactacaaaggaattatgaagattttcccgtttttaacttcctgagttatgcaatgtagatagcaataaatgaccaattaagtcattcaattgttttcatggtaattcatgaaaacactattggaaacattactgagttataaacataatcataatatatatgataataaaatggaaaggaattggttacaaattaaaagaaaggcgtgcgaagctatgctgcaacaagtataagatatctgagaaccataaattggcatttgggaggagctcactgattagtaattcttatttacctactttgattggccttaaaaaagacatatacattcctaataaacatacattcactcatgaattcacacaaaacagtcaaagatcctgactttagagagtttttttgttgtttgtttttattgagacaggctctcactccttcacccaggctggagtacagtggcatgatcatggctcactggagcttcaaactcctgggctcaagaaatcctcccacctcagcctcctgagtagctgggactacaggtgcatgccaccgtgcctgactaatttatttttcgtagagacaggggctcgctatgttgcccaagctggtcttgaactcctggcctcaagtaatcctcccaaagtattgggattacaggtatgagccaccgcacccatccagggagtttgattcttgcaagatatcttctaaagctctcaaaatagtcttgaaaaactgcagtgcagttgttctccattaaatacacaatagagcatttttttgcctagaattaccataaaaataattcaatatataaattgaattcatatataaatatatgactggaagtctatagtaaagactgtgatagtgatttttctgcattttataaattaaaaaacatagtttttcatattttaatctctctaaaattaggatgcatccttcaacttctatttgcaattgtaattagcaccatgtttgtctttattagtgatgtgtaaaatagttgcacatcttacaataggaaacattttagattaaataatgtatggtatttttacaaattaagttaatggatattcctggaaagttaagttaaacgtcactgggcaagaagccacataaagagaataactattttaaagaatacctccaaaagaaaaggcagtaggaaatataccaattagaaaacataggacagtaatagcaatgagaaaaattactgtctaaattaaaactgttgcctcaatcatagaaggatatacacagaaataggaaatacacagagatagcttatcttgaatcattaccacaaagcaatatccaaaatatctattgagagaatggtaggtttttctaagcaactcaccaaaggaaggattgtttgcctggctgcagcagacagccacctactgagttatcattttgagtaatttctttttcctaaaaaatatccatcattagtctcactttttggaatttctttttttttttttatggagattgtgactgatatatgggcaccagagtcttaatttgtacaaaaacaaaaaaaaagtatttaggttagatttagttatttatatacatcagcatgaagtaaagcaatgtacttaatttcctcttaatataccttttaacaaaggaataaataatatataattcattttttattcaaagtacttcacacaattttgttgcctttatttcaccaagtctcctctatttaatacacctatgctaagaagctttggcacacactgcaaaaagcactcaacttgcagtcaaaaggtatgacttttagtatcgtactagtttttctgcttaattgatctttgaatttatggaaaccaagacgctgttctgaacttcaatttttccatctgtaaaacaggaataataaaaccaatcacaaagggttactactatattaactggatgaaactatgtgaaagcaggtagcaaaatgaacagtgcttctacatacattatctctgcagtaaaactatgatgtgtaaactcagtaaagaaaaaaaagcatgagtgatcataaaagtctaattattcattgtcatcaaacttcagatttttgtgggagattggaggactctaagggagacaaacaaatgtaaactgcagaataatgagttttaggccccgtcactgttacctcaatttgaaaacctgctaatgaggaccacaggaactcttctgccagtgaagctggtacttcctagaggaaaaatgcacaaaaaacacctaccaccgaaaacaaaagcaccctgaattatgattttcaaaaatatctagaagtttatatatcaattatattatctcatataaactgtgtttgattccaggctagctttaaatagactctatattttaatatataactaaacaaatgcctccagtgatagttctgaaacgtcattgtccttaaattttttgctaaggacattgtccaagtgtttgctacttagagactttcagaattttcatcgctacctcaaagttcaagcttttctgaggtcccagcgtttgagcctcttgaacctggaggcaaggttaggggttgggaaagtaaacttgtcaagagactctactgggcaagccctcacagcaaggagttgggaagagagctgacagcaagctctggtggctcccacagcaatgtcttacgagggctccttcggaggagttaataaataataaagtttggttcaggactccaggcaagaatgacaactctggctgaggaaatttccaggggctgatatctaaaataaacttaaagtcacaataaaatatgataagtgccatgtaataatcctacaatggaaatacacaggatagcattgtggttaagaacacagttcccacagtttcacttctggggtggcaaatgaggagttccatggacccactccccagcaaaataagcagagatgtcaaaaatgaaaaagaaatgaacaaaaaacaacactaacaaaaaagtttacattctctggaaataattgcaaatcatatatctcataagtgatatttagcatatacaaaaatattataactcagtatgaagaaatataaacaaaattaaaaaaaattaaaatgggcaaagatctgaacagttctgcaatgaagatatatttatataaatggtcagtaagcaaatgaagagatgctcagcatagttttccatcaaggaaatgcaaatcaaaaccacaatgagctatgactacaagcccactaggatggctatattcaaaatgacagataataacaaatgttggcaaggatgttgaaaaatcagaatgctgatacattgctggtaggaatgtaaaatggtacgactccttcagaaaacagtctagcagttcctcaaatggttaaaagtagagtcactacatgattacaaattccactgtatatataatcccaagagaaatgaaaacatatgtccatatgaaaacttgtactcaaatgctcatagcagcatggttgattgcagccaaaaatggaaacaacccaaaggtctatcaactggtgaatggatacataaaatgtagtataccataaaatggaatattatttggcaatagaatgaaattacatgttgataacagtgtgcagcatggatgaaccttgaaagcatgctaagggaaagaagccagacacagaggatcatgtattatatgaattcatttctgtgaaatgttcagaatagacaaatctatagggactcacaggggcaaaaagtaattcgtgattgcctaggtctgggaaagttttggagattggcagatgacagctaacaagagtggcatttttgagggggagctggtaataaagttctaaaactgactgcaatgatgattgcacatatttgcgaatatactaaagctattggattgtgcactttggatgggtgaattgtatattatgtaaattatatctgaataaagctactttttaaaaaagagagagtctggttccccagactgcctatgtttaaatccccacctctcctacctgtgaatgtaggccaggtatttaaactctatgattctgtttcttcatctgtacaatggagataatataaattacctacctcataaagctgttataaaaattcaaataactagtacatgcaaagaacaaagaccttctaacagaacctggcacatgaaaagtgtgatatgtgtccattcttcttatgcacagactgttaagggagagcatgaaagaagtatccaacttatgggtaaggcagtcggcaaggcttaaaggatgatatttaaattcatcttgaaagatgagcagggattatcaaggaatagataagagggaagggatatccagcattagaaagagtatatgcggaagtatgtagatatgatattctatcaagaatttaaagtatcctaaaagtaaattcaaatattttctgaagtatatgaaattgaaatacagaaaattccagcaacctatgtgtcatgtcttctcttttttaagagttcctttagagacaattcagtaagaaatttctctgtgactatgaaggtaatattgtatgatgtaaataatattcaccaagttaaaaataacattgctacaactctgatccagtgtaaagtttaggtaaaatagtactcatttttattattgaaacagtgtaatcagtagacatagctctgtgttgtgtacatattttgttttgtctcttcttctgagtgtactcatcttaggtgaatggggaaaatatgatttttataaacagactcttaaagaaaaatggcctatgcaaatgatgtaatttagagcaaccatagtatatgtgttcacttcagcgctcactaaataaaatcaccataagaattgatgcatgacaatggcttgacaatttcttattcttttgtatcacaccaattcttgaaatgatagctgttgcacagacatgtgtgagtattgctattgtatatgtggtagccatgcatgaccctacttttctcctcttggaagctggaacctgaattcttagactaatcaatgagtaaatatttcagagatgtgttatctaatttacttctgaaaaacagatctactacttgtctctagacatttagaaagagattgacagagtcatttgcaaattcaaagatataaaaacagtaggtagattgacttccataatcaaatcaatatttggttagaacatttcacaatattctaaccgaaattacatgaactacattatatactttcagaaatgcagtgtaccactccatctgaacaaaaacataatgttaaggtgtccttgaagctttaagtcatcttttggcaatgcagtagtttcaacataatcacaagacaaaaccagttccacataaaattcttcagaaatgaacatgaatataaataaaaacttgagagatgctactgaaatagattttacatttcagagttacaaaggaacacattagtagctattaaagcttacagataacattaccatctagcttactaataaatctcattgttagtattttctctagtctttactgaacctttaagattattaatttttttcatattttattgatatggctaggatagagttattaaataacttcttcaagttacaaatatgctaaaaataagcattgaatccttatctatctaatttactcccagccatgatgattctaacaaggactggcctaatttcctgccacaaaaggctataaaactgagccaagtatggaaaaaccttttcagacattagtcaattggtagaaatggactttgatacctaaaaggttggaaacaactaaatgatcccaacaattatcccagctttcttgctgctggcagtttccatactggagacatgaaagtatggatccaaaacagaacttgtcagcctcactgagtttacgaagtagagatcagagggtgagaaagctgatgtggttggcgcatattatctcatttttgagatatgttgtaaattagagggagctgagcaggaaaatatttacagaaatgtgaatcttgcctgagtactagaccatcaatgctagagagaaattctacaagtgtgggcaaagaatgacaggaatcagaacaatcgccagagctcacacatgatttttgagaaaggtttcatttggggagatcgtattgtatcaagaattcaaaagaaaatgtagaaagtatgtatttatctttgagttgtgtagtgatcgatagaaatttaggtgaatatctaaatatctatatagatataaagtaggatactcccacacaccttgctatttctgtgttttacatatttccctgacctcccaaaatgtccagttttttgttaggaagctgcacgctcatcttccccttctgagctccaagagcatgttgatgttcttgctgtttcatagctgatataaattagcattgggtaaacgacgaaaaaacgtcacagaaagtttttcttgttcacattttggaaatcttccttctcagtagagaaaagcaaccttaaagttgcaacatcatgattggatttcagttcacaaaagaaaataaattttgacaaatcacatatgcttttcctgtccctcccaaaatgctgcagtcttccatggcagccttaccaaagaaaaaactaagtccctaactggaacttggattctttcaaaggcacagtaagaggttttgaccaatagagaagcattgatcaaatcactatccactgcattacatggtactctaggagagtctgaaatgagaatagatatcttcaaaaagcatccaaatctggggctggtttactcatctgtcagcttctggaatagtgaacatgctattaaaattcagctccttctgggaggtgggaagataatcaaggggagacccaccatactgcatggaagtcccagaaatggaaaagctgatcaaaggaaggaaggtaatatacttttttataatatgttccttgggatttttaatgatcggtcgaaatacagaggttttggttttaaggtgttattttcacagcatctccaggtaaacttccaagtattatgttagcctggatagaaacaaaaaagtccataatgcttgaaactgaatatgtgatccttgcatcatgtttaaaattgttcagcaaggaatttcagtttctctaggtgatggaagttagcacgagcaaaggaactttacaatttttcagaattttttttttttcatgtttggaaggtctcctcctcctcctcctccttctcctcctcctcctcctcctcctcctcctcctcgtcctcctcctcctcctcctcatcctcctcgtcctcctcctcgtcctcctcctcttcctcctcctccttctcctcctcctcctcctcctccacctcctgcttctccttctcctccttcttcttcatttttatttttaaccattgctagtggtatgatttttgaattgggaaaacaaaatattcagactaaatattttcccaatgattcttatgtagagtaatgtactttgcaattcaattaaaaataacaagctaggatggtgttctgagccaaatgtaatctccaagaccatggtcagtaaagtactcaagaaaaaagtattgaggccgagtagtctgaagtctactggggaataaagaagcagctgattagcatttgaaagcaaggtctttcactgttttaaaagtgaaggagaattttttaacagaacactcatcaaaaacaaagcgtttgaaaattacccctcctttgttttatcagtctcagggaagatgcacttcgatacacgtctcaggaattaagatgcatttcgatacatgtaatattacatttggtgacactgctggaacatatgctgagaaatgcaagaataaataggactaatgctcattttctttttttttttaatcacttgcaagtgacatttgtttcatctaggcaggaaagcaggatcttataggcagggtaggtgtaagggctgattttaggtcaagcttttcaatttattatgcaataaaatatagcaataaaaatatgcatctttatattttccagtaaattataggaatctccgtttaattttttatatatgtgctaataattaattcagtactacagtctggatccacagtccttttgataagagctggcacagaggtcatttttatgtgccttattattaatcttaataatatgtagtaatattcctttatatgcttattgtgacacacagaaacttaaagcctttgtagctttaagttcagatgtctccacattcttttgtaaatccctgcagatttgtttcttgcttttaaatatcagcacctttctgctgtctactcttaggtctctgccctctatgcaggagatcttttcttttaagtttcccaccgtgcttcataataaaatcaaaagaaaaaggtacatccctcagaaagcattcatctcactagaaatagaaaacctgtcaccttattcttaaaaccttagatcagccaggccagtggctgaaatagtgagggtagtgtctacaaagggtatagagtaggggtagcaaaataattatgtaccttgttctctccacatcttttagggaagagactctttgctctggaaaatgacttaataccattgggaggaaaacatttcctctacccacttaggttcctatgtttaggggcctgtgaattaactgataatagacagattaacaggagaaaagaaaaggttaatctacacatgcatgtgaagtcactcaataatgagtcgtttcctgaatacccagaggtaaagattggtatagcaacttaaaaaagggaagggaagtgtggctagggcatcaatgtgtagttgatctccttcctgggattagcagaaagctcttggaggagagttaatagcagctgtattgggggtagtgtcagctttagttaggtaagggaaagtcagatcagatttcaaatattttcactttaatctttatgctaaaactgtgattccttcaatatgctgatgaaagttgaagtgtggcttggaaaaaaagagaaagtataagtagatttattctagatataaagcattttttaggtatagtagaaagagagaaagagaaagcaacaggcacacacacactgagagagagattttgacacgaccatgtcaaagactaagagtaccccaagttctttatcaaccatgtagtttctgcaacctgcagtatacacacatgcatacccatatactgatggaggcagtctaaattaatggttaagaatatgaacttcagcaccagagggcattggattcaaatttcaatctttcttactagctttgtaacttcaaacttttttcctcttggaagctggaaactgcatttttagattaaacaatgagtaaatatttcagagatgtgttatacagtttacttctgaaaacagatttattacttgtctctagaagtttagagagagatcgacagagtcatttgcaaattcaaagatataaaaaacaggtagactgactaccataatcaaatcaatattggtttagaaaatttcacaatattctaactcaagttatgtgaactatattatatacttttacattatttatctaccctcaagtttcagttctctcctttgcaaatgacaataacaataccaaaaaataaaaaaactaaatgaggtaatgaacgtaaagtgataaggatgatgacaggcataaagtaagctttttattgtttttatttgctttttcctgtagcctgaaaatatgttcaaggtaaaaaaaagcattcttttgctctgaatctcctttattctaccaattcttttctcgtgtaagtgtctcagactcttcagttgtcttcactttgtcatttatttttatcctcaaatcattgatatttggcttctattttcacttctccaaacaaattgcttttttgtcttcatgatcttctacgtgacaaattaaatgcatgctttcagaccttaccttcctggacctctcacctccattggaatccactggcaatttactcccagaagccctgtcctctcttgcatcttcaacatcttctgattctgacctctctattcctttgtttatttgtttgtttgtttgagacagagtttcactcttgttgccccaactggagagcaatggcatgatctaggctcactgcaacctccatctcctgggttcaagtgattctcctgcctcagtctcccaagtagctgggattacaggcatgcgccaacatgcctggctaattttgtatttttagtagagacagggttttgccatgttggtcaggctgatctcgaactcctgacctcaggtgatcctcccgccttggcctcccaaagtgctgggataacaggcgtgagccacagtgcccggcctctctattccttttacctccttcattggattctcttcttccagagtttcatccctggccttcactatactttattgaatgacttcatttactttctagaaagttataaacaaatttttatttccaaccctagcctctctctcctgcttcagactcattatccacgagtactattgaaaaaagtattctatatttaatgacaaaaaaacagaaaatatggaaaacaaaaattaacagcaaaatcataaataattcttccatcaaaagttacttgctaatattttagtgtctaccactagctaaacttaactacatttccttatctataaaatttgaggtaattgaggtcccaaactcataaaactattgagcatgaatacacaaaaagtttttaaagtacccagcacatactaagttccatatgaatatttgctgctattatttttttcaatttcaaacatgtacacacatgtttcaaattcaaaaatgtagctttgtacattttcttcccatttagcaatatgcaaatgagtatttttaattgaatagatttttttttttttgagacggagtcttactctatcactctgtcacataggctggagtgcaatgccgtggtcctagctcactgcaacctccgcctcccgggttcaagcgattctcccgcctcagcctccagagtagctgggactacaggtgcatgccactacacctggctaatttttgtagttttagtagagacgagtttcactatgttgtccaggctggtcttgaactcctgacctcgtgatctgcctgcctcggcctcccaaagtgctgggattacaggcatgagccaccgtgaccagctgtgaatagatatttttaacagatgtgatcagtagattttttcagccacttagtgaataatttctacagctgcctcaaatgtctattaatttatctagggttgtatgtaattcccagccttctaactgttgacagttttatttctcattccctgaactatgttgaaatgcaaattaatgtctttacagagatatttttgaatctctctattaaaaaaaaaaaaagaaaaaagaaaaaaacaaaccaatcccgaacttcaaaatgctattcttggttttttaaaaaatgacctatagtccaactctgtgtagataattatgtgacagggcattgagacactgaagttgacagcccaatgtgctgtgctgtgtcatacagatagacttaaaaaaaaaaagccccaggctgggttctgtggctcatgcctataactccagcatttggggatcacttgaggtcaagactttgagacaagcctgggcagcatagtaagacccatcccccccccccaaaaaaaaataccaggcataacagtgtgtgcctgtattcccagctactcaagagtttgaagcaggattgcttgagcccaggaggttgaggatgtaatgagccgtgattgtgccattgcacttcaacctgggcaagataacaagaccccatatcttaaagcaaaacaaaacccatctctgattgtagcgtatttaggttgttttcaacttcttcctagataacttgcaatgaacgttttaaaaatatatacttgtgcacatttatgctcatttatgattatttagatgtacaattattagatgagataatataaaaaatttacagcctttcacttttatttttctttttcttttattttactttaagttccaggatacatgtgtagaatgcgcaggtttgttacataggtatacatgtgccatgttagtttgctgcacctaccaacccgtcatctagggtttaagcaccacatgcattaggtatttgtcttaatgctctccctccccttgcctaccccactaacaggccccagtgtgtgatgttcccctccctgtgtccatgtgttcccattgttcaactcccacttatgagtgagaacatgaagtgtttggttgtctgttcatttgttagtttgctgagaatgatggcttccagcttcatccatgtccctgcaaaggacatgatctcattctttgctatggctgcacagtattccacgatgtgtaagtgccacattttctttattcagtatatcattgatgggcatttgggttggttccaagtctttgctattgtaaatagtgctgcagtaaacatctgtgtgtatgtgtctttatagtagaatgatttataatcctatgggtaaatacccagtaatgagattgctgggtcaaatggtatttctggttctagatccttgaggaatcgccacactgccttccacaatggttgaactaatttacactcccaccaacagtgtaaaagcgttcctatttcttcacagccttgccagcatctgctgtttcccagctttttagtaatcaccattctgactggtgtgagataatatctcattgtggttttgattcgcattgctctaatgatcagtgaatgttgagcttcttttcatatgtttattggtcacatatatgttttctttatagaagtgtctgttcatatcctttgcccacttttttatggggttgaggctttcacttttttattgtgaatttgttttctggaaaacttttaccaattttaattcacataagtagtgcatgagaaagtctactttctcacatgcttgctgataaatgttaacattcatttttatccttgccagtcagataagcaataaattaaatagttcttgttattttaatttgtattccccaaaggtatgttaagagagcaaaacaataaataattcaccctcaatggttgctgttaaactttgtctttttaaaatttaagctttaaagattatgactttaattattttttcttctcataaataatatttctcttctaaataattctaagtcacaattatgtagggataaaaaagaaagtatacattttaatgctttcctccattaaatttgaatgtgtgttaattttgtattcagtgctgcaggtttttacagaatactgtctttggttccatattgaacattcaccttgaggactttagtctattgattgaaagctttagttcatctaatagaattattatgacacatactccaactaaaaatcagtcaaggacagtcccagaagttaatactcttccaaagactgatgcctccactgagcacctctaggaagtatgagatggtgttgcatcacttctcactaagttcttataaccccacatccaatatatcaacaaatttcatcagctctaccttcaaaaattacctagaatccaattatgtcttattaaatccattttactgccaagtcacttctgatttattgcaaaaggctcctaattgatctcccagcttcttcacttgcctcttccagtctattgtcaatagtaactgtcaactgtctagtaaactgtgaaaatatatctgatcatgtctctcctctgctcagagcccatctggcttcctatcttagtcaaagtaacagctgacatcatcatagtggcctaaagactctagtgaagctctgccccatccaaatacattgcctctcagatatttcctaatatgtggctctagcttccttggtcctagccacgctagtgtctcttctgtctcttaaacaagtcagagactcttaactgctgtatttatacttactctttcttctgtctgaatgctgtttctacagaggtgctttctaattgaaggtacaatcatttctcacatatgccttcttctcattatttgtttaatttctcttcacagcacctatcatcaccatctgacattttatatatatatatatatatatttccttttttgtttgttgtctgtcactcccactaaaatgtaggtctagaagaatagaaatgttcgtttgttgtttgttttgttcactgctgtattcttagtgtgtgcctggcattaacactcttttgaatgactgaataaatatctgaatttctgctatttccctataagtaatattattttggatagaaatgccactaatcctgaaacattttcaagttttatatggtttttatctttaatatttgtgtggctttctgctacattccaatatttaattagctttagtttacatttattaaatgcttctatatccagataatgtcatatcataagtttcagttgacatttattaacattactacttcttataatattttaacagaaatatgattcatcaactccagtgtttgtaaatatcatcaccattctgaagtcaaatgttgccaaagtcttccattaaatacttgcagacttctctcatttggtacagccagtcactccttacagctgcaatatgttatatctcgaatgtatttcttgatagctttctttaagataactgcacttgcaaagttctttgtacctagaaaactttcaacaaatatttagagaatataatttactcatgcatgtggatagacacatgtaagattcacttaagtgtcaaatttactaatataatgaaaacttggaccaaacaagcaacaaaaaatattatccagcactcatactcaaaacgcagtctgagagtttggtatttttcagttcctaaaggttgatcatgtggttcataaaatcttagtctccaaaatgtattttcaaatgaatgtcaggcagaaccaacaaatgagaactagggtacttaggattattgtaattgcctaatgtgtttggtgaccttgtattcccacttacagcaacttatgcttctttcaaattcttttgtacaaaaaaaattgtcttgtccactctccacttagcctttaagtcactaagatgtggctatttcattagttgaaagcaatgtctaaaataaaatattttattttaaaaatcaatcatcttgcataataatagctttaactttatgctcaatttaaaatatttgtatttaaataattgcttacagaatagaaatagaaatgatatataagataatatagaagatgtaaggatttaagaagttaggatgacagtatttttatttacttttatcatttgtaattgtatcttattgtctggtaaaaacatttaaggaaagattaaaatctaagtttaatgtattatttataaacatttgctccttcataaaatcttcctgcaatccctctttttaaaaatgttttcattgcatatcccgatgatctgcttttcttctctccatgaaactcagatactagttttctttacaacacctggattgtttcttcctctactgctgttccttattttgtttttctattctggtgtcttgatatctccttttaacaaattccataccattggccttcctaacttgtgaacatttctaatactcacatatgctctataaaaaaaagtgaggtttttccaagaagaacagtggccattaattctgcatatatcaaaatggaatgtgtcatctttgagcaaaatataagctcacaccatgcataaagacaactattgtttgcttcagccaggagtatgttttagggaaaaaatattttaaacaagccattaagaaatagtctcttttttctttaatgtctttgagctacatatgtgagcagaattataaagaatttccagtgactcattcttagttttggccttcctggcattctgtagtcgtgcatattaaaacctctaaacagctctcagtaaagccttggcagtagagcttgtagcttgtacctatcaaaaatgtcagatgcttttttccaacgccatcactagcaaacaatattacttagttattaacatataggaattaacggcaaaatctgcaagttgcaaacagtgttgtaaatcaactaagcatttatcatgagattttttaagtgactgaatacagattcagaatcatgaagttattatctaataacccaacaagtgatgtgaataaatccttgctaatatgaaaattatcagccactgaaacacccttttctacaagcaggtctgtggatcctcatgctaatgtacttagattgataaaccacagacattctctgaaagcttcgtttgttccagttgctgaggcttgtgcttagagcatctgtcatgcaaatgatcagcaaatcataacctgtaatttgttttcatttaataggcagacaggttttcaccaatttagactcaagtcctattaatactctttgaaactaattgctggaaaatgaattttaatgacaggattttatcatttattattttcccttctgtccctataaaggaagactcaaagccatctactcacactttgaaaatatatgttaaataggcacaagccataatctcctgtcatctgggctgttgcaaaggacccctaatcccctctcttgtaataatccattctacactctactcttaaaattactttcttactatcccatttcccttccacaaaatcttcaattccctgtcaagtaaatagcagacactttaatatggcttcgttgccctccattatctgtttgcagtttacatatttttatccttatttgatatcgcaatataacatgtatacagaaaaaagcatgaaacattaattaataagtagtaaagtaacatccagaaaacactactcagagcaaaaagcagacgattgtcattaccacagaaaccacctccccagtgcatctttctgatcagacccttcccagcatcccagagtctaaccacccagagataatcacttcctctattttctttagattgtctccagctacgtgtgaattcttaaataatatggtcaatttacccatttttgaatgttatgtaaatggaatcaaaatctgctttctttggctattgcttttttcactcaaattattctcttaaacattcattcattttagggtacagcttcagttaacttcaattttaagctgtttagtattccactgcatcaatgtaccacaatatatttatcttttccatgttgatgggcacttggatttttagattgtttccacatttgagctattacagacaagggtgctatgagcattcttggatgtatagtttggtgcccagtattcttttgtattcatacctaaggagtggaatttctaggacttagccatgcatattcatactagataaatattgatgtaatacgtaaaaccaagtaatattaacttgtatataagtagctctgtatgctactagacaagtcaaaatatttttcaaaatggttgtaaatttatatatcgagcaggagtgaatgctattcactcctacttctatttcgacttctagaaataggagcacttctatttctttatatgcttgacagtacttgggattatcagactacctcactttctgttcctcctctatttattcttgctttaggattttctatcctcttgtttattcttccttcaccctggatattaattctgacctattgcaattcatgaattctttcttcatctgtttctaatctattaatgactcagtcatatgttaactttggtaattgtcttttctaattctcaaatttgtttagttctttttcaactgcgtaacaacactcctttgtagtttccagtttcctgccaattaaaaaagcattgcccttcatttcttcaaacacaataaacataatatttccaatatgcatctgaaaattctagtatctaaattcttgaggatcaatttctgttccttgtttcttctgcaggttctattattgaagaattattatgttggtgcaaaagtaacttaggtttctaccattacttttaatggcaaacaccacaattacttttacactaatctaatatttcttttcaccacatttctttgatttttgtttggacatcatattcaaaaattatttgaaggaatcatgttacacctaaagtaatattacctttttctagagaggattgtgtttttctctgtcaggaatctggagcctccatcagggtaccaccataaattgtgttaaaatttgagattaaactatgcagtcctggattttaatccataggtggaaaaaaatagagtttcaaagaggtaagcttcaattaagacagattatgatgcctccttcttctgtaacatattgtgtgactttgagttgagattcttcctaagttttctgatctattaaaaaagatatagctggtaatccccaaaatcatgattttccttttttttttttttttttttttacagtttctactgtatttctttgttgtcctgtcagtaccagttatggtgtgtgttgctttttctttctttatatttttgttgagcacagtgattgagtacatgccccactaatagggtataattattttgagagtaatatctatgacttaacaccatatctctcactatattgagtgtagtaccttgatgcagtagctagctgctcagtgaatgttaaatggataaatcaatgactgaataaattttagagataggtacatagataaaagtgatcaaaacaagctaagtattactgcagagaaggaacaagtatcttttctattatagttcccaaagcttcaaccaaatttcttttgctatgtttacctgtccaatatattggctggttgtactcatagagtactagtcttagttagaatttatgagtaatggtccaaatccgtaatagagcttaaaactaaagctttaaaaacattgatccagatgaagaatgataggatgcaatgaaagtttatttagggcataaaatttaaaaggtatgttatcaataattcattttgaaagtccccttaatatagccatttctattctgtatctttaaccagttataggtgacattgctaggaacagattttgacagcagacttgtgcaagggatctgtttgcctagagatttacttaaaaggtagaattaaagtcatttcaagaaagaaatttaacataagaaaatataaccatttagtacactaaataattggtctagctagttatgagttaaaaatgaaaaagaattaatagtttttagcaacatatacattgggacagtatttttgccacatctatcatttacctatgcaataattaaattcataattttttaagtgtcatatcgaagagtgttattcaacttcctggtgattaaattactgataaacatagccgattttttttggttttgcaggtcctgaaaaatagagaatgcatatgacttccaaatattggtagaagagccagtcaaataatatcttccatgaatcctcttacaattaatttgctgattgatagatgttcaaaatctagaaatgaatgagttgcatgtaaggaaatcagtacatgcttctgctgccatcatatatcacaatacaagcattaaaagctatattaattatagaactttatgatcttatttacatggtctgtgaatttgatctttattttggaattcctttaatccattctgattctaatcacctcaggaccaactttagtgtatttgtacaaggcgtaatcattggctagctctataagttgtccaaacaaccaaatgagatgtcgcaaattctgccaattgtgtaaagttttattatgtactttaaatatatgaatatttggaatatcaagatgtgttgtattttaccaataatattaaaggtttgcttgttcacttttcacttgtattatgatgtcatttaaacaagtcagtattattagaaatctgattcattctgaaaacctctcatctactgatctaatgatcttcaatattcattaacatgaaatattactataataggaaaaaaatcggtaccttaacaaaaaatatggaaatttatttgtttatttattatttttacttatttatttatttatttatttatttatttatttatgtttttgagacagtctcactctgttgcccaggctggagtgcaatggtgtgatcttggctcactgcaagctctgcctcccaggttcacgccattctccggctgcagcctcccaagtagctgggactacaggcgcctgccaccacacccagctacttttttgtatttttagtagagacggggtttcaccatgttagccaggatggtctcaatctcctgacctcgtgatccgcccacttcggtctcccaaagtgctgggatatttctttctttctttcttacattctagagccttggcgagttggcccaagtgttgtacagcattttcagtgtcagggacatagacttctctcctttctctgctgtgtgtagtctcagatagttaccagagcaccagccattgtatgttctttctagttttcaggtagcagaaagaataagaaatgttgcacaaaccaccctgtttacatcacgttggccagaattagtcacatggccatgaagcaagccactttgcctgaagtaggactacagattgtctttattctccatagtggtaaaatataaaaaaatataattagagaagaagagaactcctctggaggacaactagcagtaacctactctactaactgtccatttactagttcattttgctctaagataacatataaacagtgaaactaaaatatgttttcaaaattagaaaatgtaagtaccttagataaccaagattaaagaaatgttacaaataccacaatatcaacatagttatagatgaacatcaaacttagtactgattttctgaatatccaaaatgaaaagaaatacctcaataattggttacattgttttttatcattttgaaaaaggcactactgaggcaaatgaagctctttgaccctgaacaattacaaaatttatctcatagcaatttttagggagaaaattgtatattatagttgacaatattcctataacaggtgcagtgattttataagctacttacagtgtctttgaataaaagccaaaatgaaagcattatgaaggctattttgtgaatctctgaggaaaaatcattcaaaaaaaaaaaaaaacctttggctattctggcttatatacaaggagaaattttagcctgcccagagggctggatggactacatacaccatgaatggttatctgtaaatattactgttgctgaaagatttctgaacaaatgtagaaaattaaggaatagattatctagttttctgtagtctgccagcatgtttcaaatcaatcgagctttcttaacaccaggtgttctcagaagtgaaaggggcctatttgttagctttaaaaagacaaaaatgggaaaagataaaagaggtggaagcagaaaccaatttgctaaatttactaaattagacagtttattgaaaaggtaagtgaatttctcatatcagtcataaagaagctatttttccaatgaaatgtgtgtttatatcaaagtcacaaaattacttagtgaataactcccagtaaatgcgatattattaatttcagctaaattatatgttcttagaatttttttatcttttcagattgttttatgtagattatagctgttaaaattttattggatgtaatttacatggtttacaaacaataaattcctgagaatagatacgataaatttatagtttgttgaatgatttattattaaggagtctcagattggtcctccgaggacaggaaaaataaattcatggaccctaagttttttagttacttttatctaatttttgatatggtaataattaaaagggagatgataagaaattgaatgattaagcattgttaaataatatgatgcgttaataatgcataagttatattcctgagttgattctttcaaagtataaaacaatttttagatttaatcaaaactctttaaagaattaatctttgcttttagggagcactatagattgacatcagaaatttctcttatttccatgtaggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaaggtaagaattactttatttatttgtctcatacttaaaggttcaattatttgtctcatacctaaaggttcaacagtaacaccttgaagctgatttcatataaaataagtgtgatgtatttaggttggttaagcattaggtggtggaattgagtacaaaagtctcactcaatactattttatgaactttgtggaaagaaaagtagttgacaaaataaacctaaatgttaaaatatatcctgtaatagaaaagggtttagaagaagaccttttctttgctcaacttataccccaaaaacagaaagtgtatatgatacgtgatgaaatcacaatgtaagttacacatgcaatttgtactattttttttctttctttttttttttttttttttttttttttttgagacagagtctcactctgtcctccaggctggagtgcagtggctggatctcggctcactgcaagctccgcctcctaggttcgcgccattctcctgcctcagcctcccgagtagctggactacaggcgcccgcccccacgcccagctaatttttttgtatttttagtagagacggggtttcaccatgttagccaggatggactattgttttctttttaaaaatgtgatgttattggaaaaaattaaaacattcactgcttagaaactaatcatttcattctgtaatctaatcaagataggtatgtacatatgtatatatttttctttgttctttcaattctcagaaaggtgtttaaaacctctatgtccttctttagtcctgtcagaatctgcttcagttttttgaggctctgttattaggcacatagacatttataattattacattttcctgataaattattgaatagttgggtttaggtttataacttactgtttggtttatatgtataccatttttttctctgttgcttcttttcctgtttttcttggggttaattaaatatatttcagtatttgattttattgctcttactgcctttttagttgtctccctttgtatttttgttcgtggttagtctaaaggtcataatatgccttcttaacttactacattctatcttaagttaatattgtactacttcacataaaaagtaataaattttcagcaatataattttatttgtactcactcctttttgatattgtgttcacatatttatattttattaacctcataccaaatatcatagttttttatttaaatatttattgtcttttaaaggtacagaaagaaaaaaaaaaagacagttgctgggatataatcacttatctaccgtgtctggggctctttattccttacatatatttgagctcccatttggtataatttaccttcaacctgaagaactttctttagagtgtcttgaagtgcagggctacgtaggtagcatatactctcaacttttgtttaccttgaaatgtcttttttaaccctcatttcaaaatgatattcttactggatatcaaactctgaatttacagggttttttaatgttcatcattttaaagttgtgattctatcagttttgccatatattatttctgatgagaaattagccatcatctgtatcctgattctttatatgtagtatatttttgtatgtgttagtggccattctacaagtttctcttcattttttggtgtttagaaatttaattatgatgttctagatatgattttctttgcatttattgtgctgagagttcactaaacttctgggataggttacatttagtaaatatagagaattatttcttcaattttttttaccttctttcctttctcttcttgatttgaggctcagagaatattcaagttagatcacttaatgttgtctcctaagtcactgaggccttgcttgttttattaagatatttttactccctgaccttcagatttgacaatttgtcttgatctgccttcaagtttactgatattctgccaccttcaaatttttgttaagtcctttcagtagctttttcattctagattgcttattttttctttccagaatttcaattttttgaaataatttttacttttctgctgagatttcctatctttttatcagttatgactttcttttcttaaaagttcatgatcacatttataatggcttctttaaagtccttgtttgctaaaatttcaacatcttatcatctcagaatacattgcattttcctggttcctcacatttctggttacatttgattatatattggacttcgtggttgatacattgttaagacttgggattatgtctctgaaattgtatattctgaaaaggattgatttttgcttcagtggatagttaaatcactatctgttctcttgaatttgtggagatttagctttaaacattgttaaggcaggtctatttgatgtaatcttggtccctagggcaaatcccttggttttcgtagtccacatatttctaagatataaccttctggagtttctggggaaagcctgtggttctcctcaagcccttctgacttaaaggaactcaaaattcaatctgtatcttccctgtcataggcaacagttgtaatcccctctttagcacgtttagccttctagccattactctttgctaattttcctaggatctctcccatatatgtgcagtttaggggtcagctaaggattttagaaagtttatacacagattttggggctcactcctctgtggcatcctccttcttgtgtttcccttttcaatttctggcaaccctagctgattcaaactccatcctctgacaagttagttaataagactgactttctacttgagctctgtcgaccccatccccgctgaactgaagtgggtcctcaatgactaagcctaataaaggagggctctaccccgtgcagttattattttcaagggtaccctgcagtttctgcctgctttgggttgctctccagtcttttctatatatttttttcaatttgatcctgaatttttaatttttattctgatagggctagtccaataaaagctagtacatcattgctagaattggaataatttctcaaatgctttaaagtactcagaaggctagaggatctaacctaaattgtttgtaaggaatggagaagagtagaaataaaaggtttcttaaggcagtggtagggaaaataataaagctatttctatattctataaaatcctaatgaatttggtctatttaatacataagttacatatagaattgtattggaaagcattaatatcgttatttttaatacaaaatgggcaatcgtcagtcctcttccttcttattaaaaccgtgccccttcatcttctattcttttaaaagtcacaaattcagtgttccacctttatctttctaagggctgtttcctgatctgaacccagattagcaattacgttaaaattagtgtaaagaaaaggcattatacaaatttattctatatagatagtggttaaaatccttaatgagttattatgctaataaactacacttgctagatgcaaattaaacataaaaagcattcaaattagtatgttgatgttgtttttaatttgttttatgtgcttacactagttagtttaattttggagacttactttttcacctataaaaatgaggagtccaagtatgttaatggtaagatcacttccaaatactatgttttgaaaatataagtttatcgtatagcaatcatacacaagaaatagaatgttcttcataaacaatcaatttcaatgtactatttgcatgtaagagcatgtcattattgtatgataatttatagtttagagggagtccttttgcaaataaaaaattgaggcttaaagaagcagacatatgatttttagacagaaaaaatataaaattattcattggaactaggtttttattttgttcaaccggatatttagtcactctgactaggcttcaggaaaactattaagcaggtggaggagaagaaacctacaaaaaagacttagttggagtagatagagagattaaaagaaaattgagaaaatgggttgtcatgaatgccaacagaaaataacatttcaagaaggaaagagcagtcaacattagaaaatgactatcaagttaagggtacacaacattcccttaactgtattctgactgttatcagtagagatgtaagttataatttttaacaattacaaatgttaattcaattacataatgatactttaataaaataccataaaataatttagctttccaagaaaattcatcatattcaaactttatgaggtgtatttacccctataaaccaaaattacaccgttgaaatggcataaaaatgttatgatggagctccagaaaagcaagcttattattgttattatatcttctgataatatacatacttttgtgaatctaagtatattttaaataaatgttgccactaaatatctctgtacaagacagtaagaattttaaaattaacaggattaactcgtgtgcctttctaaggggctaccaaacttaaaagaatgtttcacatagtgcaattatatatatcataatgattatgcacgtaccatcacattaaagaagagtcaaagaagaaatgttggaaagtgagctctgaattcatatgattattccacagtgattagatctcatgttagagagctttctcattaaaaccagaagtcagtggtccagtacatacatacttttaagagaggaaaatgcagtcagagagagagagaaaatgattgatatgatgtacatatggagtctatttaaaaactaataatatagtaaagtctcctcaagtccttctctgcctcactactcttataattttctgcaattaatgtgttcttaaaatttatgaaaacacaaatctggccaaaagatatgaaacagataaatgagagatatcttctgcctagtacaggagaaatatttaagggtgagttaatgtaactgagaaattattttctcctagtttagaagggaagagaggcccacagagaactttcaataagaaataaaaagtatatcaagtttaggatagaagtaccaaaaaaattaaaaacaaagataactctgaattagatacagttggatgtttgatgatatagtttcttctttggctggctttcaagtcagaagcttttaaagtggagtatttaggggtattagaagactttccaagggcaagccagtatattcagcacagaaaaatttcaaggtgttgagtgacattttgaaatagaaactaaaaacttcctttttcatatattaatttgtttggaaaagatttctataaagtaaaaaaatacagaaattaaatcttaatgctaaactctacctcatttaaaccataattagtactgacccatggatatctaaattatttttttaaaaggctctatccataacattgtaagctgcatttgtagtaaaacttcatttttatagacactgaatccatagatcgtatactaattgaatcatgactcaattcagaaaaaaagattttatacctaaaactttatagtcactggttatttaaaaaggattgtaattttaatttgtatgcatatttttgatgcaaaaatactttggtgatcaagaaaagactttcaaacacacatttctattgtacttgaattacaattgtgtgagggtggggcggaatataaatatagttcaagcataaaataaaatgatataaatattctacctattaaagcatgaggtcaaatcactatgatatttagattctaacagatatatttttaaaagtgacttgacaatattattttaagttatcaatatttacaacacaatatacatatgtcagtgccgacgcccactcaggaaaatgaaaaccattcctaaaattttgaaaagaggagaatttaatattgtgggttgatcacaaaggcgctagaaggaatcaaagagcaaaggatgaacagagtaggacattggaaaagcaaaaagaaaaagtaaaacacagatatcaagtgttactgatgtgtcagttgattgtatctgccagacgtatgccccttgatcagacctggaattgccaaaaagttgctgcccgtgccctagctgctgggatcaagaatcgcctactgccactgctgctgcagccactgaaataaccatttaaagcagacggctcttctctttctttttctgtctgatatcttcagtggtttccctcaggtggaaattatggagaagccagatggcaaaggagcctgggaaatctggtttgcagattcccatccctataaggctcacagtatatagcagagtagaaaatggtatgtataggtttaagagaaaacaggtaatgatcagtactgtctgcaaattgcgccctttacaattttctaaatgattgcaaaattaatatgtcaattataaatgtagaaagatacatacttaaaaaattcctttggggtttatatgaagaaaaaagcttgatggttattacaatggaagatttattttatataaagaacatgactggtcgttttggatttaaaaataatctgttccttcagcctaattttacctgagcgtttccaccacctggaaattaaatctcttcatgctaactgattatcaaatgctaaattatatgacaagaattttactccccaaggaaaatagatccaacaatggaagaaagccagaacccaggaaaatggaaaaaaaggaggaataagtggactaaattataaatctgtaaaattaggataaagtactatacttagcatgtaagtattaatagtgatgtttccatgttaaaatatagcaccattgagagtcctatctctcaatttctaaacttctagtataacactaggcttttcttgtcactgtgcccacccacgtggtttcatgagagtaaagaatgtttttgaaagtagacatataatattggagtataataagatactatttagtaattataatgccaataatgtcattttctgagaaagaaaatgctcccaagactaaacagagtaaatcagctgcttgggactacacagctttcctaatttttatggttgacacaaagtttggcaattctttagttttactaggtaaatgaattcctatgatgggtattttagttcatcaatgcattaacaatagaaagcatatatttaccgggaggctttataaatattttattttattattttatttatttatttagagatggagtcccactctgttgcccaggctggagttcagtggcgcaatctcggcttgctgcaacctccgcctcctgggttcaagcgactctcctgcctcagcctcccaagtagctgtgattacacgcacccaccaccatacccggctaatttttgtatttttagtagagacagagtttcgccatgttggccaggatggtcctgaactcctgacctcaggtgatctgcccgcctcagcatcctaaactgctagaattactggcatgagccactgcgccctgcctataaatatttcaaaacatatgccacttaacatgtgttaatcacatgccatggtcaaagtgctatggagggatgcaagtgtgaataagacatagacattgatcatgaaaacattttgttgatggtctctatgtgctatgcactgtgctaggcactggagatacaaagataaataaaacatggttcttgcccttgaagagatcttgtcttaatgagaaacacagaggttaaactagacacttataatacaatgcactaggtgcaatgatagagaagcactaagaaagcaacaaggaaggtagagtaaaggtaaatttcctgaaggaggagaaatatagcctgatgacaaaataacaggtagtaattatctaggtaaagagggattggcagaaagtgaaggacgtctactgacagacacaagagtagaagtaaaggtagaaaggttagaaacagcatggaaagcaggccaaaatttatgagaattttgcagctctccaagcaaaaagtgatgagaatctatcctaccatactaatgttgtgaagagaatgaaagacaggaaatcagagataaaaaggaggtaggataaacagaatttattggctaaagtgaggagaagggagaagtctggaataattcatcagttcatagtacaaatacataaaagggtggttgtgtaactaattgggacagagattgctgaaaaagatttagaggaggaggacagtttagaatagggtgagttggatatgtagcattctgaagctcactgtgaaagtgccataggaggtatacatttgggagtcagcaacctgtgggtggtagttgaaatcatgaaagtacatcagattgccaaaaagaacacatggagtaagaggatcactgggctaatcttaggatgaaacccagagaaagctgtcacttaagaattgacaaaataagaagaatttatgaaaaaaaataagaaagtttcaaaaaataagctatgactagcaatgtcagaactatttgagatgttgatgataagaactgccaaatgttcactagattggccatttgggagttgttggttacccaagccagaactcttttggtagcatagtgggagaaaaagccagactgcaaaagatgatggaaaaacttggatgtgaaaaggtgaaaatgacatgcatatgtattattttttcagaaattttagatggagaggggaagaaagagataataattggaagggtcattggttttggtagagtttttgtttgtttttaagttaaaacagagacttgagtaaaattataagctaaggaagaaaaagaaagaaggaaaatgtaatataagaaagtcagttaatatgtgaaggataaatatcctggaacagattcaactccatcaaaaatgattaaactgaaaattgattttaatgaggtaaagatgttactttgatactgaatataatataatgagaatgtgtatgttaataatagataggcaagagaatggaaaattgacaaagatactttcttattccttcaaatttattgataaaaattggagattacgtatgttgacagtgatggggacatgtattatgtaacagtctacaggagagtggtgaagattgaaatagacattgaggaaagggaaagtgactgctaaatcagaacagataaaagaatagatcagtggcactaaagactgagtggaggtttatatgaaactgacacttttttattgctgctagtttacacaacagtgtgactttcttcagctgagattgagtgcccaagtctaggagcagagatgaaaatgttcatatcaaggttgagacatggtggataaacttggtaagggaattaaatgagatgaaagaagagctaaaatgattaaggaagcatagccatgatcagagacataaacttggataaaattttggaaatgttaattagaagatcaaatgaagttgaaaaacaggtgaagtatgagtgaagaaatgaaagagtaggttagaaagacataaccagagactgaaatacgaaagttctagaatttgaccttgaggttcatggcagagtgttagagaaaacaaaagaaatgagtttaaaatagctcaaaatggagtgagggagggagggatgaatagatgaagcataggggattttcagggcaataaaactattttggatgatactctaatgatggatacactgctgacattatacacttgtcaaaacccatagaaagaatgaactctaatgtaaactgtacaccctagttaataatcatgtattgatattggttcattggccaggcaaggtggctcatgcctgtaatcccaacactttgggaggccaagatgggaggatcccttgaggccaggagtttgacaccaatctgagcaacatagagagacctccacctctaaaaaaataaacattaaaaaaaattagctagacatggtggtgcatggctctagtccgagctgttgaggaggctgaggtgggaggatccctttagctcaagagtttgaggctgcagtgagctgtgatagcaccaccgcactctagcctggatgacagagtgagatccgtctccaataatgattgtaaggttcattaactgtaacaaatgtacctcaccaatgcaacatagtaataatagggtaaattattcacactttctgctcaatttttctgaaaacctaaaactgctttagaaaataatatctatctgaatcatgacccaaaatgattgttgtaaggaatatctacattgattctgaaatatattaggaggttggtcagtttttgtgtgaagagaaacatttagccaggtctcaaagttttcagagaaggagaagaagatgctattgtgaggtttgtctggtggaggtgatgagacctcagaaagcacatgtaattgacaacataaaacaaaacaaaacaagaatggagatagcatgaatagagtctcattaataaataacaaaaaacaggttccttgagtatctaagaaaggcaaaattccatggcccctaataaatagtgaaaatgatggaagagaattcccacgccatgtcagctcaaaacaagtatattttttgcccaagccatgctcaagctcttgctctttttctatgcctcctgtgctcatccccactcctattgtctaggatcccgcacactgggttattgatgtagctagtcatgacacttggctgatggagttcatttcaataccctagtagctaatgtcaatagaactttcattgattttccagtgtcctttaattcgttaggtattgaccttttatttaaatcccacatgaccattccaaacattttccacacttttcaagcctcaatttctagtcccttcattttttacaccctcgtcatgttcagttgttaaactctatggtttactgcaaaagctgtgagaatctagcgtaagtcccttgtgttcttgatattcaacctcaaaatccttccatgattctctcatctttagtgacatcaaaggcattagttatggatactgttgacacatttaatacccatgtgagcctaaaagagttttgaatcctctctgagtcacaatgtccacatcagtggaatgaagctattgtgaagatgaaccaagaaaatgaattcaagaatgtgttgcaggaaaaacaaatagatcttgttgtatttgttgactcggatagattggtaaaacttcctcaggttctgtgttttaaaaatgtaacagatccaacacatatttggaaggtagtctgataggatttgctgtggggaagtgagagaaagaccaaagccgagaataatggtttccagcttcatccatgtccctaaggagatatacctaatgtaaatgtcgagttaatggttgcagcacaccaacatggcacatgtatacatatgtaacaaacctgcacattgtgcacatgtaccctagaacttaaagtataataaaaatatataaaaaaaatttaaaaaagaccaaagccaacaatctcttctaaactcatccctttttaattttgtcttttcagccacagcagcagaaaacaaaaacaaaaacaaaaaaaaacagcctttatttccattttccccagctccactcactatcttgttcctagccacaattatctcttctctggattgtagccgtagaggtccaattactctccctttccactcttgactgccttcaatatattttaacacagcagccagagtgatccagtcattttcctgctagaagacttttgatgggtttccatcccactcagagtaaaaactgtccttaaaattgtctacataatctgcccaatcaattccctttgtgatctctttatctctccctctgtcaccatgctccaagcttatggtaccccttgtacttccttatactcattgaacttggccttttcaatttctgtctctcctatctgcctaaaatgatatttctctgtccacctcatttttttttcagcatttgcttaaagcttattagagaggactgccattgccaccctcttcaaaagaacaacttccatcctttgtactacctatctctcttattctgttttattgttttttataacacttacaattattttattatgtactgacttgttcatttgtcttcctctggtaaaatgtaagctgaagttggtctgagatttcatatatttggtttactactgaagcctcaatatctagaaaatatttgtacataaaagaatgaatggtggccacatggcatacattaggtaataacactcccctaattaataaccattcaatgggatctcattgctctttaataaaatcaattaacctactatagcctactaaatttggactttatataaaatgtttttatctttgttgaaagactacactttgagcttttgttcctattattttaaatattttgtccattaattaaacagcttgttatattcagctactctcactttacttcaagttaattgagaatggtaccatttattggcacagaagaaatgaatgaaggaaatatttggccaggagttgcagaatgcggaatcaaaactactattttagaaatcagtaataatacccagatgctattctaaagctttacaggtattgactccttacatgctcttactaatttgatgaaatagatagttaatatgcccattatgtagatttaagacatcaaggcttagagaatttaaataccttgctcaaggtcacatagccaataactggaagaaccaggatattagcttaaattgtttgattccattctcttaacaactatggatatacctctttggagctatccaaatggaaaatgaaataagtaatctgatatatgagtctggagttcgggtaaggatatggaatggacacatgcatttgaggccagtctgcatatagatgaagtttaaattgcccctctacctttctttatccctacttctcttttattttcagtctctttcaaattctttgctccttccccatttcttaaaaaaggtattctctatcttgaaaataacctgctcatgtattctaagctaaattaattaggtgtctttggttgcaaatgacaatccaattgaagtgaaaagataatttaattctcacaaaactggcctattcagggatgagatccaggctcctttcatcaggctttggtatcgcttgctccatctctcagctgtgatttttttgtgtgtgtgttgccccagttctcaggcaggctctcctctcttggcagtaaagtgacttttagtagctcttaggcttagatttcatcctcttatctatcccaacataaacatagattctcttttacctgcagttccaatacagagcctcagctttaacattcactggctctgactatgaagtattgtgttcaagaggaggcagtgttctcaatgccaggcctacaccacttgcccaggtggagcactgagagtaggggtagctacacgcaaaacacctagagcaagcctcggggagtagtgaatcccaaggaaaagtaggatgctgttatcagaggaaggggaagtagataccaaacaggaaaaacaaaagatatccttcaggggcttaaaaacaatagaataagttacaggaaactatcaatagttacatgtacacaaaaatttaaatcgacagtaatacaaaatcataatgaactaaattaaactacaaacaaaatgctagaaaatatttgtaaaagtgtaatggtgacttgtttgtgtcaccgcttcactgctacatgaagtaaaaatcaacaagaaaatactaagaccccactggatagatataaaagatatgaacttagagtttcaaaaggagaaactagtaggcagtataaatccgaaagcaaatatattgcaatggagaagggcagttaatcattttttagaaagttaagtttatgaaatatgattgatatatattttattttacaaaataatgtaaatgtgttatatatgcttggaattattttatatgttgtatttcataataaagtagaacatcaccagaatttgatgacatacttgtcatcaataatagatttgacaacactgcaattaacacaaaacccacaaggaatttaaaagcatagcttgaaactgaccaaataacaactatactagcactgatatagagcttacttattcctgacacagtctcacatactatgtatttattacctctcagtactcacaatgataagtactactattatctcaatgttgtagatgatgaaacagagagaggtgaagtaacttgcccatagtcacatagccaagttgtagagaattaattattcaaattcaggaagtttggctccagcatccaagtgcttaactcctttaccagtttccagagaaaaacagttttgtctgcaaagcatttaaataaacccagttacatgtcagtgagaaaaacaatactcaaacagttcagagctgtttttttttaaacctgcatatttgaagaaggttcagataggagttcagacagagtatgagtagaagacaaaacataagattacatagagaaagatttggggtgagatgtaaaagatttgcatttctaaacttctcgaaattcacacttctttctcaaacacctgtgtcttctttccataaaaaattaaaacttttagaaaggactgcaatatactgtacagtctatatctcacttccctcttgcatttaatcacactccatttagatgacattcagctttaatctgcctagactgcctgtactcacttcatttctcaaccctagctaaacttgcactttgtcccataaggctttcaaactactcccatctcttagtaatctcgtcctctgagaacacctattccacttcttttcaaattacctttgtgtaatgttacacatctatctatatatatctacatctatatctataaatgggcatatatacaatctcaggaagagagaacgagagagatggagggagagagagaccttctttttgcatagtccctgttttggaaatcagaagactaaggttatgtttactttgtatgccaagcacacagcagaatgccctaaattcatccatttatctgcacatgtttttgaatgcatgttgtattctgggcactgtgcctggcatcatagatacaaaggagtggaagatacttttcctcggccttcaaagatctctaagtgcacacgaaaaacaaatgtgtagataaataattaaaacacagtgtgaaaaatgccatagggtaatacatacagggtgccatggcaacccaggggccgaatggcagcttctgcctggggagttgaaaagatttcacagaagaggagaaatttaagctaggtcttcagatgagtaggagtataagaggcaacaatagggataattataaaagcatgtttgccttgataaatagtttgcactttatcatttagccagtacaaattataaaagagttttacaaaagagaaaaatgtgatttaacttacgtttaagaaagatagctgaggtaggcctgagaatgcattggagtgaggaagagaaaaaaacaaatggctttttcaacaatctagggaggaataatggaatgtctacattaaaacaacagtaacaggagactaacaaaaagaatgagtctgaggaaagttaatattctttattttattttattattattatactttaagttttagggtacatgtgcacaatgtgcaagtttgttacatatgtatacatgtgccatgttggtgtgctgcacccattaacttgtcatttagcattaggtatatctcctaatgctatccctccccccatcccccaccccacaatagtccccggagtgtgatgttccccttcccgtgtccatgtgttctcattgttcaattcccacctatgagtgagaatatgcggtgtttggttttttgtccttgtgatagtttgctgagaatgatggtttccactttcattcatgtccctacaaaggacatgaattcatcattttttatggctgcatagtattccatggtgtatatgtgccacattttcttaatccagtctatcgttgttggacatttgggttggttccaagtctttgctattgtgaagagtgcagctataaacatatgtgtgcatgtgtctttatagcagcatgatttacaatcctttgggtatatacccagtaatgtgatggctgggtcaaatggtatttctagttctagatccctgaggaatcgccacactgacttccacattctatggcataataatagaaattgataacttggaggagaaaagaaggaagggttgagacttggtgagaaatttagcagaggaaaatgagcagatggacactccacaacaaaaataggggatgcagaaggaaaagcagattggaaaagggcaacagggacacagaatttggctataggcattttgattttgtggtacctgaggaacattctcatggaattgtctaggaacaattagtcagtgagcatctggaacccaagtgaataatgttgagaatttctaaaagtttaggaaacataggtatttccatcacttccattataaaaacttcattgggaatgttggattaataggaagatcatgcacagaatgattatttaaggtcctaaattgttccacctgagcatgggtaaggagaacaggtgttaattatttttgctgcgaggggaaataatttaaaaactagagggaggagagggttaactttgggaagagagttcagagaacctgagaatgtgatgagttgtccccttttccacccacactggagaggggcatgccaggggcagttgggaaggatcaggcattcttcccataaagtcgagcctatctctctatgccagcagaacatgctgcagggaggcacaattcccaccattctgacccaccatttcctaggtagtcaaacttagggtggcaagaacacctaagattcccacagtctagagaaggaggaagagctggcaaggacaaagaccagaggaaatggcctccttgtgcagggagagcccaccacccactgggatcaggagaaggtcctgttatgaggagcaacgcttgtgaatgaagaagggttctcagctgggtgcctgaaagccatcaaaaatgttccatgatcacacaaaagagtcttacatattttcattactgcaaaccagccttgaaaatatatgtatgggccaagaaaactttgcccaccgaagaagaacctccctgctacaacacacctgccagtgactgcccagtgataaatgcttgcaggccttgtgaaatgaggagatagctttgcaaaggggaccagagtaaaatacgtaaaaagaagggaagcccttatagagactttaaattggacagtggctaagactttcattcttacatgagattaaacaagtaataatagacagattgagtttcccagagtatgtcagctgtacacaggcaggaagttaaaaaaaatacatgtggtcataagaatacatgtttgcacgtctgaatggtaagtgttcaaaatccactggatatgcatataggatgaaactaaaatatagatatgggagatcatacaacctgtttgtatataagtacaagaggaaaacatggccaaaaatatttgttgttgataaggaaggattttaacactaatgaaggaaaaggataacgagagatctgtgaaaggaaataaattatgtagatgcaaatgacttagtgaatggctgtaggagcaattttctaaatttgcaggtgatatttaattggcagacattgcaaacagcaaggagcaattcaatcagataaagaacttgaatcattaagtacttggcctaatagatggcaagcgcagataagtggtgaataataagtcttgaatcaaaactaaagaacagagagtgaacatttgccaaagggaatgataccatccaggaatggctcttagatttaaggagaacttatagacaaggacaaacaaaacttcagtaaaatattacaaataaaaagatttggtgggttacagcttatccagctgaagctgtgatgagaaaatctgacaacttaaggatagataaatcctgaaatccacggttggctattgaaattccatttgttacctagaatttcatctatccctgatcatggtttggagataaaattaatgagtaagataacatccaagcatataagaggttacagatttgggtgaggatactataaataacttttaaagacatttcggatatgaaattctctatgttctatgggcataattgtgaggtattgtgtttagattgcttggtcatttttatttaacatgccagttctagtctacgttagtctggaaattataaacatagagaaatatgctacaagtaaaagagaataataaaaatttattatagcctagaaaggtagttgatgcaatatataatatatttcctctttctctttttttgcaatggtgaatactttactaaatgaaaaggttaattttaatattaaagagaaatggaaacatcctttagtacaacattaaaaccacaaatggaacctttaaatattcactcactctagcaatcaatgttccaacctcatttaaaggattttttttaacttgacatacaaatattcagaatgaatatttggaagcagagccacgagccataccttgaaagataactgcggacttactcttgcctgccatttgggtacttcagatttcagttgttctaagtctcaatgatcctgagttttctttttgtaatttggtaattttgtaatggcaggctttaaaataagtaaaggttttcttaactaagaacaaaaaaaaatccggagacctaacaaggctcagctgtgtccaggtaggagatgactgcagtttggcttcagaggctccctctagcagtgtgaggacatctgagtgtctctcctactcattttatatttcatttgatactgcacagaatcactaggagaacagccagaattgatttacttctcatagagacaaactgtttctgggagctagttatcttcttattaacaaagagcttacattcccctcccctccagagctcctaaaacatctatataatagctacattaagtgaattctacaatgattgaaaattttactataatgaagataaaaattcactcaattctagttcttttatccttgatttgcatttgactgaaatgtgtatttgcagtttgggcatttcagtcagcgattgctcctgtattctttgcccataagcagccttcagatggcctcttagaaaattgaagaagtctctacatgactggaaaactctttctgatggtctgtttcttcaaagatatagcattacctcttgggaattatagaaacaatatatattgttaagcctcttctaatgctactgtaatttataactggtaactttttcccccacttagcattcaataagcatttattggggcctaatgtgtaggtggaattttggagaatacataaagtatagaacacagagttcttgttcttcaagagctaagcagctctatagagaagagagagacagaacgacagagacagagacagagagagagagagaagagatcaacacatatccaccacttgctttactatctatacttcaacttttggtggactcatcccatcttatggattcaattatcatctataagtagaccacttccccaattgtttctttaacccagacctctcacctgaactacaggcttttattcctcacaatgccttcagcattttccatttctaatgggtacctcaaacattaagtgttcaaaactgaatttctgatttcacccctttcccccatccttgtctgttgtagtgtatggcaactccaattttcaagttactcagtgcaaaacctttgagttgtccttgaattctcttctctctgtcacgccttatatacaatgcatcagcaaatttgtctggctgtaaatctgaaatataccataaatataaatacgatcacttctcaccactcgaaagccactatttttctctctttaggactatttcaatggccctttaactgctcaccaagctactgctctttttcctatttctgttaaaaaatctatttttaacagagcagccaaagtgattgttttaaaatgtcagatcgtattacactctccctataaccctccaatagttttccttcaactctaatttacataattccctataatgccttatatgttcaattatatacatatacacttaccaccatctctgtgaaatctctttctcctacttccctagtatgagtattgcttaggtataaatcagaactcagaaaaataagagtaagaattaaaaaggacatatgtgctgaaaaaaatagagcaatgaataaatactggggaagtaattagaaggaagagattatacagaaaccataaggcaaaaagttaatcaaatttatcaagcatattataggggacatggccaactccacaatttgttcacctataatctcaggcaagctatttaccttgtctgagtcttagatttggcctcagcgaaaggaaagtggtgatacatcatgagcagggttgcagcacagctggcataaatggaggtttatcccacacatgtgggctgaaaatattagaatccaagctaccaaggtcagagtgcctggctaagagcttcatatggaaaaaaaacctttaagtcaatgacaaaatgggagagacttttttttttcaggcagtatatagccaagaatctattccttgaatgctggaattgaaggttatataaaagcacttattactaccaaattgcaaagaacaagcagagcaagtaagttgagagagagagagagacatctttcttggagaacatttttggaaaatgactgtgggcaaagcaatgtgaaaatatttagggagacagaagactacgaagataaaatacctatatcaagaagtttatattgaaattgagaatataaaacagatattatgggataagtcccataggagagatacagaaaaacagagaaatgaaggataactgtaaactctagggaggcaatgtcacaaactcaggtgaaaatacattagaaaaggaaaactaggtatttttcagtatatataatcaggctggaagataaaagctggttcagagactagtgaaaacaaatcaggctggaagataaaagctggttcagagactagtgaaaactaaattgttcctataaggactttaaaaggagatcagcatgtgagtagacttggaggcctgctaaagagggagctaggagaaggaatagcacgtggtttctgagaaacagtgtagcaataaggcttatcacacataaactaaactaatcatgatgtttttgtcactattgtgctgtcagagaaaaaaatctattgaaataatgaaacatactaattttgagaaacatcagtgtggcaaaacccaagaaacacttttcaaatgaatatactcaaattgcaagatcaaacatctattaattataataggtaagaaaaaggaaacattcaaaaaagtccttcaaagcgaaaatatgtaaattagagtaccttcataatcaataaacacttattgagcatctattcatgtgctatcaatgtgttaaaaatacaaaagtgacaaaaataattattgctcaaaattctgtgcagtatttagaaagattgggtagggataaacatgtatttctctaagattacattacattatgataaggtttatggaaaaaatgtacatacctatgtatatgtaaaaatagaaaagagtctaaaagaactttttcaatctcaaaacagtgtttacatatgaggaaatgtagcgatgactgttcattgtttataaatatctgttctctcctttcttagtaatacagctcctgaatcataatagccagatacagacttcccacaatatgaatttcccagtttctctccttagctagtgtggtcatgtgactaaattgtagccaatgatatttaagcagaaatatcatgtgatgcctctgagaaatgttcttaaaggaaggatttttattcttattcttatcttcctcctttcttctggctggaatgttaataggatgacttgtgttcaagcagccctctaaagacatgagttggaagctatgtactgaggagcacagagcaacaagagaaaataagtaaaataagtttggttcttagctctggaagcgtgataaacctgggatagtcagccagggaacttctttcatgttgatttttaagccagtgatattttgggcatttcttttacctgcaggaagaaaataggctgattttatgtaatttgaccctttaaaaactagaatatattcatacatagtttttacagttcagtgtttaaacttatttatttttcatcttagttttgcttccctatgttttgtaaatggtaaacttattagccattctgtggtatataaaagtttcacttttatgttttgtttttatattggcccaacttccatgttcagctaaatacactaacataatttaaattactgcatttcattgggaatccaagttagaaaattccttttcccacatttttaatacctaaaacttgggaaatgaataacattataagtacttgaaaataatattcactgatttatcatgtgtaagccctgtcgaaatatttattttctactgagcttggaagatattttaaaatgattccattaaagaaatttttaaaatttttgaaatatctatttacttaagatgttgaagaaaacataagcatctacctttaccttccattttttagatctcatatgatatgacaaataaatagaaaattagaggaaattttacaacagtactctaaattaagtaagggtaccctccatgaaccaggaattggcagatttcaaaaaagcacactcctaagaaatttctgtttttcacgtgaccctgacaaaatccattaattgtcctaatttggaagggtacaaactgcagaaaagagcagggtattagctcagcaggaagcataatatttcattgccaagttgctgttgtgactcagtagcagcacttctgttatcttctgcatggctcctcactcttcagcgagcaaattaggactcattcacatggtgatccagggttcctggcacagcaagatagatggcaagccattgtgccagccctccaatgctctgtttgtatcacattgcttttctcccattgatcaaagcaagttcctggctaatcccaaagttaaaggatagggaaatagactgcaccaattgttggaagagctgaacagtacattgcaaaggggcaggaataccagaataggaagaactttgtggctatcttatgtaatctgccgtgctgatcagttagactaataaaccaagagaagaaatgaaggataataaattcaaatacctaatagagatcaggctgttaaggtataaaagtaaagttgggtatagtacctatgcacacaatgtgcttgaattgtgagagctaaagtgaattgaagatctcatgaactttccaagggggcactgtctctcaaattcaacaagttgcttgaaacagactccagcaattttcacatgaaattgtaagtttgaatttctatgtagactctactaattttgaattctggctgaagtattttaaaactgtggttgaacataaccacatctgtaagttacttatgaatcatggaccatcaacatgtgagttttgatagagaagactgaaaggataacattttacaactctattaaatataatataaatagtacaattaatatatattttatataaatttgtgtcctatagacactgaagacccataggttaattacaaaaattgataatacatcatgtgcctccaactccaaaatttatatacaacataagtaatacctaacaaattaccagattaaaacacaataaaattaagatgaataacattttaaacaaagacaaaatctcaaaccacttggaagtaaaaatagcaaatgagcaaaaactctcatacactgttcctagagcaaagaggaaataaaaactaaaagtatagactatttagaaaataatgataacaaaagcactacatgtaaattgtttttaaaactttgcttacagaaacgtgttcatctttaaactctacttaattactaaattaaaataatgaatcaagccttcaactcaataaacaaaatatgaagccattaaagcttgagttaaaatgcattaaaatctgtattttagaattcataaatcaatagggttaattgaagggaaaaaacagttctttgaaaagatataaaacaaaaacaagccttgggcatgtctggttttggaaaatgaaatgcataaataaaagtatcaaaaacatgtgtacaccacaattaagaaaaattttcacaagcatgatggaacagtaagtacaactttatcgtaattatttgaaagaaacgtatggcatgaattattatcaaggaaaacatcccatcattaaaattgacccaagaagaaatagaagacaattaaatatatgtccaatatgacaaaaaatgttatttgtttacaaacaaattaataatgttatctcctgcctgttttcttaatttcaggaaagagtaggccaaatgattaagacatttcataaaagttacccaattaattctgaagagctagagtaattcccaaaagaatggctgaaaatgaaatcacatacaaaaaaagaaaaaacattcaatatcactttagtagtggtaataaaaatacttattaagtgataattgaattcttttacaaaattcttttggatatgaatatccaaaaatcttaaatgtcctttcatatttaatccgtcagcatattagaacatagtaaagtattaccaaacagggtttattacagaatgagcttcattcaaccaaaagataacaggagaatctttggcaaaatatctaatagtaagcaaagttggagacatggattagataataatatgaaatcatcatgtgttctaaaaatgaaagaatggtattaaaaaatcaaaggaaaaggggaaagtaggggaaaataggatatcgtaatgcactttagggaataagtggaagtaacagattttatttaaaattttcaaaacgttaactggaaaaaaaggagtaaaagcataataaaatttttaaatattgaggttaaaaactataataaaagtgcaaatctttctagatagtaaaagaaaaacctaccaaagaaaacatgctacatagaaaaacacagtaaatataacaaaatctacacaataataaataacataaagaatagattaaataagatacatttttgggatatggatcaaacactacaccctcataatatgccattttctcaagcatacatggaacattgacaaaagtcaatcatatattgattggcctcaaagaaaacactattaagttccatttaagtactttattacaaatagtgttccctcatcaaaatacaataaaactagaaatttagaagaacagtaagagaaggcttttcacctgaaattaagaaatcatcatgttaaacaactgtagaaaagagaaaaagaaacaaaaattatctttaaaattagtggtaataaaaatactatatatcagaatctgtaaaggatacttaaaggcgtaattagtagtcttggccctccccttcccttcccttcccttcccttcccttcccttcccttcccttcccttcccttcccttcccttcccttccccttcccttccccttcccttccccttcccttcccttccccttcccttcccttcccttccccttcccttccccttccccttccctttcccttccttcttttcttctttccttccttcttctccatctccctcctatttttcctccttcccttttttttccaccctttcttccttcctttagcatttcttcaatccttactttctcccaagcaaacctggaatctttacattgtaatattatttaaaagccaaataaaatcaaataatatttaagaaaactatcaagaaatttcaaatatttacaaaaatttattctcttgaacagcaagagaaggaaacagtttagtaagttagataggcagaagtagacctagtacttgtgaaatgtgtgccaaaactcttcagtaactattttccttctgctttctgtagaaaatatttaaagttgaaatgaaagcatttcctgaagtgatacgtgaattactacaagcaatatgtacaaaacatgaaaaacagaggtgatatttagtttggaattgtcatattcaaaatcagaaataaaattttcattctgatagagcagtgagtttgattttattctcagattaaattacagaatggattattaatcagatgtgttttagatgattaaaatagcagttcatgtttttgatagcattagctattcaggatcaaatgaatatctgattaaatatgtattttgagttcaataatgccttttacaaagcactttaaaccctatagacaaacgtggcttgatggcagtgtagtaaggaatatttataggtgattgaaaagctatatctaaagttttaactagtgagctatcatcaaagtgcatagaactttagaggcatattgccatactttgaacttgccaatgtatgtttcatcaatactttactagtaatgtgaatgaagaattaaaggcttgctcctcaacttctgaatggctcaaacatggtaaaataaagttgacataatgaatgagaagtatagattacagtagatgtgaaaaatacaaaagaaccaaagaatgaaattaaagagacaaatataaaatctaacatttgcttcaattgcataagactttgtgggctactagtttgatagtgtttattttaaaaatatttttaaaattttatttgaccttaaatttagcataaggcagtattaaaaatcacctaataaaaatgatacagcctccaattttatttaaaaagtgtataatttatatcaattgaggaaactgattatttagactgtgttcacaggagaatgacaagtattttgagggacagaaaatcatatctttggaaaaagtttgaaagcttgtcatagggcagatctatttagattgataacataatgtatggatgacaaaactaaaacatctaataaagagtacagggaagcaggtattgattcattataaaatcaaagttttataataattagaatatttcaaatgcaaaattttcatcttagaaaaagcaactggacttggtgtaatgttaaaataatgcatgtaaaacacatgatacttggtatatagtaagcactaactaaatgcatactattaatcttaccaatataatgttcttagcattatattcaagaataaattagatctttagttgttacatataatcatttattttagattaaatttagagtaaatgtatttcaatttgtctaagcttctaagattcagtgattatattgcttattagtcatgctccattgtatcatccatccatatccttttcatgacttgagagaatgcaaatcttgtatcttctctcaaggaaaatattatgactatataattaaaataattttaaaaatgtatttatattccagttttagtgctagtcctaatcaaaatttaaataatcattttacaataaatatttgacatataatattttgtaatatattgaattttctatagtagatgcctaattatcttagctatttgcaaataatgtaagtgtaaatatactgataaatcaagaaccttactttaattattgacataattattcaggatattaatcttttatcattgctataaaacagtcaattttcatattgccattttctttttattatttaaatacctctctctgttgggaatgcagacaaaaagatggaagagatttataataattaggtaatataagtttagtaggggctccatctttatttattcatatattcatagcaagtatttattgaccatgaattctatgccagaaaatgtgatatgtaatttttttaaaagtcacaatccttgctttcatggagcttatggcctagtggaggagtcaaacattattgaaaagatcatataaacatatgtaagattgcagctgtcatagtggctaggaaagtgaggaatgtaaacttctgatagtgtaaacaaattattgttccaatcaaagagatagtggatagcttccctgtgaaaatgaaaatcaagctgacatatagatataaatgagtgtttacttgaagtttcaggagggtcaatccagactgtgggaacagcatgtacaaagaccatgcatcaggaagaactgctggaagggaaaatggtacagtatgaatatgttgaagcaggttggggatagcctacgtaaaggtgtgtagaccatgtttttaatctttctcctaagagccatgcaaattcattgaaaatttttaaagtgtggcaggagacaggatcagatttgctctatagaaagactactttggctacaatagggagactgaagaggaagaaaggtagatttcaggtagtcttacaaggagctggagcctaggaaaacaatgaaagctggaaatagtaaagaaatgaatggatattaggatgctcaggaggtaaaatcaataatgatagatttgatagggggcataggctggagaagataatgaagctaacaagttttatgacttatataaaaagacaccattaaagcaagagatgttggaagaggactggttgaatatcataagtatgatgttggccatgttaaatgttaaatttgaggtatttttaagtcatttagtagaaatgtcaattatgtagttgaataaatcagtctagatcccagagctcagatacacatctagaaataatacatttgtaaattgtgtgtagatggggacaatagcagtaatgaacacagatggaattgcctaggcagaagagctcaaatgagaaaaggatgtaggcccaagtccagagaactgctaacatgagcttgaaaaaggaactgagaaagaggtgtatgttatgtcatgaaattcaagggaaagttgtgtttgtgatggagggagaaatcatcaatgctaaatgtcaagagacctgattagatgagctttgaagtatatccactacgttcaacaatacaataattaagaagtactttttccatgaggaatagggtatccaacaatatggggaaaaagagttttctcagagtgactgggatatataaaaatggagagaaaatgtggtaatgtggagtaaccagagagtagagggaagggctcaatctctttgatttcattttaacaagaaacaaagaatcttttaatgggaaatctagttaataggatgatgttgaatgcatgagacaggaacttaagtatctgaaatagagagagattgatacatttaatgatggaaggttagccttaggaaaggggacagctcctgtattgtggaagcagataaatagagtagactgggtatgggctataggttggaacacagaaataagtatgatttttaatctcccatcttctatgttctctatataataacagtaggattaaagatgtgacaagtcgttgtaaaaagtggacaagtgagttgaccaaataaataaaaacctaagaagggtaagaataaataattgtctttgattatttctggttatgttgtttattgatatttaggaagttttagaactgtctttctgaattagtggtccttggcctttttttttttattatactttaagttttagggtacatgtgcacaatgtgcaggttagttacatatgtatacatgtgccatgttggtgtgctgcacccagtaactcgtcatttaacattagatatatctccaaatgctatccctccccctccccccaccccacaacaggccccggtgtgtgatgttcgccttcctgtgtccatgtgttctcattgttcaattcccacctatgagtgagaacatgcggtgtttggttttctgtccttgcttggcctttttttaaattttgcttcagtgcagcacctctaatataagtaaggactaccacatactcattatccattacagtgttctgctgtatcattgattctgaaggatggagtgaagcacctctttaggaagactatacaaaactcagagatgggaaagagagagagagagagagagagagagagagagagagagagagagtgtgtgtatttgttagaaaaagttcattatatgattctgatatgcctcccacagggaggctagaaatttctccttgaaaatagaatagccaaatgttgaaaatagaccagaatttaggaatttgtttatagatatatgacaagtaattgttaaatttaataaatagtgtagcacatacaaataatcagctcccttttcctaaataaaaaactttagctatttttattctattttaaaaattcacttcgtgatatttaaaggtatccattattaaaatcagtaaccattccaatttataatcatttaaaagtaaaacatataattatttattagaaaaatatttgtgaacattttataaatattatcaacatgttgtcagtaaattcctcctcaggtggaattttctgactttggttgagtcattaaatgttttgggtcactagtgatcaattagtaaattactgatccatagtactttaatggcctgaaaaagtaaatgcatcttctgagcacctaattgaatcttagttatttattcatcattaaaatcaagataaatgagtcagctcacaataatgaaactgaacagttacattcatttcacaaatagattaaactaaagctcagaaaagacgggacaagggagttaaacatccaggttagattttccatctgaaaagacccaattcccaatatcttgctataaaaattaaatacatatatgagtttgaaagcaatatttttctgcaagttcattttcatatagcgttattaagtttaataccattcagttaataattgtagatccatggtacgtatactaatatggtcttgttataatgtaaatagtacagtttaaacagcaaaatttcacactgttttaatataaaaaatttcctagaaccaattaccctgagtgcctactatatggttcatttggaaaatgaatgatagctgcaatatggtaaaatgattatgagcacagccttcggaataagtaaaacatagctttaatatctaacttctgtacttactaactgagatctgaacaagttacttaaacttctaaggtttagtttctccacttacgaaatggagaggaaaacacataattcatagttcattgtaaggactaagtaaaaaaaaatacttaaatacttagcacagggcctagcaacaaagatatatgaactcggtacacacagacatacaaacacgtacccacactgcttaactttagctagaatatttttaaaagcattattagtttgagactagattcatccaagttggtttagcattctactagggatgttacttttcatatctttctttgtttttgttcccaaaagctataaacacaagttttatcttctttcctgaaacaattaaaaagaaaatacaagaaaatgttcaaaaaataatttactagtgtttttgtttgtctggaagggtcatcctgcagctttaatcacagctgaagatcattatttcaaaaaagacacatcttttagatatttaaatatgtattatcatattatgcagtttaaatgtgaagtcatctaccctctggtttactgagattctgttacattttaaataaatagtaaatgctgtagttaagagtgctatcactgagaatctaagaagacacattagaaagggattattactccaagaagaattctctttccttaatcattactttttcattaaaatatttctgaagtttatacaatacaatcatagtagtgaccttaggcatatgacaccttagtgctataaaaactctaacaaatctgtttagagcccaataatataaatttctgtgaagagaaatataaaccaatggtaaaatgccatgttgaagtttctaaatagcccacctagtaatttacatgttaagaacatattgaatatcttgggaacatgttcctagaaaagattctccattataagcttttcctttactgttaatgattgctttgataaaatgacccacgaaaaaagacaattttctccctgtgttatctgtgtctgaaatattcttcactgattttacatatgctgataatatgaacaaggtaatttgtctgactctggtggggcaagattttcagtaagaaatgcaaaattcacacatagctcttctgtaagaagtctatgcagtgtttcagtttatataaaaagatttatattgcctgaggcatctatttttttttcctcgaggcaagctgaagtggcacaaatgaaattgtttttcacactgttaatgtattcctttctctttcaatttctcagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggtaaggagcaaaagtacattctagtatttaaaaaaaatagaatgtgatgtttccaaagccatgtattcagttaataaggttctgtatctgacatcaataagtgttctaaagggtactcacagaaatgctcagaaaagaacatttgctacttcctcctagtggatctcagacacaccaagtttccagcaataatggttcattgtcttttgatgtaagtttaatttcatcaacaaaggcaaatgtgaatgtcaaaggtaaagctcacagaaaacatcaagatcagattttcctctccaaactctgactttctgagaaatagccttataaggatgaaattacttattaccagagaaggtactatttaattatttacatatgtaagaaatgttaggacttgttctttgttcagagacattatttcatgcattaaaaatattgtcattgaaaagactttggttaatttgagactgatgagaaattttgtgttttatcttttactttgatatgtaatctttactggtgatttaacttacaatttcactattttctaaagaatgtcattgctctgttatttaatatccaatctgcccaactctttaaacttgtccaattaattatttggctctcactgtttcaaaatagaataatatttattgcattccttacttgagactattgcctcatagagaatgaaatagtaagaaaattgatagtctcttgcaagctctacacatatattgaagaggaggatgtttgctacaatggagacattatacttttgtgctaatatttacaactctcaataacatctttctttttattcctattttctcttggaccttccatttaacttcatttttctattctaatttaatcaaagattagtctagaaccttcatctgacttgctaacttctaatctagcccttaaaccttttgtaagcatgcttttccctccacccttccatatccagggctctaagcttacctgttactgtatatttttcacagacacttttagttctttcattaataattaattcagtaaatatttaatccacactatctaagtagaactttcctaagcaattagtgtatgatggtgagcaagaaggtctttgccatcattgcgccacaacagaagtctaatgagacacaaacatgtaaacacaggattacaattgtgggtagaaagttctgtggtaggataagcatagactgttaggagatcataggtgtagaagcacttaatatatgttaatgtcgcagagaaggctttttaaagtaacactttatacagagagacagagttaactatggaaagtgcttcttgaggaagatgaatggagaaaaggagacataaacggttaggatggaatttcagaccaagaagtgagagagaaattaagatagtccaagcagagaggatctagtaaagatgaggctgaagctacatttgttattataaggagtttgaactgatccttgaaatgatcagatatttaaagataataaatgggaaaatacagattcaaattttactctagaaatattctggttataatgtggagaatagattgaaaaaaggcaatgtgaaaagtcagacaaattagaagactattacaataactgagcaaagagttgatgtggcttgctcaaaggtaaggtagctttgggagtcaagaggagagtattgatgaaatggaatcaacaggctttgattacctatagcgtggtgtgggggtcagtactgaagaaaaaaggagataaagttttatcctaggtttttgaatagaaaattatgtatattggatgtggatctcatttactgaaaaaataaaacagaaaaaacagatatgacaggagagatgatacattcattctgctgcacattgagtttgagctatccgtgaaacatccaaaagagtattactaatgtgtgcttagtggtttgatatatttgtcagatgcacagaagagacatctggacttaatatatatttaggagatattggaatgtaggaaattttgaagacatgggagttaatgagatcacacagagtagttgctcttaattgcaaactcctgattgaggaccactggcccatacaaagcctaggacagagctctaaggaaaggaatggatagaggagcactcagtggtgcctgataaggagtgactataaatgcacaagtgaaaatcagagcagctagtagtatacgtttggttgactgtgttaaacctttcaaagaatcaaatgaaattaaggcttgaaaggtttttgttggatttaacaataaatttattattgaagcaaaaaaggcttgtctttgccctatgatgtctgaggtttcagctagacaattcagaggccagaggctaaaatcatccaaaggcttgttcatttcactcacatgtctggtggttgatgcggtctgtgggctagtggcctcagctttttctccatttgggcctctccatgaggtcactttgcatgggatagtttgactttctcacagcatggtagttgctttctccacagagaacatcccaattaaagaattttatgttccaggttgggagtcataaacttgtgtgatggtgtgaattcctcttgcagagaacatcctggatgtacccacctcatgggtttttatgagaatttattaatgaatggttaaaattgtgaagttcttagatataacttatataagtgtcacataagtgtttactaaataaataaaacaatgaattagactcagcggcagataattgacatatgtaaaaaaagggataacaagacaaatgattgtagatcattttgatgtagatattgattgaaatagtagatcatggggtatatggagaactagaaagagaaggaccaagaatgcgaatgtaaagaagagtaagggtagaaattgatagagtaggcctggcatggtggcacatgccagcactttgggaggccgaggcaggcggatcacctgaggtcaggagttcgagaccagcccggccaacatggtgaaacaccatctctgctaaaaatacaaaaaaatgccaggcatggtggtgggcgcctgtaatcccagctactcaggaggctgaggctggagaattgcttgaacccaggagcgggaggttgcagtgagccgagattgtgccattgcactccagccgggatgacaagagtgaaactccatctcaaaaaaaaaaaaaaaaaaaaaaaaaaagatagagtagttaggagagagtagtagaggtctcaataagattacagaaaaagagtgaaaacataattataaatgagtttggagtctgtatttataaaataggacatctaagcctaattttttttgaaatgtaatagaggagaacatgttgtaggtatgtggatacaaattccagatgttaagatttggtgaaggacttcaaagctgatcaaggaactgagagataaagggttaggtgagccagctgtaatgatggcttggattagactggagaaaaagaaattgagccatgtgtcaaagttgtgaataaataaggaaggatgacaaggatgttgatagatatgagcattgaccagaaataggaggtgacatacctagatataattaacctctgttttcatcttacttcttccaatttattcagtttttcagtgtatgatttcaacaactgccaatatgctgatgactcccagatctacatcatctattcttgaacttcagatttgtatattcaactgttacctaggcaactctctgactataccagaggcaccataaatttgaacatgccaaaaatgtaattcattttagaatttgaaccttcttagcctctcacattctctattccagctgatccaccaccaaccattcagactcatgttagaaactctgaaaatagttttcatttcttcctctttctcatcttgtatatccaaccataatcaagtcctgtcaattttacctactaaatatttctagaagtggaaatctcttcttatctagaaagattagcctagattgtcacctagattgaggctacctcatttttcacctgaactataggagtctcataagtctttcttcttccagtgttgtctcctgcaaatatacgattcacatacttgcatatatacccaagttatccatgccatggaaagataaacacataattcccattcttcagttattttcttggcttcccaatgcccacagtttagaagtctgagttcttcagagcataaacaatattccatcacctggctcctgtccaacactcagttctcatctcttaccattcgtgcctcacatttaattgcccagttactccaaacttacggtttgaccataagacaagactctttcctaactcttcacctttgtatctgctctttccaattccttgagtgcctttgttaccaacctgattagactctactcccactctctgtctttatacagcaagttcctattcatcctctaattttttgcttttatttctctactttcaagaagtctttcctgggattgagaaccatcttctatactcctcaacatgtatttgtcatagtacttaccaaccatagtgtaattcctttttttaaacatgtctccacctgagtcctttgaatataagatagtgtactatttaatctgtgtagtctctttgcttatagttaagtgccttgtacatgttaggcatttaataaattcatattgataaatttaatgaatggatgctaaatacttaactaaataaagcatggaggttagctgcaatattttgtttattagattatagtctcaaataaaacactaaaattatccacaaatgacttaaaactcactaaaccaaaaagaaatttatctgtaatgtccccactgagttgttgtaagaaactaagaggagtttataagtaaggcatcctcttggttgaagcctcatttgtgaagacgttgacatacttatgaattggctttctgaattcttcctccaagtgaccaaatttcaataagttttggagcacacccaggaaaaaagataaatagaattacccatatggttagcatgcttttctagttctataaacatgcaacagataacaaaagttataaatatgttaaatacctttctatcccactgctcccttaaatgagttgcacagcctgcaggttgattgtacatttatacaaatttataatgacagataatgctgaatcgcatatgattagctacttcatctttgaaaagctgctattcttccacttgctaacaatgaaaaggtgaattcattaaaagacactgagagcatctttatgctctgattaaaaataaatgaagaaaaggcttataaaccctatgaaaaagagaataaatcaatgacagtgtccatgtataggcaattgacttggaactggtgatatttccaataaaaatacagtcttttaagaggaagtacagctgttatttcagaattgcagtcttcattgagccactataccagattgaatagggataaagaggcatttcatgtgttatcagacagatttctaaaaaaagagttcacggacagccaaaagcagaaaaatgttaaatatatgtgagttgtttactaatcctgacattttaaaaaatctgtaacttcaaagcattctggaaaaatagctcagggaatccaactgtgcaaaagcagtatggtccattatagagataaactcagtacatctgtttggctggaacattaagagcttgtgaattaggttgtaaaatgcacgaatgagagaccaattttatacaacttttgttgtcattttatgtcctccgttatctccatgtctacatacatctcctttcaattaatattcttaagtgaaactggatttgatttttagaagtctcttatgtttagtttattggcagtgactctatcatctggtctccagaggacttcaatgactttgcaaatgtagttgtatgtaatttgctttctgtttacatgcaaagggaaatttcagaattatcttcagatgtttgtgtctgattatgggaaatagaaatatttatagtcatgtaaaatatttgaagcaaccacatatatgtttatttagcagcaagcatttattaagcaccaacaatgtgccaggaacatgagtagcaaaaggaaaataaggaataactcttaactagggtttaataaatatttcacgagtatactatgtgccatgcctggcctatgtgctttgagtatgatgctaaataagaaaaacagttcttgcaggagtgttcaacatcacgccgatggatcttaaccaaattgagatcaaaataaaccatttctgatgagaggagcagccagaattattgaaaagaataaagaaggaaaattcctttggtagttttcttaaagatcaaatagctccacagatgctaatgatgaatagaaagtgtgcctttaggagtgttagaaatactgaaaataatttgatgctgttgcacaagagttaacataagagacaacccactgattttgaaatcccaagacaatttttggaagaaaataaagagttcttcctactgtcagatggatcacactattatacagaatccaactttctcatatccacaaaaagaagagtcagacattcttttctattgaattaggcaacagaagagattgttgatgggagaccatctctttaaaactttgcacagaaggataactcaaaaagacatcaattttaatagtgtagatatcaaatatatgaaacttaccaatgtcctatttacaaactctcaaaggattcaagccttggaatgcagtagctaaagccatttctttatattgttacctaatatttcacattcaatttgaatataataaaaatgacattgactagctctgttgtttactgaccctagtgaacagaggaaaaatgagagtaattccccatgacaggttaactcgactacaaagacaggtttttttctacattgtgttcttacaggtattaaattaaaacagctctccataatttttatttaggctcaaacaacatctctgttgttgttaattatgattggcagtccttaacaaagggaccaaaatgcattctgagtgctgtcacatccacttgagaattgccccatgctgatttaaaacatgacgaggtgcccattttctttctttttatcgcacaattcttcacaactaataaaaaaaaagttgaactttcatgctgaaagtgaatgttcaaattctaccaatagtgaggagtaatttgtgtactagaaaacagtgccatgattttaagctgtgaatgcattggtttacattcctaatgaactgtgatgaactcctaagcaattatgctatgaactatatgcatactatatggccctgaaaattatttagcttgataccgactcctcatgacgtgagtcagaaaattctttctcatgctcaactgggcttttgaagagttaaaagaaatcaaagaacatgaggcagaaatcatatttctacttataaaacaagaactagtacaatcaacatcttctttgactcctttgaactacctgtgaatatgttccataattaaaattactattttagtatttaacaaaagaaagaagctgtttcctaagagacactaaaaaattgaagggtgattttgagaaaatatttttaaatctaaatttaaatgatagaacaagcaggtgctggctgggcgcggtggctcacgcctgtaatcccagcattttgggaggccaaggtgggtggatcaggaggtcaggagatcgagaccatcctggctaacatggtgaaaccctgtctctactaaaaatacaaaaaattagccaggcgtggtggcgggcacctgtagtcccagctactcgggaggctgaggcaggagaatggcgtgaacctgggaggtggagcttgcagtgagccgagattgtgccactgcactccagcctgggcgacacagcaagactccatctcaaaaacaaaaacaaaaacaagcaggtgctatagattctttaaaatagtattgtctgaaatctgagtagaactcagtgtttttacagtaccatattacaattttttcagcttaagtagtaaaaatgggaacaaacatcctcaacataaacttatcctaaagctgatttaggattggtctaagttaaagtattgggctcaagggaaagcaggtggtggtagagaacatcatttaaattatttagaatataaatttgaaaattcaatttctgtttgacatgcccaaacctgaatccatttccccctttgtctatgaatatgtaattagaggtttaataatgatggctatattttttaaagcatgggaaactgaccagagccttcaaaaacaaagtcaacatgttttgaaaattaagactgttagcatttagcctagctctagaatgcatccttaaaacccaattatcatggacataatactgtatttaaaatccccatcttcaactttaaaaaaattgttggtcataaagtccttgtgacattttgttaaatacccttgaaagtggtacaagctttacttgattgtttttcacatttataaggcagaaaaattcaatgtttaatagagaagtataaatacacattatgtatctcattatatatatcaatgtcactagtgaactacatttttatggcaatttttttcttttttgtgtcaaaatttaacaaaagataaatgcatgacccaccaatgcactgtagacacataaaattgttctttgattttgactgtgcccaaaatttatagagtctctttatatttacagctctttatcttagactccaaattaacaatccatttgggattgctgcacagtgtattctatctgcttcagttgttttctagcagttagtgtttatatccgttgtttaagctctactttagcatgtcctaaaagtatatcttctgcctttactattttaaattcttcattctctagtaaacaccaacttggatattaaacaagaattatttaactagtcacagaggtgaataagacagcatgatggctgttttcatggagcttagaatacacaagtgacacaaactaggaagcatgcagctccatcatagaatcacaattgtcatgctgaggaaacacaagacaccacgaacatggaattcacagatatcctgctatttagcgtactgcaactgggtcaaatacatactaagttgtgatactgaaagagaggaacacagaccatgagccaattttttacctagtcacaaaggaagaaagaaattgttcaaataactcacttgatctttgcttcaatagagtgtcagattatttaaaattttcttttatctataaaaatgtaagattcagtaacataaatatctaactaaactactcttttcatgtctttgtgtttccttaagagacagctcagtttacaatcctgttttttaccacttactagctatgtgacatttgacaagttttttaacctctaggtgactcagttcaccagataataattactgacttcatcaggtgtttgagaaaattaaaagaactcatggatataaaactattagaactgtattcatgacacaaagtcggcacagaacattatagttattttttcctcactgtttccaaaggccacggcaagagatagaatcagccatattgtttaatccttcaatattcatcattaacttccagaaaataagcattagtttaaaaaagcatagtgtaatcaagcataaggaaatatattaggaaaacttgtttagctaatgaaaatgtttatagtaaaagccatatgctaataaactcacaataactttatgtcattcaagtaaatatgaaaaactacaaaaacatttttccctatttaagcatgtcattactacatgtttttataatagactatagccaggaatacaacaaattaatgaacccaaattgagtggaattataagttgtgattcaagatgtttgcaatttatatagtaaattctttggggctcataaagacttaggttttggggggattaatgtcctataaaaacagtacacttagggttttgttttgggaattatatctcgagatctgcaactaaaatagcacaatattaagtataaacattacaggaaggctagtttctaaactaagcaatgttcacaaactgccactgatggcagtctgaaaccatatgggctttttccagctaaaatgatgatgatgatgctgaaatttcattttttattttgatattctcatagtattgatgcagggcaggcaagccccgaagtggagcttagcctgctgggttcttggctttgctcagggaagaattcaagggcaagacagaggtagaagaaaacagctttattgaagaggcagtgttgttacagctccatgactgcccctgtagagcagggctaccctatgggcaaagagtagcagctcagggcagttttgcagtcatatttataacccacttttaactgcatgcagattagggggcagtttatgcagaaatttctagggaaggggtagtaacttttggatcattgggtcattaccatggaaaggggcagtaactcccgagtgttgccatggcagtggtaaattgacttgacaggctggtgggcatgtctgatgacaagctgcttctgccccggccctgttttagccagtgcctaatctggttcactgtctgagccctgcctctggaattgaatcccacctcctacctcagtatcaatactaaaaactaaaatgttttataattttaaaacatgttaataactatttgatagtttaatatgttaatgaaactgaaagcagtcttgtcaattatatagaaacataacctatgttaaatatagattgaaagaaagcctttaagcttaacagaattactgaactctggtttcattgtaaacttaaatgtaatacatattgtaaatacctatgaaatacaatttaacatgtaagaaagatataaagaatcttgctaagtatctattcccactattttatgttattgcaacactaaaatataccatgccggatctgaaaacaaattctcagtaaccagtgaaatttgtttctttgatctgagaaaatcaaagttcatgatagtattctgagttcagtttgaagtgaagaacatgccatgccagattgcaaaagttggttctggatttaaaccatctttgacattatttaatataaacaatctgaaaataatttatactattaaaattattgaaaaggaaaattatctttagatgttttttccaaatactgttttaataccgattttgctgagaacaatgaccaagttcctaaatcagcaaccaatttttgcctaaagtaatttttaagaagtctgtattttatataaaggtgattcaaactttgttggcttttaaattttgaaatagtatgacttcttcacataattatctacaaagctataaggaattgttgatggcattctcttctaacttagatcctctttgatatcattatagtctcttctaaatataaaagtcattttgctatatcagcagggactgtctacaagtaccacgcttctgtgctattgttgtactgattaaagggttaaggccacttagcctttagtcctctgccttacatcaccacccaaggagtgctataatcctctagaaatgcattgcctgcagtgtggcactgcttaataaatcactccatcttatttatctttctcttgacatatagctagcagcaggaaccattatcctatgacaatgttaagttctattgacattttctcttaattaactacactaatttttacattggaaacaaacttcctttatttaatgctatcttaaacaaaggaagtgttaaacttgtcatacctgcatcatcataacatgttttgaaataagtgaaatgtctttgttacctttccagaagaccagtttattctgctgagaaaacaagtttgtacttatagaatcatattgcatcatttcttctaaactcattagacatcttaataatatataagagccccaaaatatatgtctgaattcctctgtgatacatatcccttcagtcatttgaacaaattttatgtacagtttcataaattgagaaaagcatttttttcagattaagcatgtcttacctatcttagaaccaagcattttgggtctaaattaaagatcattcaacagttagtgtatgtaatgtgccaggcactattcaagctgttggggctgtattcatgagaaaaacacacatatattcatgccttcatggagctcatcttctagtagagggagactggcaacaaataacagccataataaataaataaataaataaactacatatatcagaactcaaatgctatagaaggagtagttcagagtaaggagaattggaagtatgtatggaactgttacaattttcaatttgttgcagtaagcctctttgagaatttgatgttgaacaaaatcctgaaggataggaaggaatatactttatagatagatatctggaggaaagatgatcaggtatagggaagttcaaaatgcaaaggttctgcttgaagaggccggaagcatagtttagtaggaggtgaggacagagaggtccatgagttcagatgagattgacctttgtagactttcacatttactctgagaggaatggagaattatggagtactttaagcagagaagtgacaggacaaacattaagacaaatatatgtaattgtaatgggaggcattgacaaacttttctagagctattctattttccacatctggcatatttgaggatttaatatttgtttcaaaaaatgtagatttgtatctaaaggagtcatgattatattttataggtatacaaatgtatacatgtttaggtagatacatgctggttgcaaaatatacccagccatcgtacattttaaaaaactttaactccaagatctagccataatgttttctactctgcagatcagacacatatggttatccattttggaacacatgttaacaagtaaatcaagagatacgtctcattcccagctgtatttgtggtgatgactcctgaagaaggccattcttttctgataaatcttccctggtgcttttggtagagaaggtacagagagaaagcaaaagtacaggcattcttagtttatttttttcttctcaatcaacctagtttctttctgggaagaataaatgctatttcacaaaatcagtttaccagtttacttgaaatgtatttggaaagaaatatacatatatatggtaaaaaattctttgctacatcaaatcaatctactaataatgcctttcagagtagaattaaataaggctttctttttagaaaattcttcctgaaaagaaattaaattgaatatttttattatttttatttatttaaaatgtatatataccttctatttatccataaagatcttaaaatctgctaacattcataatagcagtgcattcttttgcttcactcacagaaaaaaaaatgaataaccttctatctccaatcttccttaccaaggccaactctttccatttaaacatttcttgatttttaaatttgcagtcatttggccacaaaaggccatctggagtataagattaaatagacactaggttcaaccacagtaggaatctgtaaactcagcattatcctccagaaaaccttcctttgaaaatgatgtacagttcttctattagggctgcacttaatctctaagctatcggaaaacaaggtcagatcttctgttgacacaggaaatagtgcaaccggtcccctgtagttattgcaaatagttgtatagattagtgacgtttctgaaaaactaaatatttttaaatgggtctttaatattcagtcctccaaatacagaaaaaggattaggttaaaaagtgaaaattaaaatgttcactatgatgttcattgatttttaatttttccttctgagcttgtattgacccaagtgacattctacaaatgctgacttaaattaggttaagcaagttgaaaattacatttgatgacctgaataattcattaaaaaggataagcatataaaagcctactttagtaacacaaacacattttttataataatgtaagatattgaatctggccacaaacaatgtccaggatggacacttttaagtcggaatgagtaactttcttgctactaaattatatacagtacatatttaactgatgaaccaaaagagagtaatttggctaagtaaaagtcattcccagcactaaaaggcaatttaacatgcatttacccccaggaaacttagaaaatgaacagtaattgcagaggtcaaacttgtaagctggctatacttacttgtttcactccaagacttgacagcgatgcaatttaatcctcaaatctgtgactacctgagactatcattgaattgagggagcttatcaactaagaaaattaaaaataattgtactagtttatagctcaggtgtagataattccatataccaaataaatattatcgtgatgtgttgtgagtttataagttaacatattacatacgtgtgtgtatacgcacacatatatcttatttctcctttaggggacgatctctccctgatttttcaatgtagtttcataaactttctaacactaattgacaaaattaaaaacaaatattgtgtaatgcacagatggcagaaagtaagcaaaagtgtatgatttcaaaaacaaaaatctacagatatattcttatcaatttatttttaaattttaagtattagctaaacagtcttattaagagccattttcatataaaatagtacattgttatattttcttttctgttatgatattgtaaaatgtggctcattcttagtgatattaaaacaaacaagtaacacaatgtttgttagacgtgcatttttgtctaatctattttacaaatcttttagcaatataattaaaaatatttgaaatcagggaattcaaaggaagtaaaggaatgagaaaagcctagtggaataaagatattataaataagatattaaaatatagatttaatttttaaatgggagcatctggcatgagtgaaataaaatgaaacaaacctcacggataaaactttgttattaaaactcttttccttccttcttttgcttctgtgcagatgatattttgataatttcctctgaaagtaactgaggctgtgctgcttcttatagataggctgcaaggaggggaaacccattatctttcaactcttaaactgtctcttcataagataagcatttcaaaaattgtattccgtaactccccttctagtttttatccctcagtttttagttgactaaattaccaaaaacaaaagtgatggggcaaattctataataggtctgaggggtctgaagactcaaatgaagcttacagagatcctaaccggatgatctagtacttttgatctttgatttggtgtgtaattggttatcaggatttgtttgctagaaaatttacccttaacacagagaaatgtggaaattttagcttgaaacaattctcaagattatacatacttttcaagtttaagacatattccttattcattacttaattcattgttatttcttctcctgaattcaatttttttttttttttttggagacggagtttttgctcttgttgcccaggctggagtgcaatggcgtgatctcggctcactgcaacctccgcctcctgggttcaagtgattctccttccttagcctccaaagtagctgggattacaggcacacaccaccacgccagctaatttttgtatttttaggagagacggggtttccccatgttggtcaggctggtctcgaactcccgacctcaggtggtccgcctgccttggcctcccaaagtgctggaattataggcttgagccaccttgcctagccttgaatttaatattttatttatgctgattgaagttagaattttggccaggcgcggtggctcacacctgtaatcccagcactttgggagactgaggcgggcggatcacctgaggttgggagttcaagaccagcctgaccaacatgaagaaaccccatctctactataaatacaaaattagccaagcatggtggcgcatgcctgtaatcccagctacaagggaggctgaggcaggagaatcattgaacccagaaggcggaggttgcagtgaaccaagatcacgccattgcactctaacctgggcaacaagagcaaaactccatctcaaaaaaaaagttataattttatcagcagatgatctctcagggtataacttttaaccataattaaagaaatgttagattagactttatccatatacattaaaaatatgaaatactactgaatatatagttcctttatttaaagccacaacaagagcatttcattcacatagctaaatgatcaatgtggtggatattctccgtatttatcaggagtttaaaaagtaaacttatcagataaaaataaggaaaaagaatattccagacatttcaaagtttaagctggtaaacagtgtgaggatcccatttttgcatatgaatggaacaaaggttggagataagactagagaaaatgttaggggccagattgcagacatgctcaggtagaacacaaagaaaatcgactttatgttacagaagatagatattcattaaagatgtttcatcatcaaactggcccaataaaatttatgttttaaaactgggctctttgcagacagtatgaagcatgatttgaaggttatgagacttgaaatagaatagctgaagtaatgcaaagctgaagaaaatcagccaccaccactaccacaacaaaaacagaagaaggaatagaaaagagagaataaaccagaaacccacacgacagggcttagtgcctgatggagtgtcaaaaaacagtaaatatattaatatgtatgcaacagtagtttcatactgcatgtaatgctattaaaattaaattactagtacatccttgacatctattttttcctttaactattttttcctgtaacattatttactgtctatataagactatattatttgtatgtgtgtacataaatataacttctttgccaacttcccttttattatatgtttatacaattttaaaaaatcattctagtggttcaatctttgtgcacatccatggtcattttctgaagaaattatcctagatatgcagcttctgagttaaatgatatgtatgcatctaagacttgatactttcagcttaacattgtaccatacttcatatttgaacatttcaacaattaaaatcacataagttttaatagactttaaaaatatttatttagaaaagtaatagtcaattaaaataatgtaaaattcagctttacattactgtgtcccactagatattgagaagaagcttaagtacattcaaacagttgaaactacttggacataaaacatgacaactctgcacaccttaaaaattacctaaatcatttggacaaaagtgtttgaaatttgttgctgataatgtaaatgttaaaaacgtaggcaaaaggcaaactgaaatttagctcaaacctttatatgtgtattgttggtgtttataaaggtataaaataataccatgtaatgcaagaaggctataactaattcatattgcttcctcagttaatgtcttcacataaaaactacccgagatgtctattttttgaatagcagcttgaattttcaaatattgtaagagtctcttgtgtattgccatatgtgcataaaaaatttctaagtctgtgaaacttggaaaaagcagcaaatacatatttttttctattttcaataaatttatgcagagaagtagggtgaatgaatgccttttgggaaaaggaaagcaaaaatataactcaccattttgtttgcatgtacaatttatacattgaaagtgctattcactagcatataatctattatatctaagattacataaaaagttatttgcctaagtaattaaaaaagaaaatataaaaacaatttataattccaatactgggtgcttagaattttcttatgattcaattaaaagtttatatactactactaaaatagagaaacgacaaatgcatttgttgagttatcactagaacatgaagttaagatatgtagaatcacagcctgcctcctagaacaactctgaggacagaattattcacctattacttctcttacttgtcattagaatctcttgtcattgcaatatcaccttccatctattttctttacatcttccaggatcatcaattcattatattggttatgttttaagttgactgctttttagaatcatctaaataacttggtctaagtaaattatttccaactcaaaataatggggagtttttctgagtcttatagacaaactcttattctgtttgttttaaatttatttgcttgaacctgccctaaatttttagtgtaggaagcccatgatctaaacctatttattctagtcattgaggagaatagagggagaaaacgaaatggaaataataaatcagaacccttggtggaagaaatggcgcatgtacttggaggcggagacaccaggaggcttcctaaattctctgacatatgtcactccctgcctggttttctcccttccctatgatagcctgtgatcatatattgtattatttccccactcctctatgatattcaccttgggttaggaagcccaatattgcttttctagtcataccataagcctgttgtgaagattaaataagaatacagttctaaaacacttaaaacaatgcataatgccttagtaaatacttaacaaatagaggctttcatattttgtttcctgacctttgctttgtaacctcctactctctgatcttgacctgagtttaataagttttttgttttgttttgcaacttcaccctgatccccttcctccctgagcctacttcctctttgttacatccatggttttgatttactgcttcagcccagtacaataaccttgtttcctgattttcctactgctcatcaattcaagtccctaactcagtgactccagaggctgtaagttgaaagtgtaagaacttcctggaaaaattattttaaccatttttaaatctcttattcaaaagaatatgtggaaaagaaatcagaatagaatcaatttttctcttcaactctttaaaatactctcctaagaacttaagcataagagctctgtaaaactgaaaattacggaagaaaattcaaaattaggaaagctgatattgttttgtaagactagattcataatgttaaatgattccctttttctctatcaaattataaatctaatgtatgctcaataaagtcattttaatttaaaactaatctccagtggtggttaacaggttgctggttttaaatgacattttggaggcttaaaaatgtattttagacttacttttggctcttttatcattaaaactgattgaaaatgtattggcattctctgaccttttagaactaatgacatacttatgcataaggcctagtttagtaaccaacctcagaaattccaaattaaaaacttcactttgagatccatttcactttgattcctgttgacaactgctgcttaccctttgaactttcatgcttctgggactggcaaaatgggtgcaattttcctcagaactactgattgattgaatctctgaaaaatggggttgctaatggcactagaatttatatagtggttttatatagtggcttaggcctcactataattattttaaaacattaaaagctaatggatcactacagagtggcaggttctgactcaactgcagtcttgcttcatgctgtttgacaaacgactagtcatctagacaatatttactgtttcggtgcctttcccagccctcatttcattgccaggtctgtggtaaaatcagtaggttaaaaaaaagtataaaaagaaaagagaataatttttgagaccttctggaaagtagcatttgtatatatgtaaagaatcatactatattccttattcaaaccatgcattgtgttcttcttttggttggttgtttactttattggtgagcaaataggcaattggtatacaatgatgtgttaaaagtagaaaacaaaacacctacagtgtaaatcaagtaatttaatacacagaaaataaataaaaaatacatgaaatgttaaatatggtggaagtgagaaaaacacagggatgatatataaattgtcttttaaaattgcagtgtatccctcaatcatactatctgaaagctttctgaagatattaagggatttgtttgaatatctttccctcttttcaattgaatttctaaactttcaaatgttttaattttgtagtattagataggaaaatgctttttacgatacatttaagcctttttccagaatcttagccttacacccttataaaatatctagcatatctaaagccaaaccaggaaagaaagaatgaggctacttggtttctcctttttattttttaacaaaacttctaaaatatcaaaatggaacagatataagagcgtgaatacaaaagctgaagatatttctaaatatatgtgtgtggttttgacaaaatgctacgtagtagaaacaatacatgtgatgggaagtattctgggagtcaataagtgtttgggacatattcctccattgtttttgaaacttatatcaatgttctgaagatatagtcttatttttatcattaacatttacaaaggtagttttgacagatactggaaatgagaacagaaaaagaaataaacaaatacatttttgttgcatataaaaataatgggaaatttaaggaagacatgtggcagactggctgtcttaatccattttgtttcactataagaaaatatcacagagtgggcatgatataataaatgaaatttattttatagttctggaggctgggaagtccaatatcaaggtgctgatatcttgtgagggccttcatgctgcatcatcccatggtggagggcagaggggcaagagaatgtgagagagccagagaactttccagaagtagccagagaacaatagaaagctgaactcacttttgtaaaaacctgcacttgtgacaatgagcctgctcctaaaataatgatattaatctattcatgagtgttctgcctgtatagcctaatcgccccttaaagattacatctgttaagactatcacaatgacagttaaatttcagtatgaatgttcggaaggtcattcagccatagcactgacccgttctgctttgtgctaaacctgctttgattatccattaatattgtgagatgcaaacctatgaattagtggaaatttcaatgaacagccacaaatactaccaagcctttcgaccaaaacattcaatttcagatatttagaagcttgtttagaaacactctcttaaaacagataaaagaacttctaatttcaatgtcatttcagaatctataaaaaagtaaacttaccaattcaaaatggatttagcagtcccataaaaaagaactttgctaattaatgttctggaaaatttatttgcctgacccaataaagttcttgtataacaagctactttcagtggatattagtgcatttcattcatactatgatcagactgtccagtagaactgaatgcaaagcaattagtgcaatggaggaataaaaggctttattaaatgagacctagagatagaatttacagaaagggtttctaaatgctatcactgccactatgcttggagacaggaaagttaatcaatttgcggtggggaattaatgataaacattatgtgtattactcacccatatgttcttaacattgcacttaagagagtttatatttcaatgcagcacttacctcagtattttttactgttacttaacatacaactgtgtcaaattgtaatgtagcccaccttacaaactggaaacctgaaatctgtgattgatgttcaatgggctctttttttccctagctctttagaaacagtgggaattttatacaggctagagtaacaaaaacattgtgaaagtaagaaactgccaagtaatatgtttttgtgtaataaaattcaatttagttctaatatgagttatagcaattggcacttaaaagttaagttaaaatcagcatgtaaggtttatgtgtggtaaccagcacccgtttaatttgattttaatttttaatttagcatttttcatatctgctcatcagaaatattttatggtattgggtctggtaaaataaacttaactgctggtattaagtctgaagtttcaaaaattataaagatcgtctccttctgtaggaagttctaatttgaaataacatatttttatttgctcagaacattcttattttaagtaaatatgtatagatggcatttgtatgtataaaagaattctattaattttaatagattaaatatgataaaatattaaattatataattaactacataacataaaattaactaactacatattaaattaacattatgttaatgttaagtataaacattttatattttaactgttaacattaaaatatattaaaaactgaaacgcattattcaaccaacatggaactcttcaaactagaaaagcacaaataatataaaagtggtggaaagaaggaactgctatttataagctttacaagtatcataatgcctatgacatgtaaatattaagtcagagaagtctacaggaaattttcatttcaattacatgatctaatgtcttgtagccttcttttgcttatttgcaaatagacctatagccagtccataacaatatttagtcatttaaaaccaactgaaataacaattatattagtcagattatcaagagagacagacccaataggatacatagaggcgtgcattgaggatattgcaggttcagtttttgccaccacagtaaagcaaatatcccaagaaagtgagtcacacaattttttttaattttccagtgcatataaaagttaggtttacactatactgtattcttttaagtgtccaatagcattatacctaaaaagcaatatacataccttcattttaaaaatactttattgctaaaaaatgctgatggagagacatgaagtaagcatgtactgctggaaaaatggtgctttgcaacacggggttaccacaaagcctcaatttgtaaaaataagtttgtaaaaaaatgtgtgaagtgcaataaagtgaaattcaataaaatgaggtatgcctatatatagatagatagagatgtagatatagatatttgagtggggatttattagagaaattggctcacatgattatggaggctgagaattctcatgacaggctgtctgcaacctagagattctgaaacactaagaaaagcctcaaaaccagggaagctgatgatgtaattctcagtcccaggccaaaggcctgagaacctgggagtggggatggggcggggaactagcataagtcctggagtccctaggccagaaaaccagggatcctgatgtccaggggcaggggaaaaactgtgttttagctccaggagacatagagagaagaaatccttttctctccttttttgttctatctgggccgccagctaactggatggtacccacctacattgaaggtgaatcttcctcactcagtccactgagtcacacaccagtcttctctggaagcccccactgatacagccagaagtaacgttttaccagttgtctgttcctgaatccagttgacacctaaaatgagccatagcaaaaatagagaaatgacattacctatcactattttttcaataaatcatgttataaaatgtgcttgaaaattctctttacttgtataagatataaaaaactaacttcattcacaaaatagcttttcttcatggattctgtcaaaagaaaataagtcaaaatatttaaaacattacatgtttgaagatgtttatagcaatgtaatatgtgatagaataaaaatctccaacttttctaaactaggagaatacttaaataagctatagtagaactgactgagcaatatcattcagccattgaagatgtagtaaataggatacaaaattgtatgtttgacctgaccattactactgaaaaatcacattaaaaatgccaaaaaaggacatatcaaaaaatgctaccttgaccccttcttcagtattgggcttctgaatatatacactgggttagttctgggaactagataagaggttccaaattcccactcagcaattgaggctagatttctgccttcagatgtggaatttttctatccatacatatcaagaagcaccttaatggtttataaagtataacctgtaattaatagattgtatattatgtaaattatgtaaatagaggcacctattttatttttagggtcactgtgatcaataagctattactatagttctctgaagataatacacttcaattatcactgagaaacagccatgactcactgtggtaattttacctcatctcttatagttagtcatccacaccacgcctttacctgggatactgctttcattttggatcaagaaatgcaatttattgcaggattccccagtgttatctgagacttcagaggagaagcacacagaactcttcagagatacttgtgttctgcccccttccatgcattttttaatgtctttgtgtagggattggccttctcatgtaagagaggtgaccaagtttcttggaacagattcattccaacattcccacctccctgaatctctacagtaggccagggaggttgtatataggttattttcaaatttcatgcatttttggttcattctttaattagccaatctaatgaattactaccaccccctgcccaagtatcaagtcagcacattaaatcccaaatctgaaatcttaccacccatgacaatatatttgccctaatagatacttaatgtcatactatttggtgtaaacttttataagtgggctttatacttctttgactcaattattttgggacctaatttgtagcatggagtcaataaggagtaacgtggtgagtccagaagagatccgtgaaatttcctatgtcaagttattgaaaagcatttgtgcagaagaaggctgattccctcagaagtggtgagaggttgcttccaataacaagaaggttcagaagaatttgaaagttcaaatttcttatcaatgcatgagatatcttatatggcagaagatttaatcagcaattaagctgtgctacagtcaagccttaatcttgtcctcagcagtatctaccctaaaactacaggataaagagagttcttcaaaactgccatcaagatattaaaattttaccttatttctgagctaggcattcatggccttaagtttctcatttgcactctgtattcattcggagacttcagagcagttagctggaaccataatcttcaaaatcactattattgccatggccttgcattccacctgcacttcattccatgccaactctggtggttatttaaacaattgtaatgtaaccacaggctgtaaattgtcacagttccatttcccatcaatatgtgctacagagatatgggagcaatccaatctcagaatctcatttttatggttctgtttcaattactaaatttaagaaggaagtgtttctaggagggtggagagggacagcaaaaatgagcagggtcagtgcatcttagatcccagagggattgcaggcttgatggagggaggaaggtcaaaagattgaagatggcataggagattggaatgcttgaaattcagattacagaagggtttatattattcttaataatggtaatattcactaatgcaacttaaaaggaatgtcattgcattcaatagaaaataactataaaatacatttaatgtaaatgaaacattgaatacaaattagttccattgaatgccaaaaggagtttgagatttgaattttctttgtaaaagtaaaatcaaaatttcagaaccttattatctgaggctttgttcttaccatgatattactgggtatatacccaaaggattataaatcattttactataaagacacatacacatatggttatcgcagcactattcacaatagcaaagacttgaaaccaacccaaatgcccatcaatgatagactggataaagaaaatgtggcacatttataccatgaaatactatgcagccttagaaaagaatgagttcatgtcctttgcaaggacatggatgaaactggaaaacatcattctcagaaaactaacacaggaacagaaaaccaaacaccacatgttctcactcataagtgggagttgaagaatgagaacacatggacacggagggaaacatcacacagcggggcgtgtcgagggttgtggggcaagggaagggagagcattaggacatatacctaatggatgaggggcttaaaacctaaatgacgggttgatgtttacagcaaaccaccatagcacatgtatacctatgtaacaaacctgcacattctgcacgtgtatcccagaacttaaagtataataaataaataaataaataaattctaaaaggtaattgtaaatggaacaacttactcactgtaacatgatgtgatttttgtgctctctctccctaccacaaaaagccatctcttatacccatgatagacatgtcatgttgtagaaaatctaccctagcttgcaaatgggttcaatatagtgaacccattatcctgtggacaacaggaaaccgcacttgtatctcttgttcacttccttattacccccacatcttctgtcaaaaaaataaaacacttacagatctggtcacagtatctctcaatttgactatcaataaactttaagcaatacttatataaaggtgactggcataaatgaagcatttcagagatgatatatacattatctcctcctatctttaaatgtagaatatgcttatgctggcaatgacttccacacaaattccaacaatatcatctttctttgtttttctacattgtgattctgtaagtgtaaaacacgctaatatttatttacattttaattgatcagcttacatgaactattcagtcagcttgaataatgaaaattttctatttactatgagtttttagccattttgttagtaacctgtttccaataaagatccaactcttgaaaaaggaatgtttatttttttaaaaaaggtattagttttctcccatttttttctaattataatttataaaataatcccaccattccagattacaaattaaaaatgttgtgagtgtttaaacctataagaagtggatttaccaaacaaccaaattggagactcttcaacaattaattgctttttcatatttcatggaaacacaaagatgcatatatactcacacagaataagacttagaataacaaatttttgcctgactcagatggatttatcaaatttcccaaacttgcctgaagaaattgcttatttttaacaacttttttaagtaagctaatgtatacagtagcaaggttaatgtagtttttcatgtggtaaaacaatcacatcaaaatgaaaatctggtcaagaggattttccttaaaacagaggggtcctttggaaaataaaaatttttcatgctttagcagagcactttaaacttatcaagggctataggaatccaaatacccaacttcagagtcagacctttgcacactctgaagtgtcatgaagtatcagcctaatttttgcaatacttttttagcaaggtgagattatgttttttttttaatttggcacataattattttgtcctttacctaattctctcttctggcatcctgactctatgaaaatgcatattttttttctaattgtggataaaaaaaggagaaagaaaacaaatatcattattaaattcactattctctctccttattttcttcttttatttagtttttaattgtgaagtattatttgcctacagaaaagtacgtaacatattgtgcagctcaatgaattaccagcaatggtccacctgtataattgccacctaggaaaagatagaacattaccagtgacccagcccccatttccttttcctcaatcatttttcactcttcccaaaggtaaccatccatgggatcatcaacactgccattcatgttgcttgcttgtgaacaattattatacagtgtgaattattttacccaacattaggttcataaaacccattaatggtgttgtttataagtgagatttgcttgttttcattgttgtgcaatattttattgtttgtgttcaaaaaaaaactttagatgaatgaaatttaacagagttgaattgagcaaagagccattcaggaattgaggagcccctcaaaccagataggttcagagcaactggggggctgccacaagattagataatatttatggacagaaagaagaaagtgacatacagaaaatggaagtgaagtacagaaacagctggattgattacagctccacatttgccttatttgaacacagtttgaacagttggtcacctatagttggctgaaactctgtgattggtacaagagtaggttacagtctgtttgtacatccagttaggtcacagttcactacgcatgaagaaaccttgaggccaaacttaaaatatgtaaggaggtatccagtctactctcaaagtatgtttgggctgtttccagtttagactattatgacaatgcttctacaaacatttctgtctcttggtatgtacattcatctagtgggtatgtacctaatgggggaaatttctgtattctaagatatgcatacgttagttttcagagatcatttatcagaatgattgactgaaccaatttgcaatcccaacaacagggtacaagcattctgatagtcccatgtccttgccaacacttgctattgtaaatctttttattttaatcattctggtggctgtggagtggtatttttttattttgtatttccccagtagttaataagattgctaccttttcatatatttattggccattggttatcttcttttatgaaaccacctatccatttttctgattgttgtctcatttattcttatagatttataggagttaatatttattgatgattttttgttaggtatatgtattataaatatcttctactgtggcttgtcttttcactctctttatggtatctttttaactatgaagtattattgcagtcaaattatcaatcttttcttttgtgttaatgcattttatgctgtgtttaataaatccttttctacccaaacttgtggatatattctcctatatagttttctagaagctttattgtttaccttttatatttatatctataggctgcatggtattaatttctgtgtatagtatgagttaagagacaagtttcattatttttcatacatatatctaattaacctagaactacttaatgaaaagacctccctttctctatagtacatactttagtgccagctgggtataaatcaagtgcctatgtatgcatggacaactttcatttatttatttggtttatccttgtacaactaaccaactgtcttaattactatattaatctatagtcatcaagagccagtttttttcttcttcctgaagagtatcttggcaatttttgtacttttgcaacttcatataaactttacattcagcttcaagcacatttacttgtgcacacacacatacacacaacctgggatttttaattgggaattcactgactgaatctatagatcaatttgaggagaacttatatctttacagtattaagtctctcaatcaatgaacatgctatatcttcatttattgaatcttcctttattttactcaaaaatagttttatagtttttcatgtagaggtctctcatatctttaaatgagtttgttcctagttatttgatcatttaatgctattgcaaatgatatgttttttaattctatgttgtcagtgttgctgttatatataaataaaatctttttttgaacactgattctgtaacatagcaagctgataactaatttattaattttagtaatttatcctttgttctcttagattttctacatacatattcatatcatcactaatccgtaacttttgtttcattctttccaattcctaaatacttttttctgattttttttcttggactacagagtctagcacaactccaattcaatgctgaatagaaatgttagcaatttgtgtcctttaagacagtcaaaaatttttattttattagtatgtatgatacttgatatagattttcttaaagtactctttataaaaataatgaacactttttaaagtttccaatttgctggttatttctaggtttgttttggttttgtttttctaagactggatgttgaactttatctgtaccttttcttcatctgccaagatcatataatttttctcttttggtcctaaagtagcgaattacaatgattgatttttgaatgccaaaccaatcttgctgtcctataataaaccctatctgtttatttatgcagttctccgtttgctaatttatttaccttttgaatctacaatcatgtgaaagattggcctataattgccttttattggaataactttgtcaggttttgttatcaaagttgtgctttctttataaaatggattgaatagtgtcttgcttttttctaacttcatgaagaatttgtgtacaattaaaattaattactccctcatatatttggtagattttgttagtaagaccactggccttacattttgtggtgcgtaggttttaattccggatttgaaatctttgatagttacaaaaccattcaaattttctatttctttggggaggaacttttttaggaacttgtccatatcatcttaattttcaaatttattggcataaatttgtacataagttatccttctattatctgtaacatctgtaacaatgtacttttaaaattcctgttacatttttgtgtcttcacttattttccttgtaagtttcaacagcttattttggtctttttaaagaaccaaacttctgtcagatcaaccttttaattgcatttcttatctattttgttaatttttgctcttaattattttcttccttgtacttgttcacatttaacttgctgatttttttcaacttctttaaattgatgagtaactcagaatacttttcttatacattgcaggctatcagtttccttcaatacaatttagctgcatcccatctactttcaaaacttgtgaaattttgatatggagtatttttattatcatcctattcaaagtacttttcatttctctggtgattttctttgacccatgacttcatttatgctcatttggggattttcttgttgtctcagtcccaccctcatttggcaagccctggaccccagttttattaccacctaaccattgaatacttttaaagtgttcctcagtttgttagtttcttagctttctttttttaaattggtatatgcccctcagggaaaaccatttccaaatatgaagctatctttctgggttattttcttctccaggactctgggcctataaatttttactgcctctttagctctgaaaacacattatgtattcaatttttctagttgttgtcagtgggaggattgttctgaatggcttcatccaccaaccattaccaaccattaccaaaattggaagtcaagattcccattacttttaatatttgattcctaaatgtaattatcaaataacattttatttgcattctacaagaatatttgagttccttgagttgcaatttttataacaaagattaaaaaactcaagtatgcttttatgtgggtgataacaactctaatcaaggctaaaactttaatagaaatgaatgcccaattagcattttcattcataaatttattgttctaattttgttatacatattaacatcttttagtctttggctatcatcttgttcacattttattattattttttcaattagctattttgaccagaaaatcctcatatggatgtaaaaataaatattttattttgcttttacctttcaaaagctgggcaaataattattttgcttttaagaagaaggtatctaaaatgcattgtaacttattttgaaaaatgggttccagatatcagaggttagcctgttctgaatataatacatcaggggaatagcttagaatataaccaaagggtgtacttaccccacgtataaaatttagacatattacgtagtgggaactcgtggttgtaattaaaatatgcctgatattatagtaaatcgaatcctgttaagtcattcacgtattgatagaactacatgaaagtagtattgtatctctttatttccaccgtgagtataaaactaacttcttttagaaggcctattaatagttcacatatagcatgtattagtctaataatattgccataaaaaataacacagactcggtggcttaacaatggaaatttatttcctcaaaggtctagaggctggaagtccaagatcaaggtgtcagccagtttggtgcctcctgaggcctctccccttggcttgcagatggtcaccttcttgctgtgtcctcacatggcctttcttccatgcatgtgcatccctggtgtctcttccttttctgataaggacaccagtcatatcggattagaatccatgcttacaatctcactataccttgattacttagttaaaggtcctatctccaaataacaatcacattgtgggttagaatttcaggacatgaatttgagagagaaataatttagtccataacacagcacatattcattcaaaaaaacattacccacttaatatgggacaaggactgttcctatatcaaaaattataaaggacggaaataaacaaaaatgtttaaagcctaatacattgttatttttaaaaagataaaggaattggcagtatagggttgtggggagttattttagatagagtggtgataaaagattgttataaaaagatatcctctgagcagaaacctgaaaaaattgaaggaagacggaatttatgaattatagaggagaaaattttaggcataaccatttgcaaatgcaagggccctgggacatatatcggcatggctctatagaggaaatttcaagaaagccattgagagaatggtaagaaataaagtcagacaattgacctaagatcagtatacatagagtcttgtaaaccttggtagagatttttattttattttttaaagagtcctgggaagccactggaagctttgataggggaatcccattgatctgattttcgtttataaaggcaccatggtaatagacttaggagaggtactctctagaatgtaagtaaatggggaaaccacataagtagttcagtagtagagtcaaagatgtcatctttgaattgggtgtcagcagtagacaggatgagatgaggtaggatttgggatgtaatttgaatgtaatggtgacaggacttgctattgaagaagatgtttgaaaattcctatttttggtctaagaaataaagtaaatagtggtgctattccctgacatggtgtggactggcttgaaggagagttaatttgggagtaaaataaaatgagttctgttttagatgtcataagttagagatgcatattgaattgcaagtgagaatcatgtaggcttttatctatagctctctagaaagagtcaaggtagggggctagaaatgtaaattctagtgttatcaaagtatactgtagatcatagtcaaagtcaggggactcgttgatattgtccatggtgagactatggacagagaagagaagcagtctaaggactgagcccaagaacactccaacatttaaaagatggagaagaggattctgcaacaagattgtaagagtaggaagtcaattaaaagtagaacaaagcaagtatgtgatgctgaagccaacactaatatgtgtgatcccatgatcattaacaagctatgtttctagagaatataacaaaaaataatcctttcaatattatttatttaactggaaatctgaaaatttgtattaaatataggcatagcaatattaatgtcacctaactaatgaataatcaagcccttggaaagaaagcatatacctgtgattataataaaaggtaattaattatagggttgaacaggaagggggaagaactatcatttaaacatgttatactaaatatttatcatgcttcttttggctgggtctttcataatctcataaaagagaattaaatatggagtgatgaaaatatagagatctatgttgatgttaagcagaaaaaattctcactacttgcaagttaatttggtgttgaatatagatgacttcagatcctcaataaatactagttgatgttctttttatctctttgcttctttctacaggcggggaagtcccgtacacgactctggctacccgaatgatgatgggggcttggtggctatttgctttgattgttatctcatcttacacggcaaacctcgctgctttcctcactattacacgcattgaaagttccatccagtaagtaaacaatgtttccattagccacaaaatatgagaaatgataagagtggccaaagctatctgagaataagtatgtggtgtctcataataaatgtacaacttctctttgagtaaaggatcaattttgtgttactgcaaagtatcactgattagtccaagtcctggaaatgcagtattggtagagcattttttataaagtaaaaatttggctatgatttcaatgttgcttcccacattttcctggaaggataacacatcttcagaattttagtgtccacaaagaatgactatatctgactaacactgtgaaaaggaagaaaaaaaagagtcatacttaaaaggaaatctttgccttgagtctgtcccattatgtactgtcagaataaatagttgaatagatacagatgtttgagagatagacggatgattggggattggggagaaaagaaaagggaggggaatagcaatcaacagaaaattatagtatttcagtaaccacattctgtttttctcttcattaccttatacttcatgtggtccttattgctgctatttactggttgcagttggaatgctgggaaatagtgattaactatggtgcacttatttaatcctaaaagttacctaagccagtgtctcaattcacaaatgccatttccgtaagcccgtggagcccaagggccttttatccaccacagccagttttgcttttgtggtttcatgctataagatcaacaccacagtataatttctgccttattagaacataatgttctatatattgttttaagaaaaattttcctgaaaatgttttattcatccccaaacaaggtaagtttgaattttcctaaagttggacattcatttcccaaaaagctgacaattcaaattcagaataattagatatgtcagggaattccttaggaatgtaacttgtttggaaaagaaaatctgggtagttattttcttttaaaaagaatgtaaattaaattcattagtagccacaaaactattatagcataataccaaaaaagttaagaattaattatctataaataaatagggtattattttctatttgctcattatacaaattgaaactcccatattcaactagtaatgctaataagtagtcaattattttatccattcataaaattgatgtttctagtttctctcatgaaatcatgctgctcaagttgttttccaattattcctttgatacagaaccttcatattcccccaatttattgtccatgtaaatagatctatgtgtgacataaattacaaatcatacagagtgaaacttataccattgatggaaagcttatactggtgaccccataagcatcatactttaagcaatatgaaaatgattacaacagcccagccaaaagatcaatgaaatgagtaaaattatgaaaataataataaacatttattgatcacttacaaaaagccagattttgtgatgcattagcttatttaaaacttactatcatcttcaaaaatacatactatgaataactcattttataaatgacaaaactaaagttgagaggataagtaactcacccaaagcctgcagctagtaagtgactgagtaaagaccaaatcttaaatctggttcctgagcctacattctaactgcatcatgttagttcccacaccacacttgaacttgaatttctgtatgaatcttaggttttagagaacacaagaagaaactcgtcatagcattttccattgctaagggatgtaaaggatgaaattctccaaatcctcaactggtctgaggaaatagagtatcaaaagttaggtgacttttgtgttataggcatgtaggcatatatcccaacatgagttaattatgtctataattggtatctaccattcagggtaagactttggcaaatccaatcaatagaagtcattttaagaaaaatagcttaattgtcaaataaaaattgtacatatttaagttatacaatgtgatgattcaatatacatatacattgtgaaataattgacacaatcaaatgcaccacccatgctgtgcattagattcccacaactggttcatcttctgaaagttcgtaccctttgaccgacatctccacattttccctatactctagcccctggcaaccaccattctactcctgcttctacgagtttgacttttctagattctacatataagtgatatcatataatatttgtctttctgtgtttggcttatttcacctagtgtaatatcctccaagttcatccatgttgttgcaaatggcaaatagcaaaacagtttttaatcaataaaattgagtattttatttcattaacatatttcttatcaattatgttgaatgtgtcacattttgggtatccttaaagctcaaaatttatgtagttcacatctgactttgaagtgtttttaaataaataaatcgtaaaaagtttaaataaaataactgatcctatgcagtaaacaacaactgtcattatagtaaacaaaaaatcatggttaacattgactgagaatttataatgaaccagaagttaagcatattacaaatatcatctcatttattccacaaaataaccttaataatacaagtactcttcttattgccattttatggatgaagaaacagagtttggaagataatgcttaagattacacactcaataagtgtcagagttgagagtccaatccatgtcaatcagacaccaatccgtggccttacctgtcaaattcttttttttttcttttttttaatctagtggtgggtcctagaatttgtttgcttgatatggtatttctctgaggttgcagactttgtggtgtctgtaaatctgagttatttagttattactaactttgccagcaccagtttttatctagactttcatgcaatagcagtgggaggagaagcctgtctcaaatttttcatccataggtttatctaaaagtaaaacctgatggaaaaagattgtaatttcacatcatgtttccctcaagtgtagttctactgcccaaagtaactttgcattcatttttttaaaaaatcattcctttccaatgccaactggcattattaaaagtcatcagtgggtataataaatctctacttccttgtaatattatcactggactaattttggaatgagagaatcagagccaaataagttaaaagaagccagattccctcccgaaatttaaagatatcttctaatttcatgcctcaacagtgttggtaaacataattgcctgcagtgtttcttagaaacattcaaaatctcatttgtaactaatgccaaagtttcttgggaaaattctaatttttcttagaaaagacaaactttttttcaaagtagcattcaatgtcatgcttcttaatcatttatattaataagatttgctcatcaccaaatgaagctgcagtgcatgtcaatgtactatttccagcccaattttgctgtgccattggcaaacacatgccaaccatagcttcatttccaaaattcagcgttgcttctgcagactacaatgggcagaggtggttagaggaatgtcagtgaaggggagagagagagagagggagagaaatcagcttctttgaattgatggttgacagaaactcttccactttgctgggagcaatctaatagatttattttggggaagctgaataatttcataaaattttaccttgtttttaaaattagatatctatgggcatctaatctaactggcacttgttattaataaaagttttgaaagggaattttccctggaaaagataacccataaatttaatttcatatcccttcagtgatatgggcagcacatcataactatgtcctatgtttaatataatataatgagacagagtatgacacagttcagttcttaaagggaaaaaaaatgccatttccacaagactctaatgacaatttgggctttttcattcccattgagaggtaacaacatatagttaattgttttcaaacacctagaaattggaatgattttttttctcttgataactagactaatagtggcaatggtgaaatggagcatgtgaagctttgaaggtacttcagagtaagcactggataatagcatcatcaacattagttctgtttgcctttattgtgatattacttccaaaagctacctagttcacataaaagtgaaaatagctatgggaaaatcagggttacacagttatagttattaataactttagaatcaaactggtctttggtgatgaaacttgagttttttcattcccaggagctgcaagtaaacttggacctactcaaagggatcccaacatcccaccatatttttgtgttcagtgctttcattctccataatgcttaaggttggactaaacaaaatattgagttaattctgccactgaatctaactaatatgggatagcattgctttccaaactgatacagaaagagatccataaatattctattactaaagaagaaccccttttccctagcatatcaataacaggatttttgccatcaccttggtctacattttgaaaagaaaataattattgagcaatttttttctaagtgttcacaggtgagtatgatctaattatgcttagaaattcaagcatcaccaaatctggtactaaagcctggagacagagggaaggatagcaagtgacagatgctctgtaaagaaaaggaaagtgggactaaatcatcgagggcatggtaagacttgttaaggaatttggaatttttcctggaggtaatggagagtgacgttgtagaaagacaactttatctctggagaggaggacatgtgggagagagaaaatgtaggcatgcatgggaggccgttaaaggtgtctaatgcatgtatatttacagcaattaactagtatgtctctacttgatacgaatatgtctctacttttttcaagggctacttaatttgataatactagaggattaagggtaacttagaaatttggcttcagaaacttcatatttctaggctaatatttacttatgtagtggatgtaagaatattgcctcagttaattttgtttaagatatttaaagagaggatgtggcttactatgttttagctaactaagtaaaaaggaagacagtgattaatgaggaaattctggaaatgactctgtttaggctgcgtttcacatgcaattttgcagaaaagttgcatctcaaggtctactattcgtgggccccatctgcctctcacttttagctttgagccatcaacaaagaagttagacttatttttattccatttgaatgcatttttttcctgattgtaaaaaaaaaaaaaaacaggctgttttgagaaaataggaaagtacaaaaagatgtcgaaggacaaagcattaataatccataaactgtcatggggcagtaagttctgttaatatttggacaaactttcttataacttttaattttgcaattattatatatacacaggaagtttcaaagatatagtacagagcagtgtcatgtattcttctctcagttccctgaatttttgcatattaagtgattatactacaaaattaaaaccaggaaattgacattggtacaatgtgtgcaaattgctctatgacatattattacatatgtagactcctataatcaccactgcaatcaagatacagaactattccatcacggcaaagatctctctcattctacccctttatagtcacattcacccttccttaccaaccccaacctctggtaacttactgtgttccccatttctgtaagttttgcgtttcaagagtgtaatataggattgaatcagagtatgtggcctttcgaaaatggctttcttattgattcagcataatatccttgagatctatccaagttgttgtatgtaatagttcattgctttttattgctaagtaataatccatggtatggatgtaccacagttggtttagcaatttacttactgaatgacatttttattgtttcaagttttgggctattacatataaagcttctaagaacacttacatggcagttttctgtggattttttgtttgtttgtttctctggcataaatgcccaggaatacaattgctcggtcatgtgttaagtatatatttgttttttaagaaactgccctactaatttccagagtggctgtaccattttgtgtttccacctgcattgtatgagagatcaagggtgtctgcatctgtgtcagcatttggtggtatcatttttttttttttagccttgctgataggtatgtggtgatgtctcattgtggttttaatttctattttattattgtgtagtggtattgaacatctgttcatgggctcatttgtaatccttatcctcttccatgaaaggtgttttcatgctttttgcctattttctaattgggttgtttactattaagagttcttcacatagtccagacacaaaggctttgtcatataggtggtttgcaaatattttctcctagtctgtagcttgtattttcatcctctttatagggttcatcatagaacaaaagttttagaagttgatgaagtgcaatgtatcaattttttcattttatggattgtgcttttggtttcatgtctagcactcttcaataagtccaaggtcatgaagattttctcctatttcttctaaaagttttatagttttacattacacatttacatatttgatgcattttgagttaattttgtataaagtgcaacgtttaggttcaatttttcactatggatattcaaatgctcaagcagcattgctgaaaagactatcctttcttcattgaattgttttgcacctttgtacaaaaaaaaaaatctgttggccatactatgtgagtctgtttctgtgttcctaccctgtttcattaatctgtgttgtctatccctctgccggtaacacagttttgattactgtagtttgagtagagtgattcttcccacctattttttcagaatcattttagctattttagttcctttgtctttttattataaattatagaataatcttgtctatatctacaaaaatattgctgaaatattgacagtaattgcattaaataaattggagtgagaattcacatttttaatatgatgagtcttctgatctgtaaacatatgtctccccacttatttagatctttgatttattttatcagcactttataattttcattatacaagtcctgtacatgttttgttagatttgtgcctaagtatttctttttctcagtgattacaaacgttcttggtatctcgatccatttgtgctgctataacaaaatacctaggtctgagtaatttataaagaatagaaatttatttcctcacagttctggatgctgggaagtccaatatcaaggtgccagcaggttgagagtctggtgagggccaggtttctgcttccaagatggtactttgactgctgttctatgtcctcacatgacagaaaagatggaaggtcaaaaggggccaaactcattccatcaagcttttttataaggaactaatcccagccatgagagcagagcctttatggcctgattgtctcctaaaggtccccctcttaatattgttgaactagggattaaatttcaatatgaactctggaaggaacccaagtattaaaatcatagtaattgaatttttaattttaattttcacatattcattactaggatatagaaatacaattgttttttgtctgctgattttatcttgtaatcttgctaagctcatatcttacttctaggggtttttggtagatcctttcggatttcctaggtataatttgtaaacttactaagctcctttattagttttaggagtttttggtagattctttggatttttctaggtatagcttatgccatttacaaagtcaggtggttgtatcatttttctttctcatccagataccttttattttctattttgccttttctttgctggatagaatttacaatactatgtcaaattaagagtagtgagagtgaatatctctgctttgttcctgatcttgctggaaaagcagtctttgaccgttaggtatgacattatctgtaaagttttttattgtagatattatttctcaaattgaggaagttatcttctattcctagttttccatgtgtttttcgtcatgaataggtgttggattttgacaaatgatttcattttttattgattggtatgctcgggtaatttttctttattagcctgtttagtggattacatcattcatttcaacaactatttttaaaacaaggtagaggctaactatattccccgcttctatttcttctccatctttttctccaagtcttgattttctacttgattttcttcccattattgattcgagtcaataaaatatcatgactgtccctgcctgctgcttcacatcttagtttcttttcccttaccttaactattgttcctctttctccattctcttcccaatagagtttatccactggagtgtggagtccagactgttaccttctcccatcctcaaaattggcttgaaaaactttattattacttcatccaataaagatgaatacaactccattagcaaagcatattgagcccttctttcccacccacatttctgtccaggggcaccaacaaattccttctcactttttcatgctacagtcaagctagactcttatgggaccttgcatgcctctctggagctttacatgctcttctctctccctgaaatcactcaaaacccccttctcttccggtatcttccattttcccaggcagaattagccattactacacatgtgccttctctttgcgattttaagttcttcaaaagcaaagactatgttatatccatcttgagaggcactgctagagtgcctctcagagtacctaacaatagtatgaataagagcagctaatatttcttgagtgcttgctatgtgacagctagttttctaaatactttgcatgggttttctcatttagtcttcgtaatagccccatgagagatatgttattatcatctctattttatagatgatgaaactgaagctagggtagtaaacccaggcaatctagcactataactttttaccaggggaacatattgtatgctaattacaaatacgctaaacctttattgtatgaaataaataaatgaataaatggcatccataagggttactataaatttcttaggaaataaagagagctttgcagaaaagaataaatggcagcagtatgtttagctaagttacttccaggtatttctaagttatgtggtatgcaagtcagtaacgggagactggattcaaacaaatctgcattcgaattctttgccacttaatagctcaatgaccttgtcaggattccataattattataaaccatattttcctaagagtaaaaaagggatagattcaacttcataggtttagtgtagtgtttagtgtaaagattaagtgaaaaagagcatgaataatataacacagtccatggacagcacctacctaacatttgcttccattcttctacattttctctaggcactcatatagattccttggcctgtctttctctctgcccccattttgatggtatttttgtcattttgtccacaattctatatattaattgttcctttgagctgattcacctaaatctcaatgtttcttgcttatggagctactgtttctgacacagatgtcaccatcctaccttacagtctatcttgctgagggttgtctttttgccctgctgcttaatcctctcattttccccaaagataaaagcaaaataaacaaacaaaaatctgatgcatctgcaagccttatctgaatttaggcataaataaggtcttggaagaatgattcactctgttatctcaccttagctagtgactaactagcactgagatcaggttgctactaatagagactggcaagacccctgggtcaggatatatatttgccaggtaagttttctctcctaactcacctttatttagccctctcataatacacagctcaaatactcaaatatgtccttgccacatattcataactatatttagtgtctcccttttttgaaccacttcacatctacctcacttacaccctgtattggaatactattctacttgttttacttccctattaaaatgcatattcttgagggttgttttatcatctttgtaccagttcagtgccttatgtagtgtattgtgtgagtacttagtgggttacaagtaaatattcactcactgagtgaactagaaagacattttttagaatctgacctgagagtgtgaaactccatgacttgtatgtgtaccccatttaaaaaattagatagaaatatgaaagccatttctttgtcctattattccaggataagagaggaaacccaaaatggtatgctctctaagtatcctttgtgtcacccactcactcttcagtcttccagtaggagtcttttttatagctctcagtagggaattgcacactttattaggaggagccaaaatgaaggtggatgaagtgagcgagggctggctcatactgcctttctgtttcattttagtacagaattgtataggcttaactccagaacacacaagcactgcagcagaggaagacattcatctccttactctctattgttagtgttgaaatggcttacttgtcctagcacttaagtactacagtgatggatgtttcccaaacgtacagctatctcgatgtcatagacagaattttgtctctgttttggaaaaaaattaaaacttcctagaagtatattggtctttcaaagccacctttcagtgagcatttaattaaaagttgtctcacagtttgtggctcccaggaacagggctatgttagcatttccatagactctgtttacactgagctcaccaggacaaaaactttaccaattttataatcttccacagcttctaaaataatcttcttctgaacaagatgaatcattctagacaaatcaaatccttctctttttctctttcttcccaatcttgctcctttaagcctagaaacctattaagtgctgtgctcaagaatataaattcctgtctcttctccattttctgttacttcctccccttactgaagtctgctggataaataaattctatccaccacaaacttatagatatggttaaaaaaagaacctatgcttggagtatactgcttagtcattgtggaggacatagtttgagtacagagcatccttttgtgaaattaatgtgggaagagtagtgatgaaaatcagcaagactggagttggcagccggggctgtttggcagaagaatactattaaaggagactgaagacttaggttcaagtctcttttctcctactaaagaataaggcaaattctaaaactactttgcacttcagtttttcgtcttttaaaaaagtgatccaattcttcgctcactgcacaaatatttgctccacagtttgaatgatgttattttccatgtcccttcaggcataaacttttatatcaactataccaatgagatatcttaataaacaaggtgtgagataaaactgatactcaactgaaaacctgaataacagatatcttaagttgaaaggcaaatctgaaaaaaaaaatccttttttgtcatatcttcttattttctttttctagttctctatttccagtcctatttttctttccctagcctctccatcatgccagtgatgttggtatgctgccctccacactctactgctaagtatctgtttgaccccatcaattctctgatgctcttagttcctccatagttcctgtcacctaaagatatttaatttattttaatggctctctcctccactccccccccccacacacacacgcacaccacacacacacacacacacacacgtactacagcctccatttctcaagcccagatgctaaagagggatgatgctaaataagagccagataccccagctaatagcaagtggtgaggaaggcgaggaataaggtctaaagctggctggtgggctgcttttattcagaggacgattgtcattttctgagagggatgctacagagttctcaagatttgctgttgtcttgggagtgtggagcacatttgcaaaacagttcgggcatttataatctcaaaatagcagttaataagacctggctctcaggcatcaagatatgcatttaatatcaacttctgctgaaatttctcaaaaaggaaataccacctacttgagaatagaggataatttctctgaatcattctgaatcagtcattgtggaggacgtagtttgagtatggagcatccttctgtgaaattaatgtgggaagagtagtgatgaaaatcagcaagactggagttggcaggcagagctgtttggcagaagaatattattaaaggagactgaagacttaggttcaagtctcttttctcctactaaaaaataaggcaaattctttttattttattattatactttaagttttagggtacatgtgcacaacgtgcaggtttgttacatatgtatacatgtgccatgttggtgtgctgcacccattaactcatcatttagcattaggtatgtcacctaatgctatccctctcccctccccccaccccacaacagtcctcggtgtgtgatgttccccttcctgtgtccatgtgttctcattgttcaattcccacctatgagtgagaacatgcggtgttcggttttttgtccttgcaatagtttgctgagaaggatggtttccagcttcacccatgtccctacaaaggacatgaactcaaaccactttgcacttcagtttttcgtcttttaaaaaagtgatccaattcttcgctcactgcacaaatatttgttccacagtttgaatgatgttattttccatgtcccttcaggcataaacttttatatcaactataccaatgagatatcttaataaacaaggtgtgagataaatttaaaaaaaatatttattttgagaaattcacagacctactggactgagaagaggaatgtatcttttgcatttggaaaatgttgagttatcagtagaaacttggccccctgttcctgtgttataaagagccaggatttttggtttttgtcatattcattagatacttcactgaaactgtgaccttctaccttactttgacagtaatgtttcactgggtctttaaataggctactaaattagcctacacttattcatggtaacttatttctcctagtcttttatttcccactatgaaatttttgatagtatgattaatgtttttgagctcctcaaaagatcttatagaggaaaaaaatcacaaattattatggattcctcatttgaattcacactgtatttcatttgggtcattgtttcatgtagtattattatgtattattgtttcagagcttgttagtaggccatatgcaaggtagtgatcaataatatttcaatgtcagccttggagggtatattgaataatttttttccataagtcagcattggtcttgattctaattaacattttcaatgttaatttgaagtatggaatagggagtaagcttattaaatatgcagattactctatattgagtaggggtgattattgactagaactccactgtaagaatgtataaggacctttacaaataaaacaaggtgattagaagtacgatgaagtttaatagggacgaatatgtgataatcactcagagatggaaaaaacaaactgtatgcgtatatttgtgtatacctatgataatttcagtataaaccatctgtcaattataaatctgaaatgtggcattagtgtttatttttaaaatgaccagagtaacctagcagcatgtaagttgttcaagccttgtaaagactaccatgacctacttagaaggttcacaaattatgcaaaaactaaaatacaagagaaaaaaaaatggtttagttaataacagtctaaaaatggaagtaatatatcttatagataacaactaaaataatttagtatttaatttgacaaagagaaggctaaaggaggaaaatgaaaaagaagtgttttattacatagagaaatattgtaccagaggtggtatgcaggtattgtccattttcattgagaacaaaatagtgttttctgtgaaacaggagattttggggctatgtacaagtaaggactcccttgtgttaagttttccaagtcactgaagtatcttattaaaaaaaacatgaagtcagttttagggactggtttatgtgccttaaggtacctaatcatattatgtaatgcctctggtaactctttcaactctctggtattatgattattttagtatgtttttgttaacaccatttaaaaatgtgatccttccagggaaattaacgggaattagtgaagtccttcctgaattttcaagaatataggaatatgaaaatcccctatttcactactgaaatctattgcattatttgaagatatcatcttaacataaattttacaatcatcctataatcagcagtaacattgtaaaatgctgaccataaaatttaggataattttgtatttcttcctagtgtcttgagataaataagtattgcagcttttttatgatatataaaaaagaaactgcacatgctttttaccatgcacaggaaaactgcaggataattgaatgtacagaatactaggaccttttatagtgaagatttgcttaataatttatatattataatatatattttattagatatcatacacatatattaaatataatatatctaaaatggcctttcatggtatatacatgtatatttattttataatgtatttattattaaatattaatatataccaaatatttgtttatttaactaatagccatttaaaatagagaaaaggatcataaatgatatttctgtcaacactgtcagagttttgaggtttgtggtagaaaaatacagtgtctgccacatttcagggttcatgatgtgacacaattagtttctagcttgtaatgtgggtcaataagtcagacaagccagtcagattttcagatgactgttctcttgcatctgtataacaccatcatttcacagagagtttaacaatcatttttattggttatagccaacagcagtaagacgtgcagcatttccatcttcccttagattctctaaaatggcctgccgtgtccacatatctgaactaactcctaagtttgtaaggaaagtgcagatctttttaatgcaaggggatgttcccctaagtagtccatgacatctacccttcccaagggcatctactttacataaacttacaattttacctgtgaccatctgactgtaccacatggtgggtagggctgacccagaatactttcgtcgggacagagtgcagaaaatattcccaagtctgtcagggtagacttcagggtcatctgctggtctgtaatccccacactttgtaatctaatctaccacaggaggaccgtgttctgccaggtagatgtgcccttctcatgaatcttgctgcgcactttttctagaccaaacgcatcttatattctggtggctatttaaacagttctaaaaaaattaaaatgaaatagacactctaaaggagttcaaaccagaaggacctgaggctgtcttttatctaatgtattctgttgtgccacatgaggagagttagggggaagatgaaagactcaggacaggagtggggaaagggacagaatggagcgactagaaaaggctgcatcatttagaccttattcaagcattccacatggaggtgcccatcttctgaccctccgtaaatctctaaccctctttgttcctcctatggcaccctctccatccagaaggcttcatttgaaaagttctctccatttcccaaaatggagtcctaaccctctgccttgcctggtatcattctaccgtgctggcctcagacctcagcttgctcttccaaaggcttctgctgtgttgaggaggaagagactctggcaccataacaggaaggaagacacagcactttggtgctggtacattccttcattagagattgctgtctctgggttcctcctgaattaccccacaccgtgaggaatacttttaggctatacaatctaatcttctctgagagaaccctatgtcttccattaacatgactttgacattaatcttttttaaaataggaaacttagtgctattaagctaaaaactctttcctgagcctactttcattaaataaggacaccccttcaggcactaaaaatatcttttacagagctcttaattatggaccaagccaccttgaaaacatcaggagtcctttttatcccaccgtatactcttgatacctttacatttcaccagactttacaagcttgagtctgaggtagttaagaaaacttcactaaggaaaaggagctactaagtaagataggaatgtgacttctcaaagaacaagtggccattggctacgccgtaaataggaaggtggaaggcttattccatttgtccatacatagagcgtacatactctccttcctcctcattatctaaatattcaaccaagaaaaacaatcctgaaatataattttctgtagtaatcctcaacattgccaaaggtgactgtcctcgacttgttctgctgcttatctcaagattctttagctactaaaatcatgaattcttttacatatttataagcatttcaattaagcaattttcttcaccatttcagtttgcttccaatatttcagtgaaaaaatcactcagttcatgtaccccttatcttctctgtctgcactgctcagataagtaactttttcaagagcaaatattctactttgtaccaggtcctatgtctaccagaatcacagactataccctcagctttttgaaatacgttttttggtcctaattgtttgtgttttctttttatttgccttgcctctgaatttatttattttacatatgtggcaaaatattatgacaggcaattcactggaggttcaatgaagcttgcccagctgattgtgttacagaggaaattgccaaatatttctttaaaaatgaacaatgagaacacatggacacaggaaggggaacatcacacaccggagactgctgtggggtgggggaattgggagggatagcattaggagatatacctaatgctaaatgacgagttaatgagtgcagcacaccagcatggcacatgtatacatatgtaacaaacctgcacgttgtgcacatgtaccctaaaacttaaagtataatataataaaataaaaaagttttagattttttattttgtttttgatttttttttttttttttgacggagtcttggtctgtagcccaggctggggtgcagtggtgtgatatcggctcactgcaacctctgcctccgggttcaagcgattctcctgcctcagcctcccgagtagttgggactgcaggcacccaccaccatgctcagctaagtttttgtattttagtagagacagggtttcaccatgttggccaggatactctccatctccttacctcatgatctgcccgccttggcctcccaaagggctgggattacaggcatgagccaccatgcctggccttgtttttgattttttaactacaaatacttctggtcatgattagtcagctgtagaatggctaataatatatagttaaaatgctattattatgccatgctagtttcaggggaatgcttacttcccaaaatgaaatatccttctagtgaagaagaccaccataaaacaagtaagcctcattgattgctgactgttttccagaccctgggctagatctggatttcaaagatgaagttttttaaaaatcatgggaaccagcaatctatattctagtgaggtaaataaacaaatacaattcctaaacacaatgctgaaatgtgaacatattccaagtgttagaagagcactgaagagacagtgaagtttcatgttgaaaggaaggaattctccaggtagacagagaagcatcttatgccaagaagacatctaccaagacatgcacctgtgatacagccaggaatgaagaaacagtgtttggcttatactgtgaatatgagtaaggcaaaaggttgtttctgagaatggaaatagaaaaggcttaagccaaatttttgaaggaacttgaaggctaaggagtttaaactgttttctaagggcagtgaagtacataggcagtacttaaacaaggcagcagtatgatcagattgcatatcagaaagaacagtttagctgtgctaaagaatggattagtggtgagtgagaacagagatagggaaaggcttaaaaataatagtccaggtagaaataacaaggctattagacgtggaaaggcaaagatggtgacagatttacaaaatttaggaggtaaaatatacagaacttgatgagagtagatgaggtggggaagttaaagatccacaggtaaggaaggggattagctgagaatgaatctaattgataggaaacaaggatacggcaattccagaaatcataatagagaacaaagtaatagtaatcatcataataacatcaataattttaactactggtaattgagtgctcatagctaattactaagaaaagtgtcttataaacaatatctaattcaaacctctagataccttaatataaaagtattagttcctctgctcaatagagaaagaaattgcattttggagaagtttaaataattttcccaaagattgaaacacaaatatttatgttttcacaattcatgcttttagaaactaagtgtttgctcagtgctggtcagttggcagtacctcttggggatggcctgccttacccaagcaccccagtccattttgtaacactttgacttgcttcttgggtctaaacaacattaattctcaccctcacggcatattagttgttcctttaaatgctacattttggatcactttttatgctggaaaacttgtcaccgcacttcataggacagctctcagctgctacaaccaatggacaggcaggctgtttacatggttgctaatgagctctcagggctgtaacaatatctgtcctttgacagttgctgaaatcagcatccaaaggagaaaactgagaagagaataggggggaacctaaactgagttggaggatgcttgtcatatacccctatttgtctcttttccactgttagcccttttgcctgaagcatctggtgcctatcctatcagccacgttccatttttctccccctgaagaaaaatctcctctgatgtgataacttaagttgacttgttccaccccatagaaaatgggattagacttaaaattccccaaagccagctgtcaggccactcttgtcagttattgatgagcgttctacacaaccaggctaaatgtagtttttaatcttagaagacaaagaagatggagatgggacagagaggtttatgagagttatttaagttttatgtggatagtgacatctactgtcttgttaaaggaagataggaaaaaaatataagtgaaagtttaccacagaggggttacgcattagattttttaaaaaaatagttgacagttttagagatgtgtttttaacaacgtatttaatataacattatttcattaatataaaattgtataaatgtcccagagagtttgctatgaagaaatttatgaccatttagtatcatagagtcacacaatctcatacttggaagggaaatcatgcattatttattctatttcagtgcatgaattcttcttcaacaatatttataaagaatcacctgactctgccaggggggaaaaattccacaaaaaaataccaatagaaattattaaataaggcattgtggaaggaggaatcatcaacatcataatctttatataaaaacagtagaaacctgatcaaatactgatttgacagatatgcttgactttaaaatctaacctactcaatgttaaagctattgctgtcagatatatctaatagactatcaaatatttaaaaaatttaattgtattatttttattttttattttcctttgagagggagtctcgctctgttgccaaaactggagtgcggtggcacagtctcagctcactgcaacctccgccttctgggttcaagtgattcccctgcctcagccttgtgagtagctgggattacaggtgtgtaccagcacgcccagctaagttttgtatttttagtagagacagggtttcaccatgttggccaggctggtctcaatatcctgacctcaagtgatctgcccacctcagcctcccaaagtgctgggattacagacatgagccactgcgcctggccccaaattaattttaaatgcttgaaaagagtttcagtgtttattgaaagaattttacagaaacctaaagccactcaaattttaaaaatttattttcacagaattgccttaaatcacacagtacctcagtgtatgtactgttcatacaaataactaaatataacttactcgtaagctctcagtattgttcagtacccacaggttgatgctagtctgatcagagaacagtagcaggaataaaaaaataatctcagtcaggtgtcaagaagataaggctgattagagcagcaaagcattttctttcttttatcatccaccacttagagctatagacactcatttttttactgtgtgcatgagtaagactgtgggtttgagagaagagacctcaggtctaatgggttctcagagtgagcattcactgagttttatgtgagatatgtggttaggtagagaaacagagtatactatgagttatacatactaatactatgttcacagataacacttctctggagtactctagatttttccattccttcttctttttttttttttttcttttctgagaatgagttttgctcttgtcgcccaggctagagtgcaatggtgcaatctcagctcactgcaacctccatctctcgggttcaagcaattctacctcagcctcctgagtatctgggattacaggtgcatgccaccacatccagctaattttttttttgtctttttaatagagacagggttttgccatgttggccaggctggtctcgaactcctgacctcaagtgatccacccaccttggcctcccaaagtgctgggattacaggcatgagccaccatgcctggctgattttcccattcctcctatcatctgagaaaatgtctattgttaaaaaagaaatgtctgtatttgacatggtatattaatgtatatattagatgcctattaatgattctatgattgttttacattttaaaacaatgattaggcatgtctaaatattatacactcagattttgaccttcagatacaagtttttgaagattaccatttgttgaatgacctactatatttcctttaaaggctcataatataggctacagcatttctgctaatcttgttctaaactcttcttagtatgaaaaatacaaagtgaccgcttgtaatagttactccctttctattttgggctcctgaaatggccttttcatttggtaataagctatttgtgttcacttcattttgcttcagtcgttttatttttgtcatctttggtgctatcttagtgtgctatgatggaacatgctgaatcagaaaacctgtaatttttattgcaaacatgtctcaaggcaaatttataagttgcagttgatatcagaaactactagagggaacatgcctttgttctaaattacaaaatgctctgctattctaaacttgaagtatgttgaatataaactgccttttttgtaacaccaggagcttcacatgggcaatatattaagatattcctctaaaaatgcattgtgtacaaaacaacttctccagctaaactgtattaaaactctatattttcaggctgtaaagctaatatttaaggtgaagctatgtcacagaaacctgatcatattaaagatcttaacatttgatttcagttttcttttcatagaaggataagaaggagcactaatttatttagcagcatttagccagggtgactatttgggcaacccatttatatatttaaatgaaggcactgaaaaaaaaactgcactaaactgtgatctcacctccattagattaaaaccttctgatcattatagttgagtttgattgttagtactgccagacagccaagggcccaatcttgtactggtagggtgtctggtgacctgcaatatgggctttctccaactatagacctgcaggttctagatgatgctgtgtacaaccatctggtcttcacctttgtatttatagaaactgaacaaacgagtattgttgttataacctgtgtagatatattccattccttcttcctgtgttaccacttttgggtatcctccactaaacagggggatatatgtttaaaatgttcatgtttataatacagttttactgatactactgaaaacagcagtaaattgctctcttgaaacaaaatttttgttgttataatatatcaagataattatggtatgacctacaagtaaatgtccactcactttgttattcagttgcatcctagctacatactcattttactcttgcttttgccctcaattattcatttacattatagctttagtttaccttttacaaatggtagaatccgttcaatattttagaatattccagaaaattccagaatcgcactttctcttcagataggatgatttaaatgcattattttatgcaacagatgtgtagagcaaaaaggaattatcatggtagtttccatggagtaaataatatacatcaaaaacacaaaactcaataaaatgcagataaaagtttgctgaaagttactattagaaattggcacaaatactcttctgacaaacatggcccataatgtattgtttccaacacaattttgtacatgatggagattggtgaactgcaagagtattcccagtgcctttgcccaatgctactgttggttgcaaagatcctcaggaaatcattagcaaactccatctagaaacagaccaaaagatcagagatatacattacatgagattcatggcttatggttgtagagttctgtgcgcattcgttcttgtttgaagtacagtatagtgtttcaaagcatctgctcccattcccaaaagttagtgagttgtaactgtgccagtatctgattttaacagtatgtcaaaggcacagtatttgttcttaaatgtcagtcattagagttgggcacctacacaaattcaatgagttccagtggaatgataactggttctttaagctgcaaaatatagagagactcagaaactcaaatggagggaaatcgaccaccaatttagagatagataacctgggacaaatagatactatctgtaacataaaagattgacttaaaaatcttgaagcattattctgaatatgttttcagctttccagaaacatgaaatgtattctcatccaaatagaaatcgctccccccacctccacagtacacacacacacacacacacacacacacacacacacacaatgctaaagcaaatatagcaaacgaaatatagaaataacaaccagtgtcttgcgttggaaatactatggtctttgaggctggacagacccacatttgaattctagctctcgcactcactgactatgacacactgatcaagtcacttattctctcaacctcagtctcttcctctataaaatgggtcaaataattattgatgtgaggcatttctgtgaggataatgtatatcaattgtctgacgtgtgtattcaataaataatgactatcataactactaatttttaagactacatttgacctcaaagcatgttgtttatgtaaattctataattttatacaaataagccttgctacgtaaaggaatgtagaactaatgctgataacatattgaaagttttttaaattactaaattagcatgtgattatctagcagtctaatttaacttgtctttgatggaattgctagctttttctcccatgaagcttcacaaagaaagcattgcattaccactagacgttttcacttttccttcaataataattttgtgttctcataatttgtataaatgccatataccctaacagaagtttttcttacacattatatcctaatatcagaaaacaataaaataagaaaagcaatttgatatatgtttccacacatattgcctttttttttcttttaactttattcccacttgaaaatactcagtaatgtgtctcttgtgtctctcttctctcccaataatcaaggtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtactgtccatggttctcctttaatagtccttaccattttgtgtcccatgctggaattgcgcagttgagatttgttttttttgttttgttttttgttttttatctttaatgctgacggcaaatttcctgttacaatgcatcttatattgatttaaagaagattttttagggaattcaaagtcctctgtagtgtgtctaacagatcagtttccatttgaattccaaaatcaaatacacacactggtattttgttcagaaaagggttaaggacttaacaaacatgaagtttaaaaaagtttttataaatcccattccaaatatcattcaagttatctgattcttttaaatgactcagggtattttctacactacacttgtttttggattaaaccgtcatctttagttgtgattatgtgaagctatctggaagtaaaagttaatcttgtcaacaaataaggttcctatggatgtctgtttctattccaaatgtgaaaatctttatttacatcttactttttctataactatctatattaaaaaggcatagaaagactgtttttcttttatgtgaaaatcttaaggctatttttactctgagctgtagcttataaacatatatacggaagcaattcaaaccctatcaacctctatgagagatctgactgttttttcttaaaattatctctagtgactagcctagtgaaaatcattgttgacatttaataaataattatggaatgcaggaatgaacgtcagtaatagcagcaatagtggtatacactttttctctctgaccttccactgcagaataatttggactccaagtctgtgtttcctgttctaaaggcaaactcactaatgtcatcctagaggatattttgatgactataaaaattattctgtgacaggttccagcattattctctgctttttcatctggcaccctttatctgccactgctactactatggtccctagagtcagcctagtaattcttgcagtcaacatattgatatcattcttctgagagctggtgatgctaacataaacctttcttcaagtattaatgatgtctttaaggaagtgaatgtcctggagatgttagcaatggcctctatcctctttgcccttattataccccattttctggggctcagttattgattctaaaatatttcttggctttctccaaagaaccattggctcctggagtttcaacatggttctcccagttaatggggttcgggttgagagatggatccaagtgggtgaatgaacatgtatttttggggaagggaggaggagggtggacattttaaggcttactgggtactcatagcatgttaatgaatttgtgttcagaataagtatacactatggctttgaggatgagttattttcctttatatcatctgttaaaaatgaatttgttttttgatgattaatataaatagaaatttatagttcatatttctattccattttaggagccaaagctccccctgccttataacctcattctatacagtattattgcagagaaatttcattttattttctcccaccagcctggtgttaatgggcacatcaatccgggtttgaatccagctcatttttttaaataaaatgtataaacataactagctactcaaaatctctgggccttgagagttgcatcatgaagataagaattctacctcacacagtttttgtcaagattaaataagataatatatataaagcatcaataagtagtatgagtagagccataaacctttctcataagatggccctgaagattacctgagacaatttatatgtgagggatttgtaatttaaagctttattgtttaatatttcctaatcttaatgtaaagttgtgacataataaaaagaagaaacaataaaagaggtagataataatttctattctttgttagtctgttgataaggagggctaatgagttcgaaactgcaaatcaagtcctcaaatatttattataccatgttgattcagttttctgatttactagagggctagtgaaaatgctcttctgaatgaatttataatagaaaatatctaagtgaaatttgtttgtactatatatttctttcaacccaaattagaaacagctgacaattgattagacagagagcagctaataataatacgatgtattttggttcaagcttacaaggtcttggccagcttctattaaaaaaacaaccaacaaacaaataataaccttttcacctgataaagttcattggagtttcatgaaattgagaactatgacacatggaatgtggttgtggattcttattcaagaaactagtcttgaacatttcacacagcagctttttattctctgtcattgatttctaatttatacaggcagataagacatcagaggtcttttaggtcaacatttcacaaaaggccacacttcttctataatatcttgggcaagaatccatatatatatatatgtatgtgtgtgtgtatgtatatactatatatgtatgtatatacatacatgtatatgtatgtatatacatacatgtacatgtatgtatatacatacatgtatatgtatgtatatacatacatgtacatgtatgtatatatacgcatatactatatatgtatatagtatatacatatatatatacacacactatatatggatatatatatagtaactgccttccaggaaggcctgcatcactgagaaaaacagtcctcacaatctataactttaaatagattccattaatgtctcagtctgtatttgttcttaattgtgctactagtctcattaagtttctcttactcgaaggtagataccgatctcatctaccatcttgtttcggcttgtaccaaagaaatctgtgtaaatgagcattaagtcgatgagttctgatttgctaaacttggtagcaaactaccctaagtaaactagacaaatttttttttctgccttgctttaaccaagatcttttgcataagtagaaaaaatatgatttttaaaatgcagctgaattttttatgcattcattcaacaattatttattgagcaccttctatttgtcaagcagtacattagtcactgggatggacagaaatgaaaacaaatgccttcatggagtttgcattatagtgggtataaacaataaacaaaataaacaagctctgtggtatgttcagtagtgagaattgttaaggagaaaaaataaagtaggagaagaggatgggaaataccgagaagcaaggtaatctgctttattaaatcaggtagccagggaaggcttcactaagaaaataacatttgaatacaaactttaagcaggttggagaggggagagtatgtgtacgtctgagtaaagtgtttttagaaagagggtcagccagtacaaaggccctgaggtagaagcatgcctagatgttccaagaatatgaagggggccagtatggattcagaaataagggataatatcagaagtgcaacaaggtcaagaggtaaaagatctggaggtagagagcagatgaatcatgtagggtctagcaatgcaaagtatggtcctgtggactagcagtgtctgcatcacgtgagagcttcctaaaaatatagactcttatgcccctatcccagcctttctaaacgtgaatctcattttaacaatatccataggtggttcatatgcatattaaagtttgagttgtgctaacacaggctgtctagaacatcctaagttggctttttctctggtgggatatcaaacctcaggagagttttgaactgaagagcaacatgataacatattttggcaaatcatatgactattgtgctgaaacaaacggaagatggcaacatggaagctggaagccagttaggaggccatgatggtgactcagcaacattctgaaattacaccatgggaagttcatttctcttaaaacgcaaatacatcttaaaagactatgactttgagtagttactggcattagcaccttagtggaatttagtctattagattattttagatgggcctaggacataaacagatacagcttctgagagcagttgtagaaacttccaggtggcaggtaaggatctgaccagaaatcaaggatcatgtgcagcactaaaatagggaagtccctgattattatgagggccatattcacttcccattaatctattataactcttggggaaaaacaaatcattctagaatctcagcatagaagaccactagagaagtaaataaaaccaggattggtaggatttgtaagtgaataatacttcagactatgaagttccaaggggatgtacactcaaatggataccatagtaacagggaagtcggtggtggtgccagcaccagcagtattcattcataaagatagcattaatgtataggctgtctgtccacagaagtccaagagcaatatggggaaaggggtgctattactggggggaactcacaagctccaaactgggcatcagggctgcaaccaagccactggacttcagggcctagctctaatcctagctggaaaactgaagtattaaaatggaagccaaggcaaaagattagtcataacaatatgggccagtgtcatgggttttagaagactgaggaaggaagacaaatcccagaccctaagaactagtgagtaagcttaccccagttttattcagctctggctgaaaaattcagtggacttgaacctgctattttacatactcattcaacacatattcagtgaatacctattgtttccaagtctctgttctaggcattagaaggtgtaatagaacaggtaaagttcctgcctaaatggagattatattgtagtgaagagaagataacagacaagcataaatgtgtgctctaaagaaaaactggaagggtaagaatggaaaaaaaaaagcagatcatgaagaggatgttgccatcccacattgggaggttgggaaatacttctctgagaaactgatgtttgaatggagacctgaaagaggacagggggtgaaccatgcatatagtttggagagaggggacaggaagtgctccaggcagagggaatgctcattacaaaattcctgaggcagaagctagcttggcatactggagagaaatgtcaagaagatcagtgaggttggagcaggttgcacagagagggggttaggggatggagaggcagatggatatgatcagagtgggaggtgggcaggatggaggccattgaaaaggctgatgcttgggccccactaaagtccaaattgtatcttaattggtaaatggaaggcagctaaatttctcacattcctccaagtgattctgattcacaataagggttgacaatcactgatataatattctatgagtgattttaatgaccttagttactctgagatgagaaaccagtgcagagttttgagcagaagagtgacgcaacataactttttaaaggtccgctctagatgctgtgtggagaccagggggctcaagggtgggagcggggagcttagtgaggaggccactgtaataatccaagtgtgacatgaggcgggggtggaccagagtgattatggtgaaagtgatgagaagggattaaatttaaacatattttgaaggtagcactgacaagattttctaaaagagtaaatgtggggtgaaaaagaggagttagggatgacttcaatatctttggcttacgtaggtggagggatggagttgccatttattgagattgagaaaaccatgacaagagtaggtttgataagtcaaatgagaatttgtctctggcatggtagttaatatgaaatgcttactcattacgcaggcaaagtttatatttaaggccacaaggctggatgtggtcactgaggatatgagtatatctggaaaagaaaaacatataaacacaatttaatatttagaggaggcagagacagagagggcataacaaagcatcaggaaactatcagctagtgaggtaagatggaaaacaagagagagtaagtggtggtttaaaaaccaaaagaaaagaagaatttcaagaagttcagaggatcaactgtctgtcaaatgatgctcatgataaagggtgatgaatgctaaaaattaattttagttttggaaaccagcagtcactggtgacctgacaacaacaggcctggtagagtagaagaagagattagggaaagattagagaaaagaaaagaagtaaaagagaggatgtggagattatgagactagaaagaagagattatgagaaccaggtactggaaaaaaaatgcctgtacaaataatcgaatcaccaagaataaacacagaactaatatttgagagagtgacagagagccaagtgataaaatcttcaagccacgttggaggagtgacactggtaactgtagtaaaactacaaggagatactatagctctttttaaaggagtaactcctttttaaagaaattttgctgaaagaaaatgctgagtaatgagaggagtttctggagtaggatgtcaggtttggggaaattttttacgaaagaagacatatacagtatctgtatattgatgggagtatgcaataaagagaaggaaacccataatacaggaaaaagactgcagtattgctggagaactttctttgattaggagataagttatggcatcttagtgcacaggtagacggtttggacttagaagcacagtccatccatagtaagaggagagaaggacataagttagaagatgtggtggtgggagcataaggaagttcatccttgactgcttgtattatatttaaaccaaagtcatcaccaaagtgtaagcagcagggcagagattctggagatttgaagaaagagaaaataggaatggctgtcctggagaatcaaagagatagtaaactactaaaatataataaactttctagacaagactgaaggggtttgtaatcggtggtcatgactataaattgggaccagtcagcatgattgtgagtatttgtctagccatcatcttcagctgactgagcataagtgcaaagtccacaaagagtatatttcaccagaattagtgtttccagaaaagtatgatagaagataataggagcaagaaaggaaattaagagcacatgcaaaaaaaacataattattgttatgaatcatggaatctgtgctatataaaaggaaagtgatgatacaagggaattgaggatatgaaaagggtggcaggaacaatgcattgcgggcctagatgggactggaattcttggaatcagcaaacaagaaggataaaattggaagtaacatgaagcttgttctgagatgacacgtttgaagttgaaatgatgaagagaatacagttattgaaattgatgacaagggatttggtagctcaggtagtagaaaagacaaaatctttggagaagaggaagacttgagactgaaaaagaaagtactggaaagagatgcttatgtgaataatcaaatcgccaagaagaaacgcagaactcctatttgagagagtgacagaaagccaagtgataaaaatattcaaataatgttggaggagtgttgcagggtcagttagtgaccactcagtaacactgagtggcaggtagtaaagtctgataacataagcttcaaagctggagaattttcgggacaagggtctagaaatggtttgaggggcaaagaggataccaacactggatcctgtcccagtggtatgagtgttgtagcagagaaaaataatcaccacaagaccacaggcaatgcagtatccccagaagataagtacattctacttagcaaaataaagtaaaaggaaatttcaaaaaacaaatggaggttataggtaaggtgattatttttcctagtttgcttgggacagtctcgattttgccacttgtcccagtgttattaactgtattcccactcactctcaagagtattaccattatgacaacaaattatgtgacctccctagatacacacatcctgctgataataaagtttcatagagcagagtagaagaacctggagagttgtagaggaataggaaaactggtcaaaatcaagggatgcgcagatccatatcagtgagatttaaacagtaatctggaaatttcagactttccatgagggcagcatttaggaatccaggaccaacacagactctaggcaaattatgttgataagatgagtgtaggttggcaggaggggtgagcatattgccaggtgcttactgaggtgtggggcccctcttcatccctgacagtggcagtggaagcttggctaacagcaatctcaccagcagctgaaagtcttgagggcattgcttcccacagctgagtgaggctgggaaagatagcagctgatgcatgctagacttaaggatgaagcagctctgcaccatgttgcacaaaggaaaaaaggctgtgagtagaaaacagatttcagctgttacacagcttcatctatacttcgtcctgaccttgcatgtcggccatatcctcttttctgcttgttccattccccttcctcctagagctataagcatcatttgtcattgagtaaaaatgccaaagtagatgacaattaatgagccatcagcagaaggagggtgagggctaattggagctttagtgagcaacttgctaatatattaactaggtatatgacctcaaaatctgggttaggcccttattacagaaataaacaaactgaaaatggcttggggtaaaacaagacaacaaactcaacagctttggttctacgaaaacgccaagcctgggctgtcataccactggacttggagggagcagtgtatttgctgcatttgcccttttgccaaatgattccaacaaatacatgattcacttcagtactacaccctgcagctgagagctccgataccactggcatattttctgctctctagaaatcagagtttttaggtctgtgtcagtcatcacacaaagaaagaagagaactgcacagtgggagaataaaaaagatgtagagatcatttccagcagccgtgctaatgcatttttaatagtagagttggatttttttaaattattattaagacttatttttgtttttaacaatcctcatggatatttgaaatcaaaatcagactcgattagatgttttctcaaaaagaaaaggagaaacctagaatcattgtgacacatgtaaagttgcttatgaagacttcttaggtcatcaccaggaattttacataagttacaatgtgtcaagttttatagcagacaaatcatactacaaatactacaaacaaacatgtttttctagatgccaagaaaaaatatatgtatgtatgtgtatatatatatatatatatatatatatatgtatgtatgtatatatatatatatatatatatatatgtatacaaattctgtgaattatactggatgctgatgcaacagtgaagtactgtcttatgtacataaagatgatactaccaacctgctgttgacagagtatgttcttttaaaattgcttttttccacagtgatttaattcatgatgaaagccagatctgctccaattcttcttttaattagctacattcaattctaattcatctattcattcactcattcctttaatcaacaaacatttattcagtggctgctaagtaaaatgcagaacagcaggtaccccacagagatttgtacaagacattgtgagaacacagggaaagggaacctagcatagcctgaaggatgaggctacttcagatcagtgaagacttcctaaaggaagtgatattaaacttagaatgagtagtatttaattaggtaacagaaataacaaaaaaatgggatagggaggagagggcctgagcaaaggcatgaaggtgagcagagcatagtatgtgcaagaaacaaaaagcaattccagttagaagagaaggtgctgcaataaagtggtgggggaggaaggtgcttgtggaacaaagacacctactgggccatgtatcactggaacttgctaattggacattaatataataattcaaactagatgagcaataagatgtaaaaagaatagcaggagtatttgaaatcagtttctcgattgtgaagaatagagagccactttggacttagttttcttccatattttaaaattgtggaaacagaatttattaattctaagattttttctggaatgaatattcagtgagtctttggacactaatttcaaactgtttaatagcttatgagagaaaatgcttcctaggaaacttcagaggactgtagtgggagtccctaacacagagaccctaacatcaagcctatgttgttagtcctgacttaaaacacagcctcatacccaagtgaaaaaattctccaaaggattttccagctttctagttccccaggatgaaaaaagaatagattgatgcatctttgtttcctgctggttgcattatattctcaaacttcttattccaataaatatccaaggtattgccttggtttagttcttactctcaaagttacttcccaaattggaaaatgcatatatattttttaaaaattttctgttgggtaaataccaaaaattaaaaattataatcctactgataccatttggctctgtgttcccatccaaatctcatttcaaattgtaatccccatgtgtcagggtagggaccagataggaggtgactggatcatgggcgtagtttctcccgtgctgttctcacaatagtgagtgagttcttgccgagctagtggttttaaagtgatatttcctcgatttcacactcattctattctgctgccttgtgaagaaggtgcctgcttccccttcaccttccaccatgattgtaagtttcctgaggcctcctcagccatgcagaactgtgagtcagttaaacctcttttctttatcaattacccagtctcaggcatttctttatagctgtgagaaaatgaactattacacctaccataatttaaaaattattttagtctccaattttaccctcagagtttacctccattaatagcagagtatacatctttatgacttccttctttatttaaacaggccgggcgctgtggctcacgcctgtaatcccagcactttgggaggctgaggcggacagatcacctgaggtcaggagttcgagaccagcctgaccaatatggggaaaccccgtctctattaaaaatataaaattagccaggtgtggtggcgcatgcctgtaatcccagctactcgggaagctgaggcagaagaatcacttgaacctgggaggcggaggttgcagtgagctgagattgcgccattgcactccagcctgggcaacaagagtgaaactccatctcaaaaataaaaaataaatataaaaataaaataaacaggagacatctgcaaaaatcacacatacgcaaatagtcacacatatgaatacaatttttgtttaatttccattttgactttttaaaaaataaaatgttttcatgcccttgtctttttcaattcctttgtcaaaaacatctttcaggttagtgtgtatgtatattatacatatgtaagtttcattcgctttctgtggctcccagtccctggctgttcttttacatcctcaaaagggccctccctctcctctcattctgatttatgtgttcagtgttctacaattttctccttctcaactgctaaattcaattctctgactaaacataaatgccatgactattagcatatctttctgtttttatgtttctcagattaattgtcatcttaggcactaaagcttctgattataaattcctcctttcttgttaaatatccataactctattatttttcttattttaaatcaatatgtcttgcaaaatcctttagggctctgctatctggcgccagctttgcctaggagataataaaataaataaaatttgaatgtcttgatagtgtttgggggaaataaatatattacagtataaaaccatgcttatgttttacagaaaataactggcttcttccattattcctttatttctcctattatacctaacattaaatactggagtccaaaagtgcacaatacattttaaaaaactccataactaaagataaagcttctctttttatgtgataaaaattggcttgtaatataatctaagcacatcacattcatagctttcatatttaaagttcattttttcaatgcaaatttttattgaaattttaaattttatttattttttaaaattataaaatacatgtaacataaaattcaccatcttaaccattttaggtgtacagtttagtagcattaaatacatttacattattgtgcaaccatcgccaccatccatctccacagccctttttcttgcaaaactaaaactctgtacccactaaaaattccctcctcccattccctcttccccccaaggccttagcaatcaattatgtctctacgaatttgaacattctaggtatctcatataaatgtaatcacatagtagttgtccttttttgacgggctttcttcacttagcataatgtcctctaggttcatctacattgcagcatgtgtcagaatttccttcaattttaaggctaaataatattctgttgtgtatatgtgtatgtgtatatatgtgtatatatgtgtatatatgtgtgtgtatatatatcctgcattttatatatatgctatatatatatgtatatacatatacacacacacacatatatatcctgcattttgtttatctgttcattatcaacagacatgggttgcttctaccttttggctgttatgaataatggctctcaattatcttgggtatatatccagaagtggaactgctagacgaaatggcaattctagttttaattatttaaggaactgccatactgttttccataatggttgcaccattttaccttcacacaaataatgcacaagagttccattttttttttttttttacattctcaccaacatttattttgtttttttgatagtagccatcctaatgggtatgggatagaaatcatgtaaatctaaattctattttagtatgcatttttaagaggcactattttggctaataaacttcaataactatcttcttcacattatgctccaataaaaattggattgtgcttgcttatcatataaagctcagcattcctgagaggtaagactcaatctatcccacaaatatggctcatcccagtagtgattctcaaagacagaagagaccaataacctattaaccagcccccagcaaaagaagcaagtcagaatgggggaaggaagtatgtatagttcaacagaacaaaaactcatgttattcggacacatccaattgagaataatttgttttcctaaactctgggaatgtttatctctgccattgcgattcctagaactcatcacagttatggagctgaaagagactgcagggaccttctagattaatcattttgttttatggatgagaaaattatacctaaaaaggttaagtgatttacccaaggccacacagctgattagtgtcaatatttatatctgcagcccacatctcttaattctggtcacttgctctttccatcacagttaaaaaacttaagtctgtaatgtcctctcaaaactaattaaaattcacatcacaatttgagtggttctcaaactttatatgctattaagaattgcctagtgaggctgtccaaaatgcttattcttaaacctccaaacccagatatcaagattcacggagtctggggtgggacccaagaattaaattaatgagcaatacagatgattctgataaacattgttcacagattatcttctgagaatcactcttctgggtactatttaaaagccctggtcttaagccagtgatcttcaaggcatgggccctggtccagctgcatcagcaccacttggtaacctaagagaaatgtaaagtcttagagcccacggcagaactacctaatcagagactcttggggagagactagaacattgtagattaataagctcttcaagtgattccaatgcatctaacatttgagatccagtggcctaggctcaattttagtccaagcaagccactcactttattatgttgccttccaactagaggatttaggaacccagggcttcgggtgcatcaaagtaatccaaaatatttgatcaccctaactgatactgccaagagtgtgcgtgtgtgtgtgtgttgaatgtttcaacactaaggaacaaaaccttccctgtctttgctccttacatgcaattgattgaaaagtagaggttaagtgaggggcatatcaagtggcaaatgttgcttcccgccttgtgacatcgtttacattttaggaacaaaacaatacttatctgcttgctgcaaatcttcacctggatgtcctgtcagtgctcctgccagccatatgtctaacactcaactaattacctttctttgcaagttgacgcttatctttctgtgttctttatttctgttaaaagcatcactgccctccctatcatcaggctgaaaattgaggaatcattttcattgccttcatctttgttaccagagccaaataattgctttaactatcaatcctgcctctgacacatctctccaatttattctctcctttcactttctacttccaatttagtaattcatgtcattattaccatcctcctggactacagaaataactaactaattggccccctcctgcaaattcatcttccctcagcatagcactgaaagtgatccatctttgctcaaaagcctgtaagtgttccactttatctctagtgcaaattgtttatgctagcattcaaaagtctctataggttggtattattctgtttttcagtattcatttactcattcattacttaaataacgcctattctgtattgatttgggtatcttccctttcacatgccatacattactatcaaaccaagttgctggctttgtcttatactctgcaatgttcttacatatcaggtattgctcatttctttccctccatcaggaatgcactcctctgcctgccttctttttctgtctattcgttcttcattttcaaggtctacctcagttgtactatgatgtctttcctaaaatattttcttcctccattaaactttcttaacaatgtatccatctccacaaatggtttccttttaatactgtaattgtctttgcttgtctatccttctagatcatatactattttgggccagaacacatacctgattcatcagtgtatccctctatctctacagcattgagcttgattcttaatctttctttccaacttgagtgactaaaatatttaacagaaatcaatatcagattattcatgaatttagatcccaaaatgtctaagcctgattcctcatagtgttcctcttaaacagactagatatttatatattttccttatgttctgagtagtacaacttattcactatctttaaaggctcccagtaaaataatttataagaacagatttcagtacttttcaattcagtttaaatgctatcagtcttgtctggtatgtttatgtaactgagacttatcactttgattagggaaggatgccatgtagaattatgtttcaagtgtggcaaaatgatcagttgtatgtatttgttttgcattttttgtctagaaagctgggaaataaggcaggaaagacagagtaagacgaaggctaggctcaaacaaatttggcatttccctcaggtgcataaattaagggggcactaaacaaacagaataatcagatgggatcagcattgcttatcttcccttttgccccaggcaccaatatggctccacatggtactggcaaacctagtctttatttgaaattttgatattttataatggatttttgcatgaattttgttcttttcttaaaatattgcatagagtattatttatttgattactgagtttggtgcacccttcaattatgcacacaggacaggtgctttactcaccttatcctagaggaggccatgagaaggaagcagaaaacaaaatggggaagaaaaaaggaaggaaaaatagataagatgaaaggcatgaagggagacagacagtctttattaaatactcttaatctttaagtgtaaatattatattaagttgataatagataaacaaaaacaagtatgatgaaagattctgccaacattggtgtaagcaatgttgtttatttgtatacaatatgtatataccatagacagatgtacattactacaatatatatacatattacagattgcatattttatttctgcatattacaatacattatgttcattgtattaactcaggaaggttgattctgaattatttttatttttcatatttatgtttatttttccctattagaattagttacaattttaccacattttagaagaatttacctgttaatctctgacaatttccaaatcatacttaaatatttctttaagaatcaaagataatatttgacttaaacttttgttgtttgggctaaagaggaagataaaaaaggagtttgaatctgaaattccctactaactggttatgaggcctagtcattgttctgagaaatcaccaggtaaatttgcctaaacgttgcacataatttgtaatttaccccaacagagggataatgtgtgttaaaatatggaaaatgtaaaagaatgggatcaataaacttgggctaattcaatgaatacatgtattttaatctcctgagtgtctggggttttttaacatttaaaaattaagtgctctgtagtgtaaagatgtagtgtttgttttgaaagagcacaggagacttccaggaaagagtagctactcacaaattattgctttcgccttccatgacaaggccaacaatatgctttcatttactgattctcatctaataccttaagcttgagcaccccatctgctcagcagtatgtaaatgtgatggaaggtttctgcctcaaattatactgtcagaaatatattgcatttaatactttgtgtatttaactctgtgtataaaatattcagcctgcaggagagttgtgaattacagtcaagtgaaatgctgtgcttgaattgtgaagctcaagaagcttttatcagcttatcaactcaaaatatcaatattctcctgcaccatgttaacacaaatacatttatgcaattccagcaacagagatggtcttaccatttctccatttggcactttggatataataattatatgcaaatttggacaaatttcctttctgctttagggaatctaatttagtttgtcaatctagctgttttttagaaattgctccacatattatacacaataataaaagactcaaatctcattttctaaccctgcactcctaacaacatttcacagtattttgcatattatttgataatatactgtttgaatcaggaatcttatccagagtcatagaattgctttaagttttgtcttggtgtttgtctactaatgtgcacattttttcagttgcgtgtgctgggagagccaccaaatgatgtattggaccaaaaatatttacccatttgatattctctattagtcatccagcaatttcaaacttaatatatccaaaacccaacagttgtcccaccttttatttttttctttttcacttgatagcaaattcattcttcttagattgactcttgtctttctcttacacctcatgtctaattcatcagtaaatcttgtagggccctttctttctctcttccttccttccttccttccttccttccttccttccttccttccttccttccttccttccttccttccttctttcctttcttcctttctttcttgccctccctccctcccttccttacttctctctctctttctttctttctttctttcttttttgacaaagtctcactcagttacccatgcagtggcatgatctcagctcactgcaacctctgcctcctgagttaaagtgattctcccacctctgcctcctgaatagctgggactacaggagcatgccaccacacccagctttttttttttttttttttttttggtatttttagtagagatggggtttcaccaggttggccaggctggtcttgaactcctgacctcaagtgatccacccacctcggcctcccaaaatgctgggattccaggtgtcagcaaccatgcctggcccctgtaggttttttatttaaaaacatacaaattttcaccacctccaccattattaccctggtccaagccatcactgtctctttcctggattattgcaatagctttctaccaagtcttcctgattttactctactttgccatagtctgctttcaatattgcaatataagcgaacaggtcattcttctgctcaaaattgttcattggctccccactccattcaaggccaaaaactcttacaatagcttgcaaggctgaatatgatctatgttcacccacctcattatctttctggcttggcttatctggtttctttgctgtttcttggttgtaccaaccacactccccttttcactggctgttttctgttcttcctatctttccttcccctaggtagcttcgtgacctactttctcaccatatttgagtcttagttcaatgttaccttttccagaaactttccctgacttccctatttctaaatgcaatacccctgatacctcagcacttcctacacttctttcctgcttttattctgtttccatagcatatgtcacttactaatatataatttacttgcaattttatttttaattaccttatagattttttattatatgtatttaaggtttacaacatggtgttttgatatacatatactcagtgaaatggttgctacagtcaagaaattaacatgtctaccaccttgtatagccatctttttttatagtaagaacacctaaaatctattctcttagcaaattttcagtataccattttcttaattaactgttctagtataccctgcactagaatgtaaactttatgagggcaagaatttttgcctttttcactcactgatagatcccaagcaccttataggtgcctaaaagatagaagattctcaataactaattgttgaaaaataaatttggcccccaaaataacccccaaaaaattaaacaaaagtgaattgataaaaagcaaatgcctctatgatttccttttctacagtaagaaattatttggacaaaatagtcaaagtatattaaattaacaattcttaagttttagagtttgatgatttgatgtatgtatacattgggaaatgattaccacaaccaagctaactaacacacccatcacctcacatggttactttttttttttttttggtaagaacacttaagatctactcgctgagcaaatttctagtatacagtatgttgttattaatcatagtcaccatgctgtacatcacatttccagaacttattcatcttttaaatgaaagtaaaatatgttgatcctttgaccaacatcttcccattcctcacctccaccccaggctctggtaacgaccattctactctctgcttctatgagtttaattttttttagattccacatgtaaatgagatcatgcagtatgtctttttatgtctggctgctttcctctaggtctatccatgttgtcacaaatggtgggattttcttctttttagtagttaaatacattccattttatacacacacatacacatacacacacacacacacacacacacacacacacacacacaccacattttctttatctattcatacactgacagacattttggttgtttccgtatcttggcttttataaagaatgccaccatgaacataagaacacagatgtatctttgagatgctgatttcatttcttttggatatatatccagaaatgggattgctaactcatatggtagtttcatttttaatttttcatggaagctccgtactttttcccataatggctgtaaaaattgacattcccaccaacagggtaacaagggttcttttttctccacatactcaccaacacttactatcttttgtctatttaataataccaattctcacagctatgcagtaataactcattgtggttttgatttgcatttccctattgattaatgatgttggcattttttcttatacctgttggccatttgtataccctcttttgagaaaatctattcagtccctttgcccattttttatttgggttaattgttttcttttaatttagttgtttgagttccttatatattttggatattaacccttcatcagatgtatggtttgcaaatattttctaccatttcctaagctgtagcttcactctgttgattgtttcctttgacgtgcagagctttctattttgatgtaatcccatttgtttacttttgcgtttgttgcctatacttttggtgtaatagccaaaaatatcttaacataaatttatgccaagataaatttaactaagagagtaacatatctatacaaagaatactgtaaaacattgatgataaaatgaagaagacacaaataaatgaaaagttaacccatattggtggattggaagaataaatattgtttaaatgcccgtagtacccagagggatctatagattcaatgaaatccttatcatgattccaatgactattttacgtaaatagaaagaacaatcctaaaatgcaaatgaaactacgaaagactacaaatagccaaagcaattttaacaaagaagcacaaagctggaggcatcacacatcctgattggaaactgtattgcaaagctgtggtaatcaacatagtatgatactggcataaaaacagacacataggctaaaggaacagaatagggaccccagaaataaaccaatgcatatacagtcaactaatttttgacacggaaatcaagaatacacaatggagaagggaaagtctctttaatagtgttaggagaactggatatccacacgcaagagaatgaaactgaatccttatataaattaattcacaataaagactttattgtaagatgtgaaactctaaacctcctgaaagaaaatatagtggaggaagagccatgccattggtcttgacaatgacttgatatttttgacttcttttttttttttttttaacacttgttgatttagagattcaattgtcagcttttaaattcaatctactttgacttgtgtttttaatgctggtcatggctgaaaaagagaccacacaatgattaataaatcaaataaataagggacatatttgtgcttataaatgatttaaattttccaacataattcagtcatgcaaagttttttgataaaattttgacagaaatgtgttctgtcctttaaaggatagaagttttaaattttgatgtattccatatatcttttcttcctttgtcattggtgacatacctcgcattgttaatttttgatgtctctgcatttttttaattagacttctttgcaatctcccctttataaataacactcaatatctaaaaaaatccttgaaatcttataagcttctacttttttggttgtatctctggccatgagattatgtataattattttctgacttgaaaaagtttgcttttctgaaagctaaagtgtttatataactcatcctaacataactttccttagttagttaaacttactaatggcaacatttcattctctaaggctattttcattttcaccccatcaagtagtctctcgatttattattttatgccttcttttagtgtttacatagctcctattttctgccttgaattaagcaggtttttgagagatatattaagatgagaagtaagacacagagattttgcctacaaggaattttgccttctaataaataagacaaatcaattttataaaaacaaatggctataaaacatggtaaaaagtgataattaccatcaaagaaaggcacaaattaagttctatgtgaattgacagaggaaaagataattcttttcttattttactattttcagaattaaatctaaagtagcagtttttctcattatccctttggttcctgtgagataaaattggctagaaggcaaatgacaacttcattcacaaattacatttgattgaaaggaaattgcagaaagatatttggagagttgatgctttctgtcaacattacaacttgtttctccattagccttgtggtcctcattagagatgtttgatccttaacctctattgactaagcaaaatgcagaacaaccccataaaattattttttaattctaaatatttccccctttgttacacccctttacttcatatcagaatatgttcattttttccttttgttatataggttctttttatctcgtttttacctccataatgcagttactaaacaaattttcacaaatcaataatttctaggtaaggctacataaggttttctatcctgaaatatttctgcaacgtgaaactatacaaataaatattttgttacataaaaaatttcaggaattacctgtattctctttttaaaatttttattcgtttattaaaaattgtatactcaaatcctttctctgaacactgttctttaataaaaagtaccaggaatccttagagaaatggctgatgttaagactggtgcaggaaaaatagaaggtgaatctggaaaattttttcattccagaaaataagaaagtgctcaaataacaaaaggagcaagtagggaatgctgagggacaaaggggccaagtggaaacactttctcatggccagaacagaaataacacaagaaagatgaagaattgaatattggattacaacccaaactctaaatatacaagttcatagtgatatgaaaaaaattattgaataaaaaaagtgggagaagaaacaaatatttcttacagagaattttaaataatacgtgtagatactgcgttcctacaggagctttatactcctccattcacgctttaatgtggactggacttagtgattggtttccaaagaaaagagtacggaacaggaaaaaatagagatatctgacaaacactaccttgatcaagatatcagtgatatatagatatcttgatctatagatgggagaggcattccactaccatggtattctttcaaaaaaattcataacccaagtctaatcatgagaaaagaaatcagataaaccaaaattaagggacatactccaaaatactacaccagtactcctcaacactgtcaaggttatgaaaaacaagtcaagatagagaaactgtcacagtccagaggaaactaacaagacataacaactaaatgtaatgtttgatagggttgggaacagaaaaaaaaaagacattaacagcaaaactgttgaaatcctaataaaatctgaggtccagttaatagtaatgtcccattgatggtttctcagtttttacaaatgtaccatagtaatgtaagatattaatattaggggaaaatgggttaaggagtataagagaactctgtgttacctttgtaatacttgtgaatctaaagttattccagaataaatagtttacttaaaagctatagaaacatatctagatttttctattttaggcatgaactgttatttctgactgtggaagacaagaatttagtttctgtccttctcttgcttctaccatacatgtacaaccttcccatctaccaaatccccattataattgtactcatatcaatatattgtatatttctattcacagctgacccatttaacaaactgtaattacttttccttgttgcctatcctcttgttaaactggatttagcaattatctcattttgttcatttgtttaatgtatatgtccttagcacttattcaacctcaagcttttctccattgtctaagtctcctttcataatgttcaaatgtgcccagtattctattcatttctatcgatatggtaaaagatgtcttcacaaactgttccttcaccaatattctgttttcccttagcatgtgttaggtctcttgtttcatgtatttcatgctttttttccttggtttactctttgattttggtaacacagtatctcataaccttcttaggaaaaatgagttggagataaaattgtgagacttgcatgcctgaacacatcactatcctgcttgcattttatttgcagtattggttgggagaatcctttcttccttcagaagtttgaatgcattgttccatggtatctaatatttcagttgagatgtcagaaatatgtctgatgggttttttttgtttgtttgtttgtgtgctctggaagtttgtggtatctcttcttggttccttgtgttctgaaattttactgatatgtccatttctatcatttgtgctgggcacctgagaggcccatttaatctataaactcatgttcttcagttctgaaagttttaaaaaattattttactgatggatactttacttcaattatctatttttagtttctttctggagttcctagtatttatatttaaagccttctgattgattctttcttatttatgtaattattcaatatttgtgtgattttttccttggaaattttctattcttatctttcaaaactcctgtttttcatgtctactagcattttttaacttcaacagcactttattgtcctttgaatgttgtattttctttagaattcaatatttccttattgcgatgttttttaactctaaatatatatataaggatagtgcttttgttgttgtcttggttgtatggattggcctttaacattttcttctccatgcatcgtctgttgctttcaagttgctttttcttttctaattgttttagtcactattgcaatagagacttttgatatctggtaaagtttgaatggaggcccatattttaaaattaagaaccaagaagttaattggcagctctgaaaaacaactaggcataaaaagagagagaaaagcataccccaagtaaaaagaaaagcaggttgtgaaagacctaaggcagggttgagcttgtttcattggcaaaatagggttacaaatgggacagaagagctggactatggtgaggaagggtagaaatgtaagagatcttaattttgcattccagagagaaagttttaggctgaggcttagaccaaaagctcagggcaaaggccaaagagtttcatgatttacacctggaaaatggaaagcacacaatctgtccaggcaggagtccagctacagctgtcttctgcaaactccaagaaaataacaagagctcctttttatgaatgctgtatttataagtcacatgtagctttgtcttccactgaactgtagaaattttggttcattaaatatcaacttcctcattttactggtgaagaaagtgaggccctttcttaaacatattaacatttttatcactaaaaattctctattggaatttacaattatattgagagactataaatatgctactcctagcatcatttaaagttcccaaaacccaaatgaaaaagaatatgacagcccgacagaatttgtttacctaactcgaggaaatgtcgttgagagacactatggagaaaacagcctaactcagtgaaattgaagtatattagattttaaaaggcagaaggaagacaatgaaatctaagagacattttcccaaaaggcacttagtacatgcggacagtaaatcccacagtgtcagtgtgctttttgttcaaagtgcgcagaaattttcttgagagctgtagaattataaaagttaacaacatgactataatgtttcccagcaaaacaccctacaagacagctctttaattgtaaggattcaacacttttagggtacaagtgtattctactcttgtcatggagagagtgagagttaagtgattcttggggtattcttctcttcaaatgcaagctgtgggtcccatttgtcaggaaaagaaaaataaatacaaccccggtgtgagaataagaattctctctctatcttggttccacttaattgtaaaaatcttgccaaaaaatatctgatatatatttcaaacattttgtagtcatttacagactctcatgccatttatacatggtcttgcaggggcagccttgtgagctgtgtctcatttttctaaaaccactagaaggaaaactttatgcagtacggtttgggagttgctctatacaatgtgacacttgatctgaaataccaaatggcagacttttacacagtaacttgaaaaaattatcctaattttgcgtttcatgatatcactaatgcataatcagcaagtaatgattaattactcaatatcgcccttaacttgggaaccctcatcattctggcctctctttgcaaagatgtatggacaataagttatggaagacttgaaaggaccatttcatgtgaatttcctgggaatattatattttcctaaattgaactattttactttagcttgccatttaggctgaaatgattccttactttgcccaacttgggtcactacccctcacatagccctctttaatgttcttcagttcacataccactacctaaagttaacttgattttattttaacttcagattgtctgtttcctctcactagactggggcaaagtgtgggcagtagacaatcttcaaagaccttgtctgtctcctctgttgtattcattgctgtgtttctacccacctaaaataatgcgtagtggcactgaattaatgtttattgagtaaaatattttactatcctgtacccagcctttgatgacttgccagaactgagccccagaaaaaagtaccttttctccttggtttcaataatttttcttttggattctactgaaagagaaaatgtggaaagaattactgaagctagccataactccaacaaatagccaacaattctgatcgccagtattaaaccacaaatttgtaacataaccacatcatagaataagaaagtacagtttcattgtttctgccttttttcactggaagtaaaaagagcagaaaagagcagaggatgggtgggatcataaagtcaataagatacgggaagccatgatttcttttagcttcactttcccccaaggaagatgctgaaaaagtgtgaggagggctggaaacatcacctacctgagaagaggtgggtctggtcgcaatgctcagaaggcaggaggagaccagggcacccagcctctgccttcttattcataacttagggatgcagaaagaccttatcttattcccctactgtcctgtcccgaccattttccttcttctggtaaaatttaaattcctctctgcccagcatcttctcctttcctagaagcagtgatcttaaccatctttcttcctgaagccatgcttgcgtagatcctggtcatatatgagcttacaggtcatgaaagccatcactgaggttacaagccaacaattttaaggggttacacactcatttctacctcaagccttgatattgggcatttgccaaaatgcgagtggtctcctaataacaggtcactgattcgcactgcatcccttccccaagttctcttctggaaactgaacagaagaaatatgatttaaataaaatgaaaaacaccctacttttgctaccaatatttcctaaagttcaaattgaatttggatgctctatgtctgtgattgtaagcttttcaactctcagacagtttgaaggcaaagtaatctgtagctttggtataaggggaaagaaaggagagaaaaaaaatatgaagtacttgactgtcaaacttaataaatacattttaaaagctgatttttaaaaaataaatttttctgagttgccaacagagtaaacattagtaaactttggaggtatgtctcaattatttctctctgattgctgtgcattaacacattatacacaaagccctgaggaaacaagaagaaaatgttatgttaggtattgttataaactggattgtcagcatgaatgagtgaaaataaaattgctggaaatatttgtttattcagttaagccagttggcaataaaatagaatgtattaatgtctcagtagacaataacttcaatgtgtgagaatatcaaacggcctgggagtaagggcaagggagtgagagcaagagaatgaaaacaagagcaagagtgagagtgagtgagagatagagagagagagagagagagagagagagagagagagaagcagcactcactggatcacagggcacccagaaacttatggcagcacagcatcctaaagtcacagtaactgcactggcatggcctttgggcgaccttgaaaaagaaagcttcttattaccaagagaacaagttgtgcagatgctgttataagaacaaaccacaaaaatgcaaccaatgtaagaactataaacttgctttttatattattcggcaattattatcaatgcttttatctattgactcctgaatatttggctctggattaatttttgcacactctctatattacatcaaatactactgtgatgttttcatgctagacacatttcagaggaaagtgcaggaaattggatatagattgccttagttctgagaccagctctcccagagatttgctttgtaaccactggtaacagaatatttttgttttcctcattagtaaaataaaactaatgacacttgttctcaaatgtgtggaatagataatatggaactcctttgagatctctgggaaataatttgtaaaaatttaaatgggttagcatttaaaataagcaagtataaaaacaaatatgagaattattctgtatttatgatatgtcctgatccaccacaaattatacatcatgataattatagtgataataataattaccaattattgaacagatatgctctgccagccctattttatatattctaaaatttagccataaatactaccttcattttagaaattaagaaagacaccaggtacggtggctgacacctgtaatcccagtactttgagaggccaaggcaggtggatcacctgaggtcgggagttcgagaccagcctgaccaacatggagaaaccccgtctctactaaaaatacaaaattagctgggcatggtggcacatacctgtaatcccagtcactcgggaggctgaggcaagataattgcttgaactcgggaggcggagactgcagtgagtcgagatcacaccattgcacttcagcctgggcaacaagagcaaaactccctctggaaaaaaaaaaaaagaaaaaaagaaaaaaaaagaaataaatagattaagaaagacttaggctcagagatgttaagtaagtggcatacctggtatttaaactcgtggctatctgaccccaaaacacctactctaatgctatccctttagaggtgactgcctcattcttaaaatgtgctattttacatctaaaatgatgcatttcaattttatgataccattttacaccccctaagtgaattaatcactcacttctttataactctaccatccatgtgtccattcattcactcagcacatgcattaagcaccttctccttgtcagaccctgagccaggccttgtgatacagtggtgaataagacagtcaaggtctctgccttcatgcagcctaaattcaggtgcagaggcagataacaaagaactagaaaaaatgaaaacggcagattccaatttgtgctatggaagaaggaaatagaaattttaagataagactgggaggaactaatttagattagatgacctggcagagtctttctaagtactgtatatgacgttgtactgctgaattggggaggataagatttagtagctatgggaagagctgggtcagagagaccaacaagttcaagacccagagacaagaatgagtttgtcatatgctaggggcaggaagaggccagtgttgctataatatgagtaggtaatggcagactggtatacaatgaagttgaagaggtagacaagaagcagatcgtgattaggagtttgaatcttatccaaaggaattggaaataatttcctaatgatgtgctagaaccagttaccacctgtccatgggagccgattctaggcatctcttcccagctccatgttcagtgacatcacattggtagcttaaaatcagctatggtggtctttatctaggtggtggttacataactgtatgcatatgtaaaaattagttggactataaagcaaatatcagtacactttaccctatgctattataccacaaaaaaatatttttcagaaaaaagagagaggagcttacagtgaaaaattacataaagaagcaattcactattagtgagtcagtagtgacaaaaaccaggattagcaacacaaggactttaataaagcagcgatttgaaagagaatataaaataatagtgtttttaaaaaggcaagaaaggaaaatatgacagactatacctaaagagatgtggttacaaatttccaaatagaatgaaatcacaaattctcatattcaaatgtgcttcatgtttcattcaggatataatttggagattgctctaagaaagacctgatagtgaattgcatatgaagaatgatgcaaaatgagagctcaaggattacttctaggttctaattgacatgggaaaaaatgggaaagaaataggtttggaggagtgaactaagacctgtgttgtagttgtttaagatgcttattcgagcgccaagtgtaaaagtaaagcggcaattagaagaatctagagctcaaggtgtgcgcagtgaaaagaatttgggaattatcagaatacagatggtatttacagccatatttgtggatgagataccctgaggagaaaatgcagctagagacaaaaggacatagggctgagccaggtgacttcaaagtttccagactggatagagaaggagacctagcaaagaggaccaaggagggcctgtatgttgcatatttcatttctcagtgatgctgttagtatggtgtactaaaaagtaacctgtacaagaactcaatataacagaaacctagatcctgcttagttaaattataaaagtgctctgtgaacaatttttctatctgtaaaatgaaagtaatgactctttttcagtcaatttaataggatacacatgaggatccacagaatttatgaaagtaggtatgctttgtaatctaaagatgcagcggagtcatgtcctggcttttctatcagaatactcttagaggaccatgttgaaaatggctctattctaatttttttttatattctttaaagagtaatattaatatacttggtgaaccatcttgaggtcctggtacctactcttttctgttctagttggctaaaggacttgtcttactttaggtatatcatagaaaaagctggagggtgaataatcctaatcagaagaaattaattcaaagtcatgatgtctagggtctttctaattttgccgtcaacaaagcccatcaaaggtgaaagacacagggctttgccatagcacacagccagcctacctagccaaggcaaccctgttctcaaaattcagctcctagagttgatagagaaaactaatacttttgcttattatatacatttttctctgtttactattttagagtttctcaacagtaaataaaactcctataatagactagggatttctaatctgggtgaatattattacaaaaatatttttttcctagtgatggggaatgggggatggaaggatcatctccctgctttcatctaagatcctgaggactgaagtttctaaaaagtcttaatattccccgattatatactcaaaggtgtttttaacttggcactacatttaatccagtaaattttgaccaatttttaaaaatgtaattagagtccttaagtgatgtgctttcaccaagtggccaagcattgtataattcacagaaggaccattcctctgaaatgtatgctcttagtgagatgtgacttcacgaatgtaaaacagtgataatttacccttttttgtgtttctctctcgggccacatgctaattattatctctaagttacatttcatagtattcacaaaacacagttatgcattaagtacttctgtcacccaattatgaacgtgaagtttgtgagagccttgggaatttctcagactcttacatccagaaagtggtagatctgagattcaaacccatgcagtttgacctctcagccacgtacctgacctaagtaggagcttgtcttttaggcagctatagtagaactgtctgaaatgccattataggaccaataactagcatatgatggtttttctaaatacagagactactaaatttattttaagtaaagagggccaggcgcagtggctcatgcctgtaatctcagcactttgggagcccgaggtggccagatcacctgaggtcaggagttccagaccagcctgaccaagatggcgaaacctggtctctactaaaaatacaaaaattagctgggcacggtggtgcgcacctgtaatcccagctacttgggagggtgaggcaggagaatcacttcaacccgggagacggaggttgcggtgagccgagatggtgccactgcccttcagcctgggtgacagagtgagacaccatctcaattaaaaaaaaagaaaaaaaggaaaaagctctcttcattttaaatttagtagcaatttcaaggcttaaaaatactagtgaagcataaactctttgaagaaaacaatgtcttatccaaagaatgaactgacccacaagaagtacatactagaaaatgttttaaaactagaggcacttgaacggaaatagcaccggacagggaaccatctcatgggaagttgagtcccaattctgacggtaaatttttttcttgactttgaacaaggctttttacttttttcaaatctatttctcatctatgagatagagtcagatatagcagttcctttgtgcaaagggcataatcattgtggaaaagatgttatagtggtaatattttgagctacttgagaacagtactcaatgaaggtaagacagtcatagtatataaaataatcaaagccataatcagaagagtctgtacacttatataccatagttctcagtaagattgactgtcctggtcatagtcatatttttttaagaaagggcagaactatccaattctaatagtgcattgaatcccatttctaaagtcacagtatgcccattttgtggcatatattctgcctactgctaatattcctttagacagatggagtagaactaatgtactggaacatggctttcatttattttcttaataacctttgccatgatcaacagtgaatcacatcaccaaaggaccagatctggattgtgaccttgatttcttgatttagagaagtaaaaaaaaaaatacacatttttcataaaatcaaggtgtagaagaaataagttaatataaatatgaaatgccaagtcccttgaaattcatttgaacttttaaaatatctctttatcaaatcaaagatcaactaaaaatctatagcttaaacaatgcagcattttaaaaaaatttttttctctctcgatcaaatacagttagttgccttggaaaataactgagctatcatttcaccaaaacatgtcaaaccaagatcgcactatttttatcaggaaaaatgaaagagtcaaaaactcatccaagggagagtaaaagttgtgcttgcatttacttataccaaaaagtaggatgtagagaatactctttgataaaattagtatatgataagctggaaaggccttcagataaaggaacaagaatttacaactgtaaaacatgttgtaagaatgaaaaaacagaatcacctattgtcagtggcactactaaaacacattttcaacaagcttaaatatttcaaacgcctatcgaggtcgtgtgtttgaagcaaattcatcgtgtttcatatggcatacttcatatacaaaagtaataagggaaatgttcaaaattcaaattcaaactatcagactttaaatataagtgtccaatgcccagtggtcagacctacaccatggagagaaatttgactgaggataaacatatccataaaattccacagtattttattccttccaaggcatgttttatcacactggattgttgaagttcttgttcataaaaaggagagaacttttctgccaagcaaattaatataattaaggaaaccaaatgtgtcagcctatgttgaaactacagcagagttgagtaaaaactacaaggaattccttccagaaggaaaaaatcataataatacaatgtggtagactgagaacaggtttttaactacactaacttgtagtcaaactactactctgcttcttgcttaccctgcaactcacctgaataaattactcactgtccctgaaccttaggcatgaaatcagaatagcacttacctcagagactgctgtaagaatataatgaggaaatgactaacctggtagttttctctcttcacttatcctttagttccttgactctttctgatatttttattatattttattttatttatttttagagacaggggtgtcactagtctggtcacctacctagactggctctgaactcctgggcttaagcgatcctcctgcctcagcctcccaagtagctgggactatagatgccagccacacctggctttttctgaggtttttaaatctaattttttaaactatatttcataaataagagaaagatacaaacacacctctcatgacaaagtagtttaataatctggtagatctaagggagagactataaaagtagacattgttagagcagaatttcagagaacttccactaatattaacccaatgcttggctattacagaagagataactgtttacaaaggctgcccatgaccctttgatcagcaacatttatgaaaaagtcatccttatagatgtgaaaaatctatttccttataacttgcattcacacatcactgttcttccttctgaaggcattcatagatttgaagactattagatgcctgcattaagactattcactagcctaatattcctaaccactacaaaccttctgtcaagtgacataatttctcaaattttcatcattttgagccctctttaaaagatatattccaatatgttgaataatccttaaataaagctgaacatcatattccagcaatgtttttaccagcacagaatagtaataatgctaatattatgaacatttattgcatacttattatatgccctaaatatttgagatgcatatattttttagtgtagtaattttttcaaattttgtatttagtcatccagtaaaatgttagctggcacctacagtgaggcactatagaataacggttaaggattcagtcttcagagccacacttactggatttgaatgcagactactatttactagtctgtgacctgggggaaaataacttagactttctatgcctcagtttcttctattgcaaatgagattttaagatttgttttaatatcaagctatctatgtgaaacatttagaagagcgcctagtgcatagcaattgtcaggaatgttaatagttaccattattagtactgtagagaccaggtaaccatgtggaggaaatggacaactgaacaagaaataatataactcaacattgaaataagtactgtttaaaaataaagcatagaaggagacaggaagtgctaagctggaaggttttggggatggaggttagatatgtaggtgtaagaaggctgccatagggaggcagcatttgaaaaaacctgaatgaaataaaggagtgagccaaataactgcctagtgggacagtctgcccagaagagggaaaggctagcagaaaaggccctgaagtgagatgagcttggcagagatagtgatatttagggaaagcaagccatccagtgtggctagagaagaataagcaagttaggaggtgaatcagaaagttagcaggggccatatgatgtagtgtttcataggtaatggaaagaaagcacatagagataaaacctcttatctaagttgacagactgatacctattttctttgactctaaagcctgtaactcttaatcacattgctgcccttgacatgaacaatatattagattggtgcaaaagttattgtggtttttgccactgaaaataatggccaaaactgcaattgcttttgcaccaacctaaactttactcatattaaaattccatcagattttttggaagtcaagacacactgatggcttacattgtgcccttgtcagctgaaatatttaaatgtgttttttaatttttttattatgctttaagttttagggtacatatgcacaacgtgcaggtttgttacatatgtatgcatgtgccatgttggtgtgctgcacccattaactcttcatttaacattaggtatatctcctaatgctatccctcccccctcccccaccccacaacaggccccagtgtgtgatgttccccttcctgtgtccatgtgttctctttattcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacattcgggttggtcacaagtctttgctattgtgaatcgtgctgcaataaacatacatgtgcctgtgtctttatagcagcatgttttataatcctttgggtatatacccagtaatgggatggctgggtcaaatggtatttctagttctagatccctgaagaatcgccacactgacttccacaatggttgaactagttgacagtcccaccaacagtgtaaaagtgttcctatttctccacatcctctccagcacctgttgtttcctgactttttagtggtcgccattctaactggtgtgagatgatatctcattgtggtttttatttgcatttctctgatggccagtgatgatgagcatttaattatactttaagttctagggtacatgtgcacaacgtgcaggtttgttacataggtatacatgtgccatgttggtttgcggcacccatcaactcttcatttactttaggtatttctcctaatgctacccctcccccagccccccaccccccaataggccccagtgtgtgatgttcccctccctgtgtccatgtgttctcattgttcaactcccatttatgagtgagaacatatggtgtttggttttctgtccttgtaatattttgctgagagtgatggtttccagcttcatatatgtccctgcaaaggacatgaactcatcctttttatggctgcatagtattccatggtgtacatgtgccacgttttctttatccagtctattattgatggacatttgggttggttccaagtctttgctattgtgaatagtgccgcaataaacatgcgtgtgcatgtgtctttacggtagaatgatttataatccttagggtatatacccagtaatgggattcctgagtcaagtggtacttctagttctagatccttgaggaatcaccacactgtggacagtggttgaacgaatttgcactcccaccaacagtgtaaaagcactcctaattctccacatcctctccagcatctgtggtttcctgaccttttaaggattgccattctaactggtgagaggtggtatctcattgtggttttgatttggattaactgtgtttttttatgggaactcttgctaacttggttctaattcctcttgtatatctgtaactgattttggaagaggtttatacgtattatagttcatcttgctcaattattcctctcagctgtgtgtattctgataaacttgcctgctacattttcatttcaaatcctaataaaaagagtggactagaatagaggataaaatagtttgttctgactgctacaaatacctgcaggcttgcatgagttcattaaattatctctaagatacacttgtacaacaagttatgaacctacttttaacttttaaaagttaatccacaagtttattaaggaagatttgtctaaggttctatataattcacattaatttctaacctagtacatttatgagaaaaagaaaatcggaaattagtttagcatatatttatcaaacacaggaagactactaatttttactatctatgtttctaagatgttaatcttcttaatcatgtgtcctaattttttgccatggatattatacttactcaactgtagattatagttattatctgtttgaaaaatgaatcaacatttatctatcttatgacttatggagcccatactaattaatacaaattcctgaaatattactgacagtgattctgtgactttatctctaaacaaaatgtgtttggacctaagatatcaactctgttacagtagtgagattcagtctcactatctctctagtaccttgaaaccattttggtctactattagtatgttgaagaaaattaccactatgaatggataatatatacaaaaaataaaaaggaattggaactttacccaattactttttcttttcatcatgacatcatctgccataaactgagcctcatccctctttgttctcttgactgcaaacctggttataaaagcctttttttctttagcttttatcccaattctcattacactttggatttaaccctcttgatactattcgtagaagcttgaatcttcttttccctctgtccttaattaaattgtccatttatctcttttttctgcacataaatttttttatttttttaaatttttggttacagatatataataaatgtacatgtttatggggtacttgtgatattctgacacaagatataatgtgtaatgatgaaatcagggcaattggtgaagccatcacctcaagcatttatcatttctttggtacaaacagacacacatacatattttccaaattagagataggagtctcactctgacacccaggctggagtgcagtgatgcaatcctagcttactctaacctcaatctcctgagcccaagcaatcctcctgcctcagcctcagttatgactgcaggtatatgaccccatggctggtgagttaggccattcttacattaccagaaagaaatacctgagacgggaggtggctggcaagatggctgaataggaacagctctggtcttcagctcccagcaaaatcaatgcagaaggcgggtgacttctgcatttccaactgaggtactcggctcatatcattgggactggttagacagtgggtctagcgtacagagtgcaagctgaagcagggttgggcatcacctcacccaggaaacacaagagatcggagaactccctcacctagccaagggaagctttgagggactgtgccataaagaacggtgcactgtggcccagatactatgcttttcccacggtcttcgcaacctgcagaccaggagattccctcgggtgcctacaccaccagggccctgggtttcaagcacaaaactgggtggccacttgggcagataccaagctagcttcaggacttttttttcataccccagtggcaactggaatgccagcgagacagaacctttccatcccctggaaagggggctgaagccagggagccaagtggtctagctcagtggatcccactcccatggagcccagcaagctgagatccactggcttgaaattcttgctgccagcacagaagtctcaagtcgacctgggatgctcgagcttggtgcggggaagggagtctgccattactgaggcttgagtagggggttttcccctcacagtgtaaacaaagcttcctggaagttcgaactgggcggagcccaccacagctcctcaaaggtgctatagccagactgcctctccagattcctcctcttgggcagggcatctgaaagaaaggcagcaaccccagtcaggggcttatagataaaactcccatctccctgggacagagcacctgggggaaggggcggctgtgaagtcagcttcagcagacgtaaatgttcctgcctgctggctctgaagacagcaacagatctcccagcacagcgctcgagctctgctaagggacagacttcctcctcaagtgggtccctgacccttgtgcctcctgcctgggagacacctcccagcagggattgacagacacctcgtataggagcactccacctggcatctggcaggtgtccctctgggacaaagcttccagaggaaggaacaggcagcagtctttgctgttctgcagcctccactggtgatacccaggcaaacggagtctggagtggacctccagcaaactccagcagacctgcagcagaagggcctgactgttagaaggaaaactaacaaacagaaaagaatagcatcaacatcaacaaaaaggatgtccacacaaaatccccatctgaaggtcaccagcatcaaagaccaaaggtagttaagtccactaagatgaggaaaaaccagcatgaaaaggctgaaaatttcaaaaaccagaatgcctcttctcctccaaaggatcacaactcctcgccagcaagggaacaaaactagatggagaatgagtctgacaaattgatagaagtaggcttcagaaagtgggtaataaattcacctgagctgaaggaacatgttctaacccaatgcaaggaaactaagaacgttgagtaaacgttagaggaattgctaaccagaataaccagtttagagaagaacataaattacctgatggagctgcaaaacacatcatgaaaactttgtgcagcatacacaagtatcaatagctgaatcaatcaaacagaagaaaagatatcagagattgaagatcaacttaatgaaataagtgtgaagacaagattagagaaaaaaggaataaaaaggaagcctccaagaaatatgggactatgtgaaaagaccaaacctacgtttgactggtgtacctcaatgtgacagggagaatggaaccaagttgaaaaacactctttaggatattatccagaacttccccaacctagcaagagaggccaacattcaaattcaggaaatatagagaacaccacaatgatacgcctcgagaaaaacaaccccaagacacatactcatgagatccaccaaggtagaaggacaaactgttaagggcagccagagagaaaggttgggttacccacaaagggaagcccatcagactaacagcagatctctctgcagaaatcctaccagccagaagagagtgggggccaatatttaacattgttaaagaaaagaatttcaacccagaacttcatatccagccaaactaagcttcatcagcgaagaagaaataaaattttttacagacaagcaaatgctgagggattttgtcacagccaggcctgccttacaagagctcctgaaggaagcactacatatggagaggaaaaaacggtaccagccactgcaaaaacataccaaattgtaaagaccatcgacactatgaagaaactgcatcaactaacaggcaaagtaaccagctagcatcataatgacagggtcaaattcacacataacaatattaaccttaaatgtaaatgggctaaatgccccaattaaaagacacagcctggcaaattggatagagtcaagacccatcagtgtgctgtattcaggagacccgtctcccatgcagacacacataggctcaaaataaagggatggaggaatatttaccaagcaaatggaaagaaaaagaaagcaggggttgcagccctggtctctgatattaagagactttaaaccaacaaagatcaaaaaagacaaagaaaggcattacataatggtaaaggaatcaatgcaacaagaagagctaactatcctacatatatatgcacccaatacaggagcacctagattcataaagcaagttcttagagactacaaagagacttagactcccacacaataatattgggagactttaacaccccactgtcagtattagacacatcaacaggacagaaagttaacaaggatatttaggacttgaagtcagttctggaccaagcagacctaatagtcatctacagaactttccaccccaaatcaacagaacatacattcttcccagcaccacatcacacttattctaaaattgaccacataattggaagtaaaacactcctcagcaaatgcaaaagaatggaaatcataacaaacagtctctcagacaacagtgcaatcaaattagaactcaggattaagaaactcactcaaaactacacaactacatggaaattgaacaacctgctcctgaataactactgggtaaataatgaaattaaggcagagataaataagttctttgacatcaataagaaaaattcataatgtaccagaatacgtaggacacagctaaagcagtgtttagagggaaatttatagcactaaatgcccacaggagaaagcagcaaagatctaaaatcgacgccctaacaatgaaattaaaagaactagagaggcaagagcaaacaaattcaaaagctagcagagggcaagaaataactaagatcagagcacaactgaaggagaaagagacacgaaaaacccttcaaaaatcaatgaatccaggagatggttttttgaaaagatgaacaaaatagatagactactagccagactaataaagaaaaaaagagagaagaatcaaatagacacaataaaaaatgataaaggggatatcaccactgatcccacagaaatacaaactaccatcagagaatactatgcacacctctatgcaaataaactagaaaatctagaataaatggataaattcctggacatacaccctcccaagactaaatcaggaagaagtcaaatccctgaataggccaatagtaagttctgaaattgaggcagttattaatggcctaccaaccgaaaaatgcccagaaccagaaagactcatagccgaattctaccagaggtacaaagaggagctggtaccattctttctgaaactattccaaacaatagaaaacgagggaatcctccctgactcattttatgaggccagcatcatcctgaaaccaaaacctggcagaaacacaacaaaaaaaagaaaatttcagaccaatatcctaatgaacatcaatgtgaaaatcctcaataaaatactggtaaaatgaatccagcagcacatcaaaaagcttattcaccatgatcaagtcagcttcatccctggattgcaaagctggttcagcatatgcaaatcaatagacgtaatccatcacataaacagaaccaatgacaaaaactacatgataatctcaatagatgcagaaaaggcctttgacaaaattcaacaccccttcatgctaaaaactctcaataaactaggtattgatggaatgcatctcaaaatagtaagaactatttatgaccaacccataaaaccatatgaccaacccataaaacctaggcaatagcattcaggacataggcatgtgcaaagacttcatgactaaaacaccaaaagcaatggcaacagaagccaaaattgacaaatatgatctaattaaactaaagagcttctgtacagcaaaataaactatcatcagagtgaacaggcaacctacagaatgggagaaaatttttgcaatctatccatctgacaaaaggctaatatacagaatctacaaggagtttaaacaaatttacaggaaaaaaccccatcaaaaagtaggtaaaggatatgaacagacacttctcaaaagaagacatttatgtggacaacaaaaatatgaaaaaaagctcatcatcgttggtcattggagaaatgcaaatcaaaaccacaatgagataccatctcatgctagttagaatggcaatcattaaaaagtcaggaaacaacagatgcgggagaggatgtggaaaaataggaacacttttacactgttggtgggagtgtaaattcgttcaaccattgtggaagacagtgtagtgattcctcaaggatctagagccagaaataccatttgacccagccatcccattactgggtatatacccaaagtattatgaatcattctactataaagacacatgcacaagtatgtttattgcagcactattcacagtagcaatgacttggaaccaacccaaatgcgcatcaattatagactagataaagaaaatgtggcacatatgcaccatggaatacaatgcagccataaaaaaggatgagttcatatctttgcagggacatagatgaagctggaaaccatcattctcagcaaactaacacaggaacagaaaaccaaacaccacatgttctcactcataagtgggagctgagcaatgaaaacacatggacacagggaggggaacatcacacactggggcctgtcagaaggtggggggctaggggatggatagcattaggagaactatctaatgcagatgatgggttgatgggtgcagcaaaccgccatggcaagtgtgtacctacgtaacaaacctgcatgttctacgcatgtattccagaacttaaagtaaaaaaaaaaaaaaaaaaaaaaaaaaaaaaacagaaagaaatacctaagactgagtgatttataaaggaaagaggtttaattggctcatggttctgcaggctatacaaacatggcactcacaactgcttatcttctggggagcttcagggagcttttactcgtggtagaaggagaagagaaagcaggcacatcacatggtggaagctggagcaagtgtggcggggagctgccacacacttttaaacaaccagatctcatgtgaactcactcatcaccaagaggatggtgctagctaagccattcatgagggaaaagcccatgatccaaacacctccgaccaggccccaccttaaacactggggataatattttattgtgatttggtgggacacagatccaaaccctagcacctggctaatgtttttatttttatttatgtagagacaggattttgctgggtttcccaggctggtctcagattcctggcctcaagcagtcctcccaacttggcctcccaaagtactgagattacaggcatgagccatagggatgcctagcctacctatatattttatacagacatcatggatcattctatgcaataaaattgttttctttagatattttacccacggtttctatttttaatttcaatgcttttgtgtttgtattttagcaataaatatttttatttaatatttatttgataaatatttatatttaatatttatttgataaatatttatttctcttgagtgagcttccttcatatggttatgaccttacatttatacttaggttttctctgagcatttaaatatatcctttttggtgtttattttttaaatgatatgatgtttgagatttacttcaaaataacctgcaacaggcagtagggggagtcagataatggaatggacaaaataatattggttatcggttgctgattgttggagatgagtataatgagtgcatgctagctcattatattgctttctccatttatacgtaagtttgaaattttcctcaatgaaaaattaaaaataaaagagattgtatgttagtaccagctttttagagagtactaacagagccctaataatgcacaccaccaatttttcttaaattgtgtttatcataattttaaaagcttttaattctcagggtagttttaggtttacggcaaaattgaaaggaaggtatagagattttccgtataccatttgcccctaaacatgtatagcctcccttattattaacatcccccatcaaaatggtatatttgtcgtaattaatgcatctacaatggcacatcattatcgtccaaagtccacagttcatgttagggttcactcttggtgttgtacattctgactttggacaaatatatgacatgtatccactgttatactaccatacagaattgtttcactgctctaaaaatcctctgcacttcacctacttactccctatcccctaaaccctggcaaccactgatcttattactgcttccatacttttgtctttcccagaatatcatgcaattagagtcacagaatttagcctcttgggattggcttctttcacttagtaatatgcatctaagtttcctccatgtcttttcataacttgatagctcattttttaagctctgaataatgttccattatctggatgtacaacagtttatttatctattagcctactgaagtacatcttggttgcttccaagttttggaaattatgaataaagctggtataaacattcatgtgcaagcttttgtacagacacgagttttcaactcctctgggtaaacaccaaggagtgcaattgctgaatcatatggtaacaatatgtttagtaagacaccaccaaactgtcttccaacataattgtactattttgcatttccaccagccatgaatgagtgtctagtgctttaaattctcatcagcatttggttttgtcagagtttttttttttattttggccattctaatagtgtgtagtgatagctcattattgttttaatttgcatttccctgatgatatacgatgtggagcatcatataataataataagatgtcatatgcctacttaccatctatatatcttttttggtgaggtatctggtaaggtctttggcccatttttttaatcaggtcattaattttcttagcattgaattttaagttctttctatattttggataacagtctttatcagatgtgtcttttgcaaatatttttccaaggctgtggcttacatttttatccccttgaaagtgtcttttatagagcagaagcttttaattttaatgaagtccagtttatcaattttttggattatgcctttggtagcatatctaaaaagtcatggcaaaagccaaggtcatctagattttctcctatgtcatcttctaggacttttatagtgtgtgttttgcatttaggtctgtgatccattatgagttaaattttgtgaagggagcaaggttactacctagatttctttttttctctgtgcatgtccagctgttctagcaccatttgttgaaaagactatcttttctctattgtattgcctttgctcctttgtcaaagatcaaattactatatttatgtgagtctatatctgggctctctattctgttctattgatctctctgtgcgttcttttgccagtaccacacttcctagattgctgtagctttatggtaagtcttaaagtcaaattgtatcctatggtagctttattgtaagccttcaagtcaggtaatgtcagttttccaactttattcttcttcagtattgtgcaggatagttttatagcagtgaaaaatgcaaataatgtaaatgtccaaccatttgttcatgactagtgaaataaaatttggtggttatgatgaaatacactgaattattaaaagcaaactgtcagtcttaggtaagtaaatgcaagtttctaaatctatattttaaaaagcaccatttatatccctatctgtctaaacatctgttgagttttttaaaacgtcattgtttccatttataatatcctttatattttcttagctctctaaatggtgtatatcttgttgacctgaaccactggtcccctcacttaaacatgtttctttctgttgaacgtattgtagcaattcattttctcattttggtcatgagttgtgactattgtcttttatgaaagtaaacattcagtcctaaggacaaactaaataagcttatcttttctgaatgtatcgtatagatttgtaccaaaaataaaattggcccaaaagccccactgttgaagatatgtatcatgtaactttatttcttaaagattgtattagagttccaagaaaaagcctacaatttattataaattaaatgaagcataacaatagtgtgttttttaaaaaaatctcattcccacaaagcaaagtcagatctaaaaggaaaagtggccatgaagttctctgtaggcttgttttattttatcttttcagtgccttggtacatagattagcttaaacatttgaagaaatatgtgccatgaagaaaagtttttgttggattctatgaatacatttttatttatcagatttagtttgctcacatttactatttattgtagtgtttcttatgctatcaacaaacatagctaaatgttactacattttaatagagtaacactgatttcaaatctgtaaattaaataatgaaaaaaataaatgagaagaaaaagatgttaatattaattgaggaaaattttctgaggtctgctattgaccaagaaaataaattatatgtaaaattttacagtggaaaataaatatatagaaacttggcctcctcagtactatcctttcagaaattaataaaaaaggtagaagatattattaagtcagataaatgccagagaaagggctttttaaaaatctataagtttgaaactgtttcatagaaatatgtcaaagtctgaacttccctgacttgattttgcgtgattggcattcttcaagggacaaagggagttttctggtgcaatctgcctaatggatgtccttttatttatttatttatttattttgtttcattttcctttcctatttctcagatgttcttagcttgaaaggtttattccataggttcagtggtcttctttagaccagaaagaacttaggtaagacatgaagttaaggtcgcactgagtgcactttccagtagtcaacttagatatttgtcaaaagtagtatgacatttggcaaggtaattgacagtagcactgactttattctcttaacatgttgacagcacacaaaagctcaaaatctgctttttaataagtggatggtacccctaggctaaagaataatgagtgtacattttggggcatcttctctttatttaacctgccatgctgtactttatgtattagaagtagacaccacagttgtctggtttgaaaatactggtcttataagtcagtatccctctgcataacagagatgagctagcttttgccaaaaataaaagcagggagagaaagataaagaagggtttgtgaaattcatacagtagaatttcaggaaaatacagcaccatattacaaatatacgtcactgtttactcaatttatatctgaaataatttgtaactactcacctgataatagattttagcatcccacaaaaatacttgtcaaataaatattctacattttcaattagaatgagaaaacacttattaaatgcattttacaaaaagaaatattatatggcttttgaaataaagaggaaatcttaatataaaacatatctagttgcaattgaactgtcaaattagcttaattatagaactttatataaatatttccttactaaaagattttatttcataaatgatctcttaaaagtataacaatagcaataaagattataaatacctttaagaagtgagtcattcattttaaaaatctaccacaggtaataaaatattatgaaacttaatacaccacacacatgagattaccagtaaaactgagaaaatctgaataacattggtggatttcattcatatcaatatcttgattgtgaatattgccctatggttttgcaaaatgtcaccattggagaaactaggcaaagtgtacaaggtgcctttcttaccactgcaaatgaatctacaattatctataaaagtttcaataaaaaaaggaaaaaccctacatttttatggacagaagtttaaattttcaggcaggagaatataatcaatcttatttctgttgcacgaaaaaacctattgtattaaaaaataaaagaaaatacattctaaatgcaaacataatttaagaacgaatcaatctctaataaagtcaatagagaaatgcaatgagtaagcaaattattccataaaaagtatggttcacatgcagaaaagaagaaaaatctttttaagcaaatagttattccttctttaaatcctagcatacgtctaacctctttcttcattctcattctccaggtttaaatctaagctttcttcgcatttagagtctaaaaattcttaggaatcagtttatctctgaagagttatatatagcatcaaggaaaagatacagtttcacacaatcacgcacatgcacattatcttgccctttttagaactgatagtataatttagaggcactatattagagtatgaaaactttggtggcttaacccaacaaaggtttatttgacactcatctgaaagttcaatgcagtggtgggggatttgctccacacagtcattcagggaacaaggattttttctgcgggtgatttatcatttttctaagacgtcaatgtcctctaccatatttctacacctgactggcacaagcgaagaacccaaacacccattatttagagaatggaaaagcaaattgtgacactatcaggatacaggatactactcaacaatgaaaagaaacaaatgattgatgcacgcaatgtgcagtattgtggattaaactaagtgcaagaagcccagactcaaaaggttacaaactctataattttatttatatagggcattctagagaaaataaaaccaaagggacaaatgagtagttgccaagactaggagctggggaagggattgactgcaaggagatgaggggatttttgaaggttttagagatgtgtatattttgattatggtcatgattatatgattatatacacttttcaaaactcatcaagttgaggctgggagcagtggctcatgcctgcctgtaatcccaacactttgcaaggctgaggcgggtggattgcttgaggccaggagtttgagaccagcctgggcaaaatggcaaaaccctgtctctactaaaaattcaaaaattagccgggcatagtggtgcgcagctataatcctagctacttgggaggctgaggtatgagaatcgcctgaacccaggagatgggggttgcagtgagccaagcttgcccctctgccctccagcctgagtgacagtgccagactgtctcaaaaacaaacaaacaaatgtcaaaaaaaaaactcatcaagttgtgtgattacaaagaatgaatttttttatatatgcattatatattaacacacctgactctttaaaagtttaatacatgctttatactttttatctcaactttcaaggttagaccaggagaaacatattttttaaatgtctgcaaaagtatcctcccttctgtgccactgtaaggggtggtcagcagagcagcagcagcagcagctctgggagctatttagaaacactcttttgcccccttctccaccttccctttgcagaccttttgaatcaggatgtctagttgtggagcctaggaatctgtgtgctaacaagctccttgggtcatgccaaagttttaaaagcaatgatggtttataagaaaatacaaatcatgattatttttccagcaataaacatatacttcacttatagtaaatttaaatctgatatggttatttccccccacattcctatttacaataccattttcattttcacattgtaacattctactgtcatgttaactaccttttaaacaatttaagttgtaatttgagcttgtgctatattaccaatgcattagtaacactcgtacaaatcaaagcaaggaagtttccaacttctctgccaaaggattgagaaaggcgtcttctgatcttagattaattttacaaatactaaaattttaaaaataaaatgttaactggtcttagatttgtgaacatgaaggcatatctcttaaaatttccttatctaggttaagatgaaataattaccaactctgaagaaaaggctaaaataagacagataatgtaagatatatgtgtgttgtgttgggaaataaaaggcacaaatttaacagacatattttcacttgcgttgtgccagacttgctcagaacattaatgtaagctttgcccatggcttgctgagtggtccattctcctcttgagacttagagaatggaacagtaaccttgtgaccagggtcactgccatgctcccagccttgttgatggattttagaggcagcctaaactaattccatgaacagtgaaaatgcatttggatttaaatgttttataggctgtctgtcacttaccttctggaagttagcttttactctgcttcattaaaccaacttacagtattcacaacagactggcattcacagaaacgaagtcatacacttatgaaatcctttatttattcaagtagcttggagaattacaaagagtatgagcctaaaagtcagtcagacacaaatagatacaatctcagctctgccctatctgtgtgtattgggacaacatacctaacctcctccaggttctgtttcctcacctataaggtaggaattagaatagccttgcaagcatggtcattgtgaaaattgactgagataataggataattattattttttattgtttaatgaacatatcttaagagtcttatctgcttcaggcactgtattccctaggaaaaggaaggcacacaattaaaataagacatgattttccccctgaggagttccatggttctcaaagtggttggtaatccccttctagggattcctaaaactgtgtggagatattattggatgttacaaagactggaggtgctattgatacttcatgttcatggattctaaagattctaaaatgcatgggacagcctgagcaacagcaaaataattatcctacccaaaatgccaatagcaccccaattgagaaacaccgtagtagaggaagctgaaatgaatcgactataataatggatagaaaacaaaacaaatttcataatagatagatgcagtaagcacatcattaacaacatcataaccatcattgtaataagacaatagtcctttacaagacagtttgcatcatttcatttaatcctttgcaacaaaccatcagggagtgcactatatatctgtgcttcacaattttcatgtgtgtaagaaccaaatggggatcttgttaaaatgaagcatctgattcaataactgtactttaaacaactcatcagggggccacactgagttggcatgttatgtataatcgtagggaacactgttggtattgtggccaaaccccctgagacacctgttaccatttttgtgctttctgcgcccacctcaaccctgcgcaagatttacttccaacacctgtacctgtgattcccctgggcaggcactgtggctactggagctgctttgccaaaatccgatataaagttgtaaatgcctggaagtttagatctctctagggagaacttgagttaatgactagctggtatgagagtatgaaacctcaattcctttgccaaatcaggacaaactctgaggcatcacttatccagagtcccctgcagaatttagttcaagctactgtcttctggactatgcctaaaatcatacctttacttgcccttctatttccctgccctcctttcattactcccaccacagtttcctgtgggaacacttactcaataaatcactcgtatataaaacattatcttagtttctgcttctggagaagcctactctaatacatcctcaatttctctcttttcctcaactcacgcatccttttggttcaccttccaaattacatcccaaatccacccatttatcaccaaatccagtgctacactcaggtcaaagcttccataattttacctggactcatgcaattgccttttgacaaccccaatccattttctgcattttcctgagggatcgtttgaaaagtaaatgatattatgtcacttttatgcttcaaatattaccactacttccttttgctcttagaataaactccagacatcttactatatctacagttgtttacattctcaggtccctacctccgtctttactgacatctgctaacaaatcctagctttgcccattttccttcagccgcactggtctttgttttttcttccatgtgtatttcacctcaaagacactgtgattctgactgtgctgttctctcagattttctcatcattcatctcagttcaaatgttactttaaaaaaagaaacctacctgactacccgatctaacatagaatcccatatcctccaacactttccatcataaattactgcagttattttcttcacaatatttgttattatgtcacattaacttgtttgcttttgtttgttactgcttacttattgacatgctctcaatgttattagaatatgttaataaattcttgagaccagggaccttgtgaaatgtatcatcaatgtctatagtaccttgatcataacagaagcttcattaatattttttaaataaatgaaatataagtgattctcatttaagagatgacaaaaataaggctttatatattacttgtccacagtcacacaaggtcactcagtagccagtggtggagctgggactcagctgagctcttggtcatgtgttatacttttcccctgtttctggagtttgttctgctcaagaactctgatcaaattcagcctcattcagcctcactgttgactcacagactttcccttagtatttacaccacataatgctagaatggaacttcttaggttgatattgaggaaggagaaaaataggaaagctaagtaagataagtggaggaagatagaaaaaagtggtggagacaataagttggttaaggggctgtcggggaaaataactactctagaggatagcaatcatttattttaaaaagctttattaagtgatgcaaatgattctgctatgggtaatgagataaacacccagcaagcctaaagcttgctaattaccctgatctaatcacttacattatgtacatttcagaacatcactgcgtactctatgaactccatgaatatgtacaattgttatttgtcagctaagaactacattaaaaataaagcaataaagtatatgttgaaaaaattaattataatacaaagaaaattacagactaaggttactatgttacataaaatttataattatagacatcttatggatttagtttgatagtctagctgtagatggctgggcatcaggtaaattggccctgaattcctctcattgcctcttcatatggatttacaaaatggtaaatggaggcataaaatccctaaagaaaactacttccctctccttctgcctttctttcattcatccatttattcatccctgttcattcatttaacagctatttataaaacatagagagcgagcaagagggtgagagagaatattattttgtctgggatgtcaagataagtttctttgaagaagtttaaactgagctctgaaagaagactaggaattaattattgctactacttagtgtatctctagtatgctaaatagaaatcaaatagagaaggaatgttttgggcagatggcaggggtgaaggtcctaaaaatgtagggctcatgaaacataccttctttctctgtttcatcttgaaatctcatctctaacaataaatacaagtaactttcttgaggttatttttccccagaagtatgtggaagaaatgcatataatgtatatagtatatataattgtgcatattattacataaattatgtaagtatgtattatatctaacatatctgtagagacagttgtggatgattgccattgaaagctaactttcatttgagtagtgcagtttcacattaaactgaacttgggcatgaatttcagaaagagtatagaaagggttaggccctttttaggcccaacctaaaattttaaagcctttaattgaaaaatttatgacagtttcaggttagtcatttagactaataaagtttagcaacatcacatcatctgtaataaattgttgcttatcataaacctattagggaagaaaagtttaagtcaagaaaatgtatatataaaagtaatgcttattttatgggaaaagtaatgcatagtaatgcatagctcaacatggaaaggtatgaaatgaaaagtaagaggaatgactcagtgtgttacagaaaagggaagataagtttgtgataatatggaggcagaaccgaagtttcagaaacagaggctaagaattttactccccagctctgttaaccttctagatcactggcaaatggaaaaaaggatagtggatggatcaggcttaatcgcagaaaaggtttcatgatatttggatacagaaaggttttttaaagctaattttaaatgaattaaacatcagaagcaaatgagaaactgatggttgctggttggccttcctctgaggtaaaaggtcaagtgattgcttgaaagatcatctaacttggcctatgaaatggaatgtgttcattttattcagaacttattcatgtgtcaaactttagaggattgtataaagacatcggcaaaactcttgaactatctgatacgtctatttcatataaaatgcaaaaaattgtgtaattcaccctttcaaagaaccataatcatttagaaggcagtatgagaagcatttcatttagcctatcaaggtgacctaagatagttagtttagatgtgtaagcatatgctctagtattttgcacgatatgctttgagttccattatgagcatttcaggtagaaattcatttttcaatcattttcttctctttttagacacatatataatttaatataattttagagacctcattatattataattttgtcctctcttctccactttttaaatgttacatctttcctatttgattacagtatattaaaataataatgagcttgtcagtcttatgattgacatatatagaatgtcttattttagctaggtcgaaaaaatgaaacaattctaataaaatatgtatggtaaatatgatagatagacttattgcagcaaaggaaacttgaaaatagaatttatttattcattacctgtgtttccatggctacatctcaggcacacgaccacacccacagtagcatttatacccattcatatcacccctttcctggtcagaatatggagagaggggttgccatattgggtcctaagatacagcaacctgcagcacatgcttttactaaattgcagcctctcacttattttctcaggtctgtattattgtacatattttaaagaagtgtgagtcctaaggcaaaatttaactgcgaaatatataagtagtacatcatttccccctagaatgtaagctccaccagggcccagatctttatcagttttgttccctgaagtatatcatgtacctagatcagtgcttagcacctcgtggaatacacaggagagagacagagagaaagagagaatatataaattacatatcaggctgacctgctattccaaggcaggaatgtgttcagttaactttgagtttttattgttctttgctacctgtcagactttgcacatatcccattatctttcatcactaggcccctattgtacaactcttttaaagtatcttgagtaagattagaattttgaggtaccttttcttatttccctgctatttaaaacaagagacagaaaactagcactaatggagtgtccatcatgtgtctggcacagtgctatacatgttaatgtatatcatctttttaaacaaagaagactgaaattggtctaatgcaacatgactgtatgctgcctttatcttcatcagggtgctttcaataatttggacagctgcaaatgagattgctactggatagctgtgaatcaatttaataatgcagattaacttgaaacatgagagagacatctatgggattttttctgccagatcctccttagtaaagcatggactatctattaatattgctgctgctggactttttaattctatgaagtatatccagatccccctttacataatttttaaggactatggtgctaacattttagtatatctctagtatgctaattgggaatcatagatatccttcttaataaaatcatgttcttttgggagctttgcaaccttcatgtaaccctggaccactgcaaatagagttccacatgtagataaaacattgttgaaataatttatgagttggaacctaatacaaatggattcaaattccaactccacaacttattagctaaacttagattcctgagacttagtttatttgtaaaacaggaaattatttcagcactgttgtaagaattagagaaatcatgggcaataattgaagggtagatactcaataaggatgctataatcattgatagagggtagagataggaaatagtaatattttacctttacatttgtattttccatttcaacatatgttcagaataaaggtttgggattgtgacttaaattcacagtccctattcaatgcccatctttcctccaaggcacaaattgaattgtacttcctccagctatgcctatctcacattgatctcttccagtatcatttatctttcctgtagtgaaaattgcttgcaaacacatgccagaaagcctgtgttaaatatgaaatttttgcttccttcattatatgactttgggcaagtcagtttacatttccaaggttcaatttccatcttattaaaatggctgtggaattgtactgaatattgtattagtctgttttcatactactgataaagacacccaagactgggcaattgacaaaagaaagaggtttaattggacttacagttccatgtggctgcagaaggctcacaatcatggcagaaggcaaggagaagcaactcatgtcttacctggttggcagcaggcagagagagagagcttgtgcaggggaactcctctttttaaaaccttcagatcttgtgagacttattcactatcacaagaacaacacaggaaagacttgcctccatgattcaattacctcccaccaggtccctcccacaacatgtgggaattcgagataagattttggtggggacacagccaaaccatatcaaatattaagtaagataacgaataaaagatattcaaaaactttatagtgctttataagttgtctcagttatctgtggctgtgtaataaatcacaaaaagttggtgagctaacacaataagggttatttctcaactctataaagtctaggatcagctgggtagctcttctgctcaaaatggtgtccaaggatggcttcttcactcactcgtctggtgccttaactgacctggctagaataactgattctagctgggcatctctattaccatatgttttctctggcagcatagccagaacattttacatagtggttcagggatcttaggagagcctattccaagagaaactcaagtcttaccttgtattatgcttgttaatgttttattggccagagcaaatcacaggacttatcccacagccaatgtgtgaggtgacaacacagtcacatggatcccaggaggtgtagttcatttggggccaccaatgtaacagtctacacacaaatgtaagcagtaattgacattcccatttcatttctattactttgctataccacatattttggcatttgttttgcctccatagtcttcttcattggttcacgtgtgtactccttgtttcaagatgataaattttctagtggcaaggactctgttctaacatcatgttaccttgattctaacatcaaagctaatatttaatgatatattggaatatgtaggctttgatggttttgtagaagccgaatccttcccatatctgccacttaacagccattgtggccctgagcaagtatttgacctctttgagcctcagttttcccatttgcaaaatgaggataataatggtttcttccttcacatgattgttataaaaattaaattagttaataatatgagaaaagaatagtgcaggtccagaataaattttaaatgttagtgttatattttactgatataaagatagcctgatgtacttgtttaatttgtatctgatctctcatccatgggccccagtttaatacttcataaaggaatagatttcttgagtaattcacacagaaatattttacagcctcaaaatttggagtatttatatataaaataaattctatattttagcactgcattctcacaagttagtgaaggccttgatatttttgggcattggtgtttttaattctaaaaggaggaaactattctggttgtattcctaacctttttgagtttgggcagtcttatttggtaatctgagttaaatacattttaaaatagttatgctaagatattttaattgagaagcttgtgatatttattgaaacttctatatagaattcacttacctgtaacatcctatgatataaggatattttggtattgcttacatgtgaaaatgttaaagtggatataggcactcaatgatagtcaagttatccctgccactatgctaccctttagaatttaagacctccttttgagcaaggaatgtttctggcagcatcaatagcaatcaattttctactcacattctctcttttccacccagtgaattttactgccttatgggcagcaacagttgtaccctctgattgactccactactctcctcttcacatccaaaaacaaaatccgctgacaaaatagctttgctttgggaagagattgaagggattagaccacaaaatgctactttttgggggtcaggacaagtagaagttgaaatagtcaatatatttattttgcaaacactattttaattaacttttggtcattttaacaataacttcatagatatttaaaaacctgataagtatcactttgcttttttgcattagaagctattaaattatctatatatttttcaaatatagagaatattgcccacatgaagtacatattgcccatatgtagttcacaacacttttttgacgttttagtgagtctgtgttgctggttcttcgatacgtgtgcatttccttttattttttttctcttgatccaagaattttctttaaagagatatgctttccagaagaaaaggaacataaaagtacatatgtgttttagtgttcagagtatattcaggtgattcatattggttgggaggggcaggagatcaggtaaaaaagggtgaagaaaagaaagaggacacagttttcctggaaatggaaggatgaaaaagaaaaatgcttgaacaaatattgtttctgttttctcattgatccaggaaaaatagtttagaagtatattcaaattgcctaggtccatgtttttaatataacaggaaaattatacaaatcaaaaaatcatctgcctttccccaaaaatgtgtgtttttttacccatttggtttaatatagacaaagagtctgccatttcttccttaattaagcatgtattaagtgtttacactcaagcgtcatacaaagccctcaaatatcttaaagcccagtgtggcagacagaaatatgaaggaataaggtcaaagtacaattatggatttcctaataaatgtctgtgctttgtaagaggagggggtgggcatcagggagttgtcatggaaacatttatagaagagaaaacacttttaaatgcaaaggcagccactaaaaaaccacagtgattgaaggacccttctaattcaaaaatataaaaaataaaagggaaagtgtaagtaaacaaaagaagaaacaagatgataattttccccaaattcagtcaagatttaggatatgaagaaagagtattgaaaatacattgtcatgcatgtattaaattctgtttgaaattctatcagtaaatgtttgccaattttttggaggaaaagattacatattttggtgcatatttattcatggaacaaatgctatgtgccagaccacaggagttactgggaacaaaatggtagggataaaactagtccttgccttcatggagctgaaagtgaacatgaaccaaatgtttccctcaagtcttctgtactcccctttacaaagtgaaatggcacaggcctgaagtgttctgtgctttataaagcgtgcaagtagttttgtcagctttctggaaaaggcctaatattattaggaagcaaatttgcatttaatatctacttaactcaggtcatattgttttctgttttgactttaaaaagaaaatgtgatgggtaataacaataaaatgggcacaattatttagaagaggcgtgtttgtgccaagaaaattacagaggcagagtaagatttgcaaggagatggcatttttctcataattgctctctggatgtgtgtgcagcaggtttcatttgagggtggccactgttgagaacttctttcacagcaaagtgctgctacacctaaagttttatctgctcttccgtggtttcatcttagctaccatagcaacactaacagtgctattccaccctcccatcaacattcaggagaaggcttctcttgtctgcacgggattgcgcttacatccacttagagagcattcccaattcatcagatgtatatcttttagaaacggtttcctgaggagaaaaataggtattttgagagatggttatgatatttttagcccactgagcaattttgatagccttatcatagacacagatccaggttctgtgggttctaaagattatactgttaaaagtggggaggggttggggatggaaatactgttttttgaaaagaatacaaatttacaaattcaaaattagatacaaaaatgaatatttacttaggatgagaaaagcaatcacatcacattacaaagctcggaaagctgatatataggtatcacaaactccagaaaaagaaccttgtcttgttttttgtattttttttttttttttttttttttgagttggagtctcactctgtagcccaggctggagtgcagtggctcgatcttgggtcactgcaagctccgcctcccaggttcacgccattctcctgcctcagcctcccaagtagctgggactacaggcgtccgccaccacgcccagctaattttttgtatttttagtagagacagggtttcaccatgttagtcaggttggtctcgatctcctgacctcgtgatctgcccgcctcggcctcccagagtgctgggattacaggcgtgagccaccgcacccggctgccttgctttcattaactgtcagacattcttccataatagtttttcctataattttatatctgtatactcattgatttcctctttatgaaggacttcgtaggagcatttctggagagcaattagaaaatgtctttccactagcatagtgatccaaatcaattttttttttattcttgacagtctgaaataacttctttcagcttcacagctcattattggttatgacatgtacatttttagaattgttgcaaaatttaggaaatcctctatcaagtttattttgtatgtgaactgtcagatttggaagaatatttcacagactagcttttggctctgaacattccaaaccgtttttctcctccactacccacacagttccagtgtcaagcaccagaggacacgttcatatcacagtacaaaatccaactctggtaccttttgtcgggaagctcaatattgacagcccaataggtgataggaatattccagtcctgacagctggtaactgcaaaactttaggtgatctgcggtcatttccacacaattaaccatatagggaaatgaccccaaatcacctaaagttttccttcctaaacttatttaaaatatacccaagtgaaattcctcttaccctcatgcaaaaaaaatacttaaggctattccatcgccacctgaccaatgggaagtatgatagaggggtagttggtgttgaaagagacagtggtcttgactgattgcaattaaagtatgttaattttgccagacaactgagggacactgaccttgagctctaggggcttctcagtgagcctgcatttgtttaggatgcattgaggcaacgcttgcccacaccaatctcccttagcctacatctggccctaaagagagtccacatgtctaaggtttgcttaacattcctctcaggctttccaactccctcttgctttcgttttctttatccctgtcacttctttatccaaccaaagactgagtgatcaggaggaaaataagactgactggcagagaagatgtgcatgcatctgtcattcggatcatctccaatgctctgatctatgttctttgttattaaggctctccaaaaattattttgaagaatggactgagtttacatctctgatatttcatctgtattctgccttttcatttttgtagaaggcacataacagatgtacaattaatataaaaaagaatgagtgccagtgacttcagtgaatattgatgaaaacatttcttctttggtgtgtaggggtgagatttttcagtgaagtgctgccagcatttgctctgcacagtctctagaacttctagaatgagacattatgcagccatatcaacagatcagttgaacatggagaaggtgataggaagcttttgttaaactgtgacagatgaactattatcttattcttccccgtttcctaccataaaagtaggcaagtggggagagatactgatgtgttgatgcaatagcacccactgacgcacaaaaattgtttctttctgaatatttcgagaaagaactcctgtgttttcaggcttgtagttcagccacatgtatccataattgactgcagtatggaataaaacttacaagatagctatgaaagttgactgttttgtcatctagagacttgataactgttttgttgcaccaggcatgaatgttttaggcagttttttgtttcgtatgtcatgatgccatattctaaatgagcatcaccacttcccttggcatatttttgaaacactctgcaaagcattacatggttaattgtcagaaaactgtcactgaggaaagtggaaagtgagatcctcttccccagtccctggcaaagagcattttttttttcttttttttggtattggtaagcgtttaatatccagttctcaaaacaaccccccccagtaacccccataccacaaaataacaataacctgatgtatagcatttgcaaattgtcattatatatatatatacaatttaacttctgggatacatgtgcagattacagtatttgcaaattgtcattttatatatattatatatttaatgtaagttctgggatacatgtgcagaacatgcgggtttgttatataggtatacacgtgccatggtggtttgctgcacccatcaacccatcatctgcattaggtatttctcctcatgctatccctcccctagtcccccaccccccaacagccccccgtgtgtagtgttcccctccctgtgtccatgtgttctcattgttcaactcccgcttatgagcaagaacatgcattgtttggttttctcttcttgtgttagtttagatttttggaatttcctgagtgatagaggtgaaaggagaatattttcttattcataagtctcactgaaatggggcttattataaatggttaattatccaaaaatcaaagtgaaaaaagtagaaagagttatttgtagaataaaacagaactcaaggtatatccagggcctccatgttcatcaattaatccctaaactacacagcatttatatccgtaaatatgttatagtaaatctggaaatataaaatattttaaattgataatgttagggaagccaagagtcacagagttaagagggctgctctgaactgtttttgtttttgtttctgtcttatagcttgtttaaactagaaaggaccaaatgccgaacctactcatgtacagatgagaaaattgatatccaaggaaattaagtaacttaccctaaacctacaacctgctagagatagtcagggctaaattctatgtctgctaattaactcagaactctttcactgaaatatcctgcatatctctatcaggatatctctatcctgatggagaactctttctctatcaatcctgcattattgaataattttatgtgatgtgacactcagtttgcaaattagactgagcagtactttggatcctcaggaactcctgtttttaaagagatgccatgttctcttttgttcattatcattgaagatagaaatgtcaactcttaaaaacataagattttgtggttgaaatttttccttatattttatagaaagtctctgcatattttgtgctccatgtattgatttcctgttgctcctgtaacaaattattacaaacatggcttaaaacaacacaaatttgctattttatacttctctgggtcacatgttcaaaatggatcttactggctaaaattaaggtgtcagcaggtctgttttcttcctggaggttttaggagagagcccattcccttgtctttttcagctcctacaagtcacctacatttctgaactcaaagccttttcctccattttcaaagccaacagcatcgtatcatccaatctccctctgtctctgaccctcctgactgtctcttaaaaggacccttgtcctttaagattaggcccaactggatcatcccagataatctccccatctgaaaattctcaccctaatcatatttgcaaagtctcttttgtcatctatggtatcatatggacagattttagggattggaaggtagacatattggagtgggataaagcattattctgcccaccacactgccctcttaacttaaaagaattattttaacttgtttctcactagacgttgctttagttttacagtttcttcaggtttatcagaaatagaatgagaagtagcgatcatctcagacatttgcctaaaataaatataatttctgacacttacaaaatgtatttatctctctcatattccagtttaataatggagaccttacttgttatgtatttgtgttttttttaataataaaataaggagaaaaaagaaacggaattgtgagattatatttagattggggaaataaataattccttaggttctttaaagggtgagagaacaaagccccttcaatagaaacgattttgtatgacattgtattaatttcctagggctgccataacaagtcaccacaagcttcctggctcaaaataacagaaatttctctcaaagttctggaggctagaaattcgaaatcaaggtgttggcagggccacactctctctgaagtctctaagaaagcatccatcctgtcctgcctcttccatcttctggtggctccaggcattccttggcttgtgggagcatcactcccatctctgcctccatctttacatcatggtcgtctctacgtctccatgtgtccttttcggtctctcacaaatatactttcattaaagttagaatcatcctaatcttcatccagatccttagttatgtcttcaaaaacctatttccaaacaaggtcacattctgaggttcaagatggacatgaatttcgaggggggcactatttaactcgctacaggtataattatgtatgaaggaattattctttataattaactttctagtttgtgttacacttctctttgcttaaaaaataaataacagcaaatcattagctgctttcttcttcggtgctgtggacgtttttttctgttattattaatattgatccagttcttgggaattttctcaatgctaaatgataatgagaggaagaaagataacaatgattctcattgaatgttttttgctatattcttggcatagtgctggatactttacaaacatccaatccccataacaatcctggcaagtagttatattattatagtacacataaaaaactgaagttcaaaaaggctcagtaacttgaccagcattatatacctaggaagtggcaggggtcagaatcagatataacaaaatttctctctcttccaattttccagtattctcatcttagggtccattctgtccaaggccgttcctcagacacatccattctccttcagttctcacttttgaattcacctccaagcttatacactagcaattgacaactaatacatagccttcaagctttttgcaaacaaactacaacaatagcacaacaacaactagaacttcaaaagtttgaagagtagtgaaaaaagagaaaacaaaccaatgaacaagacatcactaaacagtcctattggatttgggaaccacaggaagcagatggaaaatgctgaaacatttctctagagtcattgaaaaatgacctctattaaattggaaagaattttagggttccggtcttagatcacaaatgaaataaaaacagtttcataaagacacaactgtttctgagtaaaatatatctagaagttccttgacttactaaatgaatttaccttgggaaaaaacatatttcttgaaaaatattttaaatagaagggctatccctctaaaggctctcttataacataactttgaaagtaaacataagccaacaaacaaactagaaagcaatattgtcactatattggttaataaataaaactgggaaaaaataatatgaacattttgaatactggtccttaaataggataagtatttgaggatgttgacagaatcagtaaatacattaacaattctttttgataaacatttaagtagagcttttgaaaaaaattttcttcctttctttattatactatccctcaatggttgaaaatgttgttttttgacatgagggatacttcctttctcttattgattgaactattgtgttctagtcttaaatttattctctttttgtaagaggatacaataaaagtatgagtcaaagaatatattggggatttcaaaaaattcattagaaatggaatttaacataagctcttaatataagctccatcaagttcaagacatttttgtaaatgatgataccatccatttgctccattcctaaagaactgagggtcctgggaatttaactatgtttatgctgtcttttctgcataattaactgaagaaaatgggtatcctttacagatttttttaagattaggaaacaaaaatcagtcaaaaggagctaaatcaggactataaagtggatgcctaatgatttcccatcaaatgtctcataaaattgcccttgattgatgagaggaatgagtaggagcattgtcgtggtggagaaggactctctggtgaagctttcctggatgtttttctgctagaactttggctaactttctcaaaacactttcataataagcagaggttatcattctttggccctccagaaagtcaacaagcaaaataccttgagcatcccaaaaaactgttaccttggcctttgctattaccagtccacttttgctttgcctagaccaagttcacctcttagtagcaatttctttgattgagtttattttcaggatcatactggcaaacctgtgtttcacctcctgttacgattcttcaaagaaatccctcaggatcttgatctcatttgtttaatattttcattgaaagctccgtttttgtctgtgagtgatctgggcacaatgattttggcacccagcaagtggaaagtttgctcaactttaattttgcagttagaattgtgtacgctgagtcaattaagatgtctatggtgttgactgttgtttcactggtctttttcaattagggcatcaacaagattaactttttttcccacaaagtgatgtggatggtctgctgctgagggcttcatcccacaacatggtctcaacccttcttaaaatgaggtccatttgtaaactgctttcttgtggggcattgtcctcataaaatttgtgcaaagcattaatcatttcattattcttccaccccagcttctccataaatttgatgtttgctcttgcctcaattttaggggagttcatgttgctaataggggcacctttcaaactggtatcttatccttcttcatgcttcaaactagatcctgcccagacatgttataacaagttaatacaagttattttggtacaaaaaaaatgaaatctatgcatagttttttcataacacacattttctatgaactttttgaagactctcttgtacatggcatatccacctttagttactgaataaataaataaaagatgctcttgcttaaattgttcatgtgtgctagaactttatcccgagcccttcattctcatgttttgcactttcctgtggtgattttacataaacccatgagtttgttaatatctgttaaattgatgacagccaaacctatggctccagcagagattctactcctgagtgtctgacctctatatccaagcacattttatgcttgactacttaaactacttgagtgatcctagagatcttaatttccacatattccaaactaatcatatcatcctttgcccaaaacctggcatttctgcagatgtaccaccacccgtatcattcaaccagttcagacatctggggtcaccagatgtttccctcatactcaggacttatctggccaccaaatctggagatacctgtctcctaaacttttctcatatccttcaccttatctccaattcttctgctcacctacattacagtaagacctaatctgtctctatccctagattcttgactccattcaaatgagtacccctctgccattaagtagttttataaatccttaaatagcttgccctagctttcagcctaagatcaataataatggtgattgccatttttgtgcctattatatgtgaaacactattctagacacttgacatacatatatttgcattagctctcatctgatatcagtctggtaagatagatattaccctaattttataaatgaagaaactgaatgtcagaaagcttagatgatttactcaagactactgagccagttcatgatggagctagggttcaatcctaggatgatggtctggatgcaaaaccttctgttccactggacctgttgctgaattgaaacttgtaagatcaggacacaaaggctgttgatgatctggaatgctcagatgctgatcttccctagcatgggcagttgcttcagtaataccaaagtattaccttctctttcttctctcttttttaacctcatacatatgtacccttttaaaaaattcatggaagaatacattcaggttgttaaaaaattcaaataaagtgaaagtaattagaataaattatacatcctccacacagccccaatctcctcccaagagagctaatcactttcagacactgatgttgactgaattcatttaatctaaagacttagatctcttctcctctatgaagtttctttctgtctatcatttctctttattccctctgttctctgcctctgaaacttctacccagcattctttgtgccacagactgctcgagacactgagcacagcctatataactatatttaaaattgtataaaattagatgcacaggattacaaaggaaaccaattttattaaaatgcagttatctaaatattaaaaagtataatataggaatacaattatgaatgcatcaataacaaaatctagcaacgtatttgatagatatgttaattctgcactactgatgagcacagattgtattttgagatacttgcagcaataatactatcatgaaaatacctgtaatttttgctgatagcaaagtgacatgtactgctaatactactgtgatttttgcctacatccatatttgggggagttattaaattttagttagagtatattttaaaacatgtaatttcttttttctatccaaaggctccttgaaatctatccatggcctcattttagtattactgagcttttaggatttccactatcttcaatatttcttgtactttctctaatattttctagtcttttacactgtgttctaaggttaactttctatttagatattttactccaatggtaaagaaaatttattatattacattataatcattgttttctacctagccctgttataattttatgagtaaattacatataaatgcattcaatcactcaaagaaaagcttccaaaggaaagagaaattgaagtaaggttgatgtggatttcttgaaaggaataattaagaaacattttgcatattattaaaagcggttatcagataatcattctttctgcaaaattagataaacccagggatgatccaagaatccagagataataatcctatattaacctttgctgttactttatggttagtctagaaacaatgcagtggtctttcaatttggaaatgaaaatgttaacatgtaaggtagtatgaaaataccttcatgaaaagtatgaacaaataaaaaatatggtcaagaacttgtaaagttgtacttacatgttatatggtaaattttaagaggtgatttttccaaatagaaactaccacctaaagaatataaaaagaagaaagggggagggaaggagggagagacagacattatttttaaatgaataagctaaagaacatttataaaacaatcaaaattttttttgcagttggaataataggttttttatacacattcattatgttgtaaatgttttcctctccattaatttacattaatgtcatacaggactacaaaaaattagggttcagagttatagataacctataagccaatgcaaacagtcgatcaccagtgtttctgtaagaatgaggatggtttattatttacatccttttactttgcagtaactattcaagggagaaggcaaacagaaaatgcatcaaatctcagtattattgtctatgtttttctgttgccatcagctaatgctctcattctgattcatacccacccagcttctccactgaagtcaatgagaaacttcctttaaaggctgcagagtcacactcacaattgcctacagcagatgggtaaactaagtctgagccctgccccttctcccagtactggtcccctgaaggccaaggcctgagaaatgtttaaaaatacttgcattccctgacaacaagataaatttgtaatgtggattttttttatttctctgaacaaatcagaacatttgacaacactggacctgctttccagctatacaacaagcagcaggttcctgattttgccattttgccccatcaagttcaatggggcatgaactctccagcaggttcatcatatacattatacccagaatgaagtcctagcttttcagcgtagaattcaacaacgttcatgattctgcactcccctgcttttttttttattatttatttattttattattattatactttaagttttagggtacatgggcacattgtgcaggttagttacatacgtatacgtgtgccatgctggtgtgctgcacgcactaactcgtcatctagcattaggtatatctcccaatgctatccctcccccctccccccaccccacaacagtccccagtgtgtgatgttccctttcctgtgtccatgtgatctcactgttcaattcccacctatgagtgagaatatgtggtgtttggtttttttgttcttgcgatagtttactgagaatgatggtttccaatttcatccatgtccctacaaaggacatgaactcatcattttttatggctgcatagtattccatggtgtatatgtgccacattttcttaatctagtctatcattgttggacatttgggttggttccaagtctttgctattgtgaataatgccgcaataaacatacatctgcatgtatctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgtcgtttcctgactttttaatgattgccattctaactggtgtgagatggtatctccttgtggttttgatttgcatttctctgatggccagtgatggtgagcattttttcatgtgttttttggctgcataaatgtcttcttttgagaagtgtctgttcatgtcctttgcccacttgttgatggggttgtttgttttgttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcagttttgtcttttgttgtcattgcttttggtgttttagacatgaagtccttgcccatgcctatgtcctgaatggtaatgcctaggttttcttctagggtttttatggttttaggtctaacgttttaagtctttaatccatcttgaactgatttttgtataaggcgtaaggaagggatccagtttcagctttctacatatggctagccagttttcccagcaccatttattaaatagggaatcctttccccatttcttgtttttgtcaggtttgtcaaagatcagatagttgtagataggtggcgttatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctctgaagaaaggcattggtagcttgatggggatagcattgaatctgtaaattaccttgggcagtatggccattttcacgatattgattcttcctacccatgagcatggaatgttcttccatttgtatgtatcctcttttatttccgtgagcagcggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttgctgaagttgcttatcagcttaaggagattttgggctgagacgatggggttttctagatatacaatcatgtcatctgcaaacagggacaattggacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaagttgttgaattttgtcaaaggccttttctgcatctattgatataatcatgtggtttttgtctttggctctgtttatatgctggattacatttattgatttgcgtatattgaaccagccttgcatcccagggatgaagcccacttgaccatggtggataagctttttgatgtgctgctggattcggtttgccagtattttattgaggatttttgcatcaatgttcatcagggatatgggtctaaaattctcttttttggttctgtctctgccgggctttggtatcagaatgatgctggcctcataaaatgagttagggaggattccctctttttctatttattggaatagtttcagaaggaatggtaccagttcctccttgtacctctggtagaattcggctgtgaatccatctggtcctggactctttttggttggtaaggtattgattattgccacaatttcagatcctgttattggtgtattcagagattcaacttcttcctggcttagtcttgggagagtgtatgtgtcgaggaatttatccatttcttctagattttttagtttatttgcgtagaggtgtttatagtattctctgatggtagtttgtatttctgtgggatcggtggtgatatcccctttatcattttttattgcgtctatttgattcttttctctttttttctttattagtcttgctagtgctctatcaattttgttgatcctttcaaaaaaccagctcctggattcattaattttttgaagggtattttgtgtctctatttccttcagttctgctctgattttagttatttcttgccttctgctaccttttgaatttgtttcctcttgcttttctagttcttttaattgtgatgttagggtgtcaattttagatctttccggctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggaggaggttgttcagtttccatgtagatgagcgattttgagtgagattcttaatcctgagttctaatttgattgcactgtggtctgagaggtagtttgttataatttctgttcttttacatttgctgaggagtgctttacttccaagtatgtggtcaattttggaataggtgtggtgtggtgctgaaaaaaatgtatattctgttgatttggggtggagagttctgtagatgtctattaggtctgcttggtgcagagctgagttcaattcctcggtatccttgttgactttctgtctcgttgatctgtctaatgttgacagtggggtgttaaagtctcccactattaatgtgtgggagtctaagtctctttgtaggtcactcaggacttgctttatgaatctgggtgctcatgtattgggtgcatacatatttaggacagttagctcttcttgttgaattgatgcctttaccattatgtaatggccttctttgtctcttttgatctttgttggcttaaagtctgtttcatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatagtgttatgtgtgaatttgatcctgtcattatgatgttagctggttattttgcttgttagttgcagtttcttcctagtctcgatgggctttacattttggcatgattttgcagcagctggtaccggttgttcctttccatgtttagcgcttccttcaggagctcttttagggcaggcctggtggtgacaaaatctttcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctccaggataatatcctgcagagtgttttccaacttggttccattctccccatcactttcaggtacaccaatcagacgtagatttggtcttttcacatagtcccatatttcctggaggctttgctcgtttctttttattgttttttctctaaactttccttctcgcttcatttcatttatttcatcttccattgctgataccctttcttccagttgatcgcatcggctcctgaggcttctgcattcttcacgtagttctcgagccttggttttcaggtccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcgttctccgtccagctttgttccgttgctggtgaggagctgcattcctttggaggaggagaggcactctgctttttagagtttccagtttttctgttctgtcttttccccatctttgtggttttatctacttttggtctttggtatggtgatgtacagatgggtttttggtgtggatgtcctttctgtttgttagttttccttctaacacacaggaccctcagctgcaggtctgttggagtaccctgcagtgtgaggtgtcagtgtgcccctgctggagggtgcctcccagttaggctgctcgggggtcaggggtcagggacccacttgaggaggcagtccgcccattctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctcgctgccaccttgcagcttgatctcagactgctgtgctagcaatcaatgagactccgtggggtaggaccctctgagccaggtgcgggatataatctcgtggtgcgccgttttttaagcccgtcggaaaagcgcagtattcgggtgggagtgacccgattttccaggtgccgtccatcacccctttctttgattaggaaagggaactccctgaccccttgcgcttcccgagtgaggcaatgcctcgccctgcttcggctcatgcacggtgcacgcacccactgacctgcacccactgtctggcactccctagtgagatgaacccggtacctcagatggaaatgcagaaatcacccatcttctgcatcgctcaggctgggagctgtagaccagagctgttcctattcagccatcttggctcctccctccactcccctgctttttaagacatgctgcctgctctcctcaaacaatggtgacctccaggcctctatcttgtaggatccaacttggctttcatctttttaggaagcctcctgtaatatccctttcttcaatgtcgattgttcatgaaattccttagcatttagttgtggcctctcttatgacaccttatcgtgggtacattgagatttaattttattagtatttaacatttcataattgtgtgtgtatgccttcttttcatgcattacataatcttttcacaactagaccaagttctgatatctgttattaggagccaaacccagccctgtatttacttgctgtgggaacttgggcaaattattgatcccctctaatcttcactcagtcccaatatttgtaaaatgggaataatacctactcatgaagttattgtaaaacttaatgaaacactgcatgaaaagcattttgctcagtgtcagggatgcagtaagaactcagtaaaaatgtttgtgttataatttctctaccattgtcactctcttgagagctattaaatgacttatccctgatttcttcttacctataggccttttattgccctagaagtttgcacaactaactttccacaattcttcctggtaataatattaccgtgaaaatattcttccaatattttaagattccctcatcattatattactttaatttctgtgtaaagatcatatagaatacaaataaaatgagatcgttatttgctcttcaggtaccacattaataacaatttctacctaccatgtattgatcgcctattatgtggcaggcactgtgctagatatttatttttcttgccttgtcgctagtgttcaaaactccacaaggaaagtattttgacacgaattttatggctgagaaaactgaggtcccgagtagttaagtaaattatttgtttattctacatctgtgtggcagaactgggttcgaaatgagatctatatgtaaaggctatgcactttttgctaatttcctattgccttgtgtttattatctagttcactattgagccattcagatacaaattagccctagtaaacctttgtaatttctagaaatattgcaattgtatatgtttaatgtacaataaattcttcttaggctatcgctaataatatttctaataccccaatatggctttcttagaaaataaaggctacttgagggctgggtgcggtggctcacgcctgcagtcccagcactttgggaggccgaggagggcgatcacgaggtcagaagatcaaaaccatcctggctaacacggtgaaaccctgtctctactacaaatacaaaaaattagctgggcatggtggcaggcgcctgtagtcccagctactcgggaggctgaggcagaagaatgcggtgaactcgggaggcggagcatgcggtgagccgagatcgcgtcactgcactccagcctgggcgacagagtgagactcggtcttaaaaaaaaaagaaaaagaaaaaaagaaaagaaaggctacttgagaatgaccaagttattatattaagactttttccagatgcaagtaaaaattacgttacattgttttgtgttgtagcattaacaatgctcaatgttttgattaataagtgtctgatttgatatatcagttggatattacttgtgaaaacacgatctgtctcattgttggatattggtttttgatagatcagatttaatgtattacatggacatttatgaggttcttctacatacaatataattgatttaatacggatctggtttatggctggtgtatttaatttcaaaatatatctggcttaatacttaatgtatttgttttgatattcggcattttgatgcaatgttcaagtgtatgatttgataagaaatatattgctcatgggcatgaagaaaattgtaaaagaaaattatcagtagacagtgaacagatgtgtaattatgcagaaataatcacatttttagagcagaaatctaaagtgaaaatatgtttcaaaaagatgtgttagttttgtttaggtaaacattggattctcagcttcattcaattaaacaaacaataacaacaaacaataagcatataagacctcccaaagtcagctatttttttaacaaattgaaaattaatttactttgttgagtctttcctcatgtgatagtaactattttatatattttgataagctgttacttgaagtaaatatatttctacttgtagtttttatgtgtttctgttttgaaaatctacagctccgaaacatcatgatgaatgttttacagtcttctagttcacagggaaacagaatgcaagagacttaccagcttctcctaggatgcgttaggagtcagtatactttttagtttatgtatgagattgttttgcctgacttaccaatagaatgaattttaatgctctcctgctcatttgtgatttctctttcctaggagagaacttcctataattccctcagaaccatccctgtccctattgttcatcatccttatcagagcagtcactccagcgaatctccttatctcaaaacccagaagtcccaagacactcttcattgcctgtcctcttttgcctcccaaatttgttagcttgcaggttcagctgcttctttctacttcttttgaatccaaatatttctttctgcctcaacgaaaatccttgcctacatacctaccttacaaccaaatgttagtcacttagttcctgttatgttctattcccaagctgtgtttcacacttgaacttccatctactgaatttcattttttgctactctatatttgatacctctggatcaaatataaactgttgcattgaaagctttctgttagatagccctgacttaaaggattgcagccttattccttaataatatcaataggaaagactaaaaatatagacagtttgctgtgaacgaacaatggactatcatatactctatacattctctggtacaacatacatgacaactatccaagttagggatgtggaaacttaagctcgttgaagttaacacagtctaataagaggaatgtcagatttcacatttcacacccgggcggtctgactctagactctgtgttcttagatccaaatgatatcacttattgttatagcttccattccacataggcaatcttacaacttcataaaattattccatttcttccagctgctatccctccccccatagtccactgtctctttcttttcattctttatctctctttccctcgttcactcattccttctcatgcttcctttctcactcactctcttttaaagtttttttactgtgctaagcaccaatgaattttgcttcaaatcactgactctaagaggtttctaataggtttcttgctgacaaagagaataaatgttaacttttccctcttaggttgttgctctcgtttcttttcaaccaaatttattctgattaatcttacttatttttctaagatttaacccagttttaagaagatttccatatgagcaagttataatactatctatatttgcattttagtatgttttgtatttacagattttgtatctaccaaaatgcatcttcttgaaggagaatgcacctctagatgcaaactaaaactatcttttgcctctttctttatcctctttcatagctttctgtttctgtttctatgttttattcagacaaaataatgcaaatttgtgcatatctgtgtgcagagaagagattgaagcaagaattgtataaaatgtgccttcatattgagtatatactgtaattattttttatttataatttcttcaaggcatagaacaaaacccactctaatctgtcactaaataatgctgttaatgctaattttttctttttaagtttttcagtaattacatatataatctagactaagaaaatcatattctgaattaaacattgccacaaaattttacttccaactcgattctaggatatttaaaaccaggaaatgatactgtctcctttcacttctggtctgacaccgaatagagtgctggtgcacagtccatacccaacaaatgttgttggatggacttgaatgtgaatcacctgcagcactctgtttaatgattcagcatctattccactagagaatgcaaaagaagcagatctggagaagagaaaaattttatagcactgtcattagtggtcacttctaagcacaaggaaacttaaaagtgtttcacctacaatttagagtaagaccagcctcttcaggtgtacttcaggtaaatagattacaagtaaattgtaggcatttctttaagtgaaaaaagcttttagatgattacagaaagtctcacaaaaataattttatcatcattgaaactttctgtaattttctcctaagtaaatttcacttccaaatgtgtcatttcagtttgagataaaataatcctaaaactatggcttccatttgcttccatcaatctactggaaaacaatgtgattatatacacacagaaaaatgttatgttctgattccagtattggcttagtatcttataccaaactaaccctttcacaaaagcagccagaacctgaaagagatatgacccttgagagaagaaactgcacaaggaaagagtcgcagttacatggcttttcccctgagcacacttccaagtccacacacagatcaagacagctagcattcaagaataaagttgcagttttactggcttggagtgtcacaggatggagttagggttgctagacatctgaaaattaagagggaataccagaaagatgagaatcagaacaggaagagtcctaaaattggcattcatactgcccttaaattcttggataaccctgaactgtgtatgcacaggggagaaaccatgctggaaaaagcaacggctagaaggcccaagatttaagcgtaacttagctgccatataccacagcgtagacaaagtttggagttcaagccctgccaaattaaaagggctgagtaaactcatcaggtattccattaaaattccagaatgaatctgtaggattaaaactatgtctcagtacaaatacaagttccttaaacaaaaacacaaacttgatacattggattttacaaaaacaaaaaaaattctacttatcaaatattctattaagaaaattaaaaaggtaagccatacaatgggagaaaatatttaccacacatacatatctctgacaaagaccttgtatctcatatataaagaactaaaatcaataatgaaaagacaaatagtataataaaaaataaacaaaagattggaacagtggtttcataaaagaaaatatacaaattaccaataaactcaaaaatacttaattaacatcattagccaccaagaaaatataaattgaaaccacaatgatatacatttcacatccaccataatagctagaattagaaagactaatagcaccaaatattggcaaaaatgtggagtgactagaacttacatatattgatgatgtaaaatgcgtaaaaactactttggaaatctgtttagcagtttcctaccaaactaaaggcatatatagcctatgacttagcagttccaatctcaggtatttacctaaaagagaggaaaacttccatccataaaagactcatattggaagcaacccaaacgtccaacaatggggaaatggaaaagcatagtggtctactcagacctcaatactgcaagaaataataatgagctactgatacacaaaccagttggctgtatctgaaaagcattgtgctgttcaaaactagccagagtcagaagagtacatgccatttgatatcatttctatgaagctcaagagccagcaaaacaaatctgtcatggtgagagaaatcagagcaatagtgcccagagggtgaggaagagggcaaggaaaatttctggagtgatggaaatgttctgtatcttaactgaggcagtagattcacaggtatattttttaatgaaaattcattgaatttgagactcaaaatctgtgcttttcatgataagtaaatttgcatgctacaaatggttgtactgtgtgatttgaattggatttggattaaatatagcatgattatggtttggattggatggacagttggactggattaaatacagcataaccagatgataagaactgaaaatagagtatatgcctactcaaggaagttcctgactcacccctctcctatacatcatatcctacccaacataaatacatgggtgtcctggaacatgtcccattttcatgccttattcttcacttctattctttaggattatttccttttcctggggtttactcttttaataaattgggaactgctgcattcaatgaggggcattttaactaaggaatcctgataacaccaacagctgagttattcttgctagctagtaatttccaaaagttcagccatgaaaaagattagtaattgaatctatgcaagattaagccaaccaagacacaggtttcactgaagcttctaaaatattacttgtaaaatgtttactgggattagtcctgtttaatctctgaccaaaatttctattcttcctttgttcctctgtctttaaactttgataatgataatttttttcatcaagccactttatagaattttttccacattgatgagaaaaaatactgattctctggcttctttgaaagacattctatccttatttggagtaaccatgttattatgaataacactattatattacacctttattttctcattgctgggccaagaagttagtgagatactgaattgtgacaactgatcaccatatagtttctttttaatgaccttgtgtaatgtgtaatagactgtgaactatcatcaccttaaaatgtcatcatgttttcataacatgacaaagttataatgtaaaaatgctgaatttagtaattgaaaactgccatgctcagcgagtgatattgccaacaccaagtcctaatttaagagttagtttactcattttccacttcattttataagaaaatcttcccattttgcttttcagagaggattgtgttattatacgggcaattctttttcactattaagcaataatcaaatgctgagtttttccttaactcttatgtagttgctcttgcccaaggcaatcaatttagttaagtgttacctgtatagtcagtctaaaaaaagttgtctgccctaaagctgcttttgatgcatgagtgtaccttgttttatggggcttattgcactccacagagattgtgtgttcagtaaattaaaggtttgcagcagccctgcatcaagcaagtctattgatgccatttttcccaacagtgtctgtcacattttggtaatgatcacaaagtttctaactttttcattgttattatatctgctgaagtgatctgttaccagtgatatttgatactactattgcaattgttatgaggcactgtgaactgtacccacatgatggctaacttaatcagtaaatgtgtttgttctggctgcttcaccgactgacagtttactcatttctcttcctctgctcaggcctccctaatccctgagacatagcaattttgaaattaggccaattaataacctacaatggtctctaagtgttcaagtgaaaggaagagtcacatgtgaggaagacaggttgaaagccaagacaggctaaaagctaggcctcttctgtcagatgattagccaagttaaatgcaaaggaaaaattcttgaaggaaattaaatgtgctactccaatgaatgcatgaatgataagacagggaaacaggtggggtgcagtggctcacgcctgtaatcccagcactttgggaggccgaggcgggcaaatcacctgaggtcaggagttcgagaccagcctggccaacatggtgaaaccctgtctctactaaaaatataaaaattagccagacgtggtggcaggcgcctgtaatctcagctactcgggaggctgaggcaggataatcgcttgaactcaggaggcagaggttgcagttagccaagattgtgccattgcactccagcctaggggacaaaagcaagacttcatctcaaaaaaaaagaaaagaaaagaaaagaaaagaacgtgaaacagcctcattgctgatatggagaaagttgtagtggtgttgttagaagatcaaaccagctgcaacaacattcccttaagcaaaagcctaagccagagcaaggccctaacttttttcaattctattcacctctatgagaaacatgagaaagctgcagaagaaaatttagaagataagagcttggttcttgcggtttaaggaaagaagccgtctccataaaatgaaagtgcaaaatgaagcaacagatgctgatgcagacactgcggcaggtgatccagaagatctagtgaagatccattgatggaggtggctacactaaacaacagattttcaacgtagataaaacaggcttatattgaaagaaagttccatctaggactttcagagctagagagaagtcaatgcctggcttcagagcttcaaaggactgtctgactcttgttagggcctaatgcagctggtgatttgaagttgaagccagtgctcacttaccattctgaagatactatggaccttaaaaattatgctaaatctactctgcctgtgttctataaatgcaacaacaaagtctgaatggcaccacatctggttacagcatggttcactgaatattttaagcccactgttgagatctactgctcagaaaaaaaaaactttcaaaatatgactgcccattgacaatgcacctggtcactccagagctccgatggggatgtacaaggagatcaatgttttcatgcctgctaacacaagatccattctgcagcccatagatcaagaagtacttttgacttttaaatcttattatttgagaaatatattttataaggccatagctgccatgtaagtgatttttatgatgaatttggacaaagtaaattgaaaaccttctggaaagcattcacctttctagatgccagtaagaacattcactgttcatgggaggaagtcaaaatgtcaacattagtaggaatttggaggaagtccattccaacccccatagatgactttcacaggcttaacactttagtagaggaagtaactacaaatgtgatagaaacggtaagagaactgtaattagacataactgtaattagacatggagcctgacaacgtagctgaattgctgcaatcttgtgatgaaatttgaatgaataaggagtcacttcttatggaagagcaaaggaaatggtttcttgagatggaatctactcttggtgaagatgttataaacattgttaacataacaacaaaggatttagaatataacataaacttagttggtaaagcagcagcagggcttgagaggactgactccaattttgaaagttctactctgggtaaaatactgtctaaaagcatcacatgccacagagaaatcttttgtgaaagaaaaatttgatgaatgtggcaaatttaattgtcttatttttaaaaactgccacagacactccaagcttcagcagttaccaccctgatcagtcagtagccatcaacatggaagcaagaccctccaccagcaaaaagattacaacttgctaaaggctgagatgattgttagcagtttttagcaataaaatatttttaattcgggtatgtacattggcttttataaacatgatgccattgcacacttaatagacttcaatatagtgtaggcataacctttatatgtactgggaaaccaaaaagtcatgtgattcactttattgcaatatttgttttaatgctgtggtctggaactgaacctgcagtatctctgaggtatgcctataattgggaatagtaatgtatagatatgaaggagctaattgaaatgcaagcccatctatgattatatgccaaaaatgactgttcttgagtagttctggggggcaaaaatcatacttttccataggaacaaatatcttcaaatttgcaatgtccaatgtgataacccactagccccatgtgactaatttaaatttaaatgtgttaaaattaaataaaatttaaaaattcaattcctcaatcatattagccacatttcaagtgctcagtagccatatgtggcttgtgggtatatattggacagcatagacatagaacactgccaacatttcaaaacattctatgaaactgtgctgagtcatacctacactttttgaatcttttggtatctatgctacttaaaccacaatggtttaccttaataatggtaacttaaatacctttattctgatggaacactatgtatagtctatatatagtagaaatatcattgatctgtcacaacattccgttattacttggtccttattaccaatgtttgagaattggaatatagtaatagttgaatgaatagggagttcaaggtatggtggtcttgtgaccacgagaaagaaagaaagtgaataattcttcaacaaaaagtatttatcacttgcctactcctgataatattgggccttgtgctagacataggagaggtgatgatactagcatgaaaagcatgcagttccagcctaccagaagtttacagttacatggcatagaacaaagtcaaaagaggtaagtataatgcaatgtgctaaaatgctgctttaggagtaaatacaaggtgcgataggatcatataaggggacactaaccaaagcctggggtcctggagaatttttaggaataagtgacatctaagctgatcccagttatgaaaagattagtagaagttagagaggatggtagaaagtagaactgaggctggccatggtggctcacgcctgtaaccccagctctttgggaggcagaggtagctagatcactttgggtcaggagtttgagaccagcctggccaacatggtgataccccatctctactaaaaatacaaaaattagctgggcgtggtggcatgtgcctatagtcccagctacttgggaggctgaggctggagaatcacttttacccggaaaacagagactgcagtgagctgagatcacgcctctgcactccaacctgggcgacaaagagagagtctgactcaaaaaaaaatacaaataaaaaaatgtagaactgagaggggaaggtgaacaggaaaacactccaagcaaaagaaaatgaatatctaagaaccaagggcaagaaataatacagccatttagggaattttaagtatgagaaatgagaacaaatgctgttcatgaaggtgagcccaactagagataaaattgatttctgttataaaagtagaaatgtctcacttattttaggatttaggttgttttacaatataatttcaaaagcaaactttctccctagtattttttcagaatccatatgcacatacctattaacagtggttgggaaagggaaatatagatggacagatggcaagatctagcaattttatcataaattttatgtgtattgggtttcttccaatcttcttccattataattttatgtaaacatattattcagtttaaagttaaggtgtgtcaatggccctcctggcctgactaggaataaatcagttattagagcaaagcaactatgagcatgtaattatgaataccctaggacttatacactcataaatcataggactcaaaagctaactattattttactgtatatgttaatgatggtatttaaaaattctaaacataaaacaaaaatatttgggcttttattcagtattctttactgtatacctaaaaattatgaatttgactatgtataaattaggccttaataaacttgactttcaaaaaatcttattaaaaaacaaaaaccttcaattaggtatttacacacatgtaattttcataaatgcataaatgtaactacacttgtcttttagagcattatttttactgttctgcttggcttttccccattcttctcttttttcacacctccagccatatttttctaccttcaaatgataacaaatggaatacatagtattattccatatttttctctaagcatttttaataacgtactaacatgtttacacatatactcatgtatttatataagtcctggtcattgttggtttaaaaaataggattacattataaatactttctgtgtcttgctttttaatattctgcaaacacatcgtagaaatccttccatagcaccttgtatagctctagtagattcattttaatggttccataatgtttcctggcaggaacacatcatcattctatgactgatgaacattaccactatttccaatttgatgtcacaataaacaatgatgcactgagtattcttgtattttaatccgaaatttttatttctcttggatagattcctgggaatggaattgctggaccaaaagacatctatgtattttttaatttgaatagatgttgcttttgaaaaaggctataacattttcctgtttccactagcaatatgtgagagtacacttctccatacatctccaccagcaatagatattaagtattgccagacatttaatagatataaagcagtatgcccctcattttattttgtactcaccactaatgagtttgggtatttttcatatgctgttggacatatatatttgtactattttgcattgcctcttcagatgccatctatttttattttgcacacgctattcttttctagttaaatcattagagaagcatctgtataattttaaacattaactgtttgtcccccatgttccaattttttccaaatttgtcagtcttttcttggctttgtgaatggtgttttttctcatacaaagctacttttaaatgcttcatataaaccaaatgtctaactttacatatatatatatatacgtatataagtatatatatgcatatatatacacatatatgtatatatacacacacacatatatgtgtatatatatacgtctatgtgtatacatatatacacatatgtattctggatttaataagttggttaaaaattccttccttatatgtattacatatgctcccctggtttttcttatagggattttattattttattttaaactatttagtccaactgaaaattatttttttttctttttttttttttaattttttttttttattatactttaagttttagggtacatgtgcacattgtgcaggttagttacataggtatacatgtgccatgctggtgcgctgcacccactaacgtgtcatctagcattaggtatatctcccaatgctatccctcctccctcccccaaccccaccacagtccccagagtgtgatattccccttcctgtgtccatgtgatctcattgttaaattcccacctatgagtgagaatacgcagtgtttggttttttgttcttgcaatagtttactgagaatgatggtttccaatttcatccatgtccctacaaaggacatgaactcatcattttttatggctgcatagtattccatggtgtatatgtgccccattttcttaatctagtctatcattgttggacatttgggttggttccaagtctttgctattgtgaacagtgccgcaataaacatacgggtgcatgtgtctttatagcagcatgatttatagtcatttgggtatatacccagtaatgggatggctgggtcaaatggtatttctagttctagatccctgaggaatcgccacactgacttccacaatggttgaactagttgacagtcccaccaacagtgtcaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgcaaaaattttctcccatgttgtaggttgcctgttcactctgatggtagtttcttttgttgtgcagaagctctttagtttaattagatcccatttgtcaattttggcttttgttgccattgcttttggtgttttgggcatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagccaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctgttgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacttccggtagaatttggctgtgaatccatctggtcctggactcttttaggttggtaaactattgattattgccacaatttcagagcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaaggtttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgttgtgtctttgttctcattggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccccctggtgcagagctgagttcaattcctgggtatccttgttgactttctgtctcatggatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttgtctcttctgatctttgttggtttaaagtctgttttatcagagactaggattgcaacccctgcctttttttgttttccattggtttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatagtgttatgtgtgaatttgatcctgtcattatgatgttagctggttattttgcttgttagttgatgcagtttcttcctagtctcgatgggctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctccaggataatatcctgcagagtgttttccaacttggttccattctccacatcactttcaggtacaccaatcagacgtagatttggtcttttcacatactcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcaggtccatcagctcctttaaacacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggagctgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcttgctgggagaaccactgctctcttcaaagctgtcagacagggacacttaagtctgcagaggttactgctgtctttttgtttgtgtgtgccctgccccaagacgtggagcctacagaggcaggcaggcctccttgagctgtggtgggctccacccagttcgagcttccaggctgctttgtttacctaagcaagcctgggcaatggcgggcgcccctcccccagcctagttgccgccttgcagtttgatctcagactgctgtgctagcaatcagcgagattccgtgggcgtaggaccctctgagccaggtgtgggatatagtctcgtggtgcgccgttttttaagccggtctgaaaagcgcaatattcgggtgggagtgacccgattttccaggtgcgtccgtcacccctttctttgactgggaaagggaactccctgaccccttgcgcttcccaggtgaggcaatgcctcgccctgcttcagctcgcgcacggtgcgtgcacccactggcctgcgcccactgtctggcactccctagtgggatgaacctggtacctcagatggaaatgcagaaatcacccgtcttctgcgtcgctcacgctgggagctgtagaccggagctgttcctattcggccatcttggctcctcccccctgaaaattattatttagagtacaaaatgatttgattttattttcttcctgtcaattatgccaacaacattcattaaaaagtgaccagctttttagatagacaacccagaacacaaatgcatcagatcaaaacccataaaatatagtgtgtaataataattatatatgttttattactttaacataaaaacatgaaatagtcatttatttaaaattatatattattctgtattatttatttttattacaaaatgctatataaacaacaggacgagttaacagggtcaataagtagtaactgatagtagtactaattaaataatagatgtgacaaaagtataacaatattttaataaggttttttttctgtcctctgatacagcagttatttttaactctttgctgacaccgtgctggatatttacatttgtagtgtgtatttaagacatataagtgtgaaactttttaaaaggggaacataaatactacaggactaatttaacagatattaactgtattaaataacaacagcaataacatgttcttttctgtccccaaatatagtaggacaattttactctttcttctccgataatacttcaatgaattgcctgtaatttttggggcttccttttcttttattcagttgtagaactgaatatagtcaaacataaaatgcactttggtgtgcaatgctgctcttatcaagcctgcattacgttgattctggtgtcattccaatgtgatgacaccaagctaaatatactcttaacaagcatttgactataaaatgagagttcaattattagcaataatgtttttcaactcatagaaattagttccagctctccaaaaagatgtccatactctttgattctacaagctttcttttaaaggccaggcttttgtcaatcgtctttgcatctataaattcatcatataagctaaatatatctaaggtgtccaccatttttaaacactctgaagcactttggatgttattataagtgaaatctctcttaggaaaatgattttaaagcacaagagtaatttgaattttgtgaaattggtgctagattctaaagttacagttttagtaaagaaatagagaaagtctttatagtagcatgatttataatcctttgggtatatacccagcaatgggatcactgggtcaaatggtatttctagctctagatcctggagaaatcaacacactgtcttccacaatggttgaactaatttatactccaataaatatgtacaattattatgtgctaataataaaaggccttcaccccaaaaaaaaaaaaaaaggaaattgaggaagttctgtgtaacttggctaccttgttgtggtgacttactgttttattttttatttttattgtttcgtagtaaaaaagttttgaagtagttgtatttttttaatgtgtcattgtttcactctgagtttttgttacaatctacacataccatcaaacaacacaggtgcagtcagttcatccttttttatactcctatggtttttttcaaaaatcatcaagcaagtttggaaatatagtatataaatttttattttactgtattcttttctgcattgtcactcaatgtatttccaaattagagaaggacatttcttcttgtctcacactttgaaaatggttttatgatagtccaacattttagccattcatagtcatcttgtagtcatatgtctaaaggagctagttatctccttccatctctattaagtaaaaatcctcaagtttttctgcacattttgaggtaactgaaaagtgatcaaaaattttaattatgaaagctttaatatcacaggtaagcaatgttgtacacaagctgtgcagttcattttgcaggtaagatcttttaattttcttagataagaagtttatagactaaggccgggcacagtggctctcgcctataatttcagcacattgggaagccaaggcacgcagatcacttgaagccaggagctcgagacccgcctgtccaacattgcaaaaccctgtctctaccaaaaataatacaaaaattagaccagtgtgatggtgcacacctgtagtcccagctactcaggaggttgaggcaggaaaatggtttgaaccctggaggtggaggctgcagtggtctcagacgagctactgcattacagcctgggcaacagaatgagactctgttgcccaggctgtaataaatataaatatttatttttataaatatttataaaataaatattttattatatttataaaataaatataaaaaaaagtttatagactaaacaaaacttgcttaaatttacacttgcaatgtctatagaatatgcaggtagagggcaagtatctggacaaaatatcagtaaacttttgctttatgttttctgcagttttattaaaatattcataaaaatcagtgaggcgatcgagaccatcctggctaacatagtgaaaccccatctctactaaacaaaatacaaaaaattagccaggcgtggtggtgggcgcctgtagtcccagctactcgggaggctgaggcgagaatggcgtgaacccgggaggtggagcttgcgtgagctaagatcatgccactacactccagcctgggcgacagaatgagattccatctcaaaaaaaaaaaaaattcataaaaatcaagaagatgatttgaagctccatttttaaaataaaagtacctaaaagctagatgaatcagtttttgttgccattatttgacacaaaactttactgcagaaaacattcaagtaagatctgaaagaatcagctctatagagtaagaggccaacacgtctgttagcaaaattttgtccttttgttttcccacggcacattttatttgaaacctagtaatgaggaaaagtagcttcattccattttatagagctatcaggggaatggtacaataatgtatgtttcttgatgtggtatgcccaaactaactcatagccactgtttttaactgtgcattggtgtcttttgggagacacagaatcttttgattgatttagaagtattccctgtcttattccaaactatgagattcagtctgcatatgtgtttttacatcgttttcctccatcatacccaattgcaaatttcttttctgcagattgtgcagtagtttgtcttggttatttgcctccctgatccagttatttctgtccttccatctgtaataagataacattgtcatttagccttatttttcagcgatattcgggtcatgctggcattggtattataatcattctcatttttattatctgaactctcagaaaaaaaccagtatcgaaagttaaattaacattatcttggtatcgagatgataccaagaaaaccgttaatccacagacaaaggactgttaatactcatgaatacaatgtgcttaagtaacacacttaagcctcagcactcacagcagtgcaacaaggggtgattcattattgtgaacagcaaatcacagttgccaacatcagcagtcaggaggaaaaacagtgacagcaactgtgggaaacataatctatgccatatccatctgctacaaaaacagtgttgctttcagctattttttgagccgtggtatgggtttgatactaccccccctaaccttctgtacccattgccaaaaacctggatttgttgcctccctgaaagtttactcatgacatggggcttttgtgctatgactgggcattggaggcaaacctgggcaattgtcaccctagctcttcctattaagcttacatttatgagcatttccgtcaattcatctattcaatactttggttgagaaactggggctggattatttgttgtagcctcaaagatttttttggtctcacttgaatccagttaagtgctcttcttacttttctgttagaattgtaatcttccacactgctgtttccctggagtgtattctacttgttctaatttatttttccctttccgactgtggaactcactacatggattattctttttcttcgtcagctcatgaggattcaggtctagttgttgaagtagcctagggactggcagtcttgctaattgtagaaggtaaaatatcctctcttcctgtgggccagaacaaacaaggtgactccattcccctcctgagacacacagaagcagctaagggctctccagtcttctggtctgacccaaggcacaggactccaggatagggaggtctctgtccatccattcaactctttctggccagtttaaaggcaacagaacatgtatattaatggtaacaaatatctaaggaaggaagtccggaggacttgggagccacagatctctgtgaaccaagctttcctcaaacttagtttcttccttgccttccctgcaggttgcacttgttttcgcagacacacccagcctgaaggagagaatcaccagttcttttcccacatgctctacctagagccccaacctttctaaccttctgtcttccagagcccagcagccatttgtttcaagaaaaagttggcagcggagggtaaagaagctacattcagttttctattttcctagaatgcttttaaaaactttaaaaaatatatttagtattcctgataatctccaaaagaacaggcaagaaataagatttagaggtgggcataacacttcttttctaggttaaaaaattgatttttttaaaaaagttgatgtttattttaaatacattcatatattctttttgaaagtttgtgccctatgataactatgtcagagcacaaattaaaattttgacaaaataacagataaattatcataggccaacaattaaggtagcagtaaacaaaaccatatatattttaaagtcagtcttaagtacttaaacttgagtttgatcatgatttattgtgctgtataaattcagaagaattgatgaatgctgctaaattattaatttgcccaaagtgtgagaggctaccgcccagaaccatgtgttataaatattaaagccatcccatctttaggacttatgtgggcaatgaattataaggaccactgtaaatcaattctgggttaatcataactctttgcgcctgtgattcacaatcacattatcccccactgaccattagttaaaattggaaagaagtttgcagcttagtgggcaaggctagaatttatttccctcacattattctcaggccttttcatttttatttgatgaggaaaaatagattttcattattcaagctttattttaattttcaaaagctctgctttgtttcattcctaagaatcagaaatgcttagagagcaatggctacaaaatcaacaggcctcgagggtccagagtcatataaaccaaatattcattttttccaatgatcttgagaagtaagcaacctttttcttaaaagcccaatttttttttaccttaataccgtgatcatatagaactgaggaagctgcatgctttctgtggcccttgccgtaaactacatagcattatatttctttacgtaactgttgtttctcaaactccataggctataccttacaggcaaaggctattctatgtcacatgcttttgcattcctatggagaatctcccagaaatttatatttaatgtagtgcaaagagcataggaagatagccttgatctcacattccaaatctaccgcaaatcattggtatgacttagagcaagttacaattacctcacctgtgaattagatatcctatcagctgtctcacagtgttgtaaagaacaaataaatgtgtatgtaaatggcatttttagcagttgaaacatgtttggtaaatgttatctattatcataagaaataaatggaggacagagggaggattttctttagcaaaggaaattcctatctaacccttttggtttaatgtcacttttccataattgttcccactgaatgttttttaataagaaaggatcatcacttctgtgtctctgaagccatagattttggagtgagcttttaagaaatttactaaattaaagattcatgtgagaaagagtattgtcctcccgattcaaatcaaaattggtgagataacaggtagcgataagtctgtttgtggcatggacttctgtagttagtacaggaggctgctacctaatgaattaaaaagcaaagtgctttcagcatcagctcatgatggagatgtcagaacaggagcatacaggacacaagtaatctatatacaaatagaaatgtgtcataatccctaacatgttgaggaacataggtgcaggttttgaaaatgcactttcccattcttcactttacttggcaagaaatgcaaatattcaagaaaataacattgaatatttacagttcttcacctgacaaatggaaaatttcaaaaaattttaggctagaggaatgtgcataaacgagaaatggtctccaaagcatatctatgttttcaattggttaggtactattgataaggaatttaaatatttggggttttcttatacagctatttcagttaccagaatatttgagacttgtcctgattccttccaacaaaaattaatttcccttttcttttacgactttaaacaaaatctgttcatatgatccttaccataatgtgattcgtgttacaacaattttgtacttgacttatctccactactgagttgtaagcagcttgatgatgggggcccaagtcttacctttatattccttatagacttaaccttcaggattttagagttaatgtgtaatgattgttagtaaaattgaatttaaacaacaactgttaaagaaaaatatagaaatgggaacaaaacctagctcctagtgttatctgggaagtgagaaatttatcacggggagtctattgatatctcaggcactattacgaggacacaggtgctgagcctcaatagttaccaatgtcaatcaataaccatagcatcctagcatctctactttggggtctggagattgaaaacactagaggtagatatcactttggattatttttcttcctcataatgagacctggaatatgctgacatgaagctcccagattcacttttgctttcttctgtttaacctagtatgaaggactctgctggtgtggaatccattagtaaataaatcaatggcatgtgattcagttgcctgtctaaacatggcctcaagaacagggctagttgaaaaattttaagaaaactccattacctagtcagatggattgaaaatttttaggccagtccttcaattattattctgttgaaaggtgacttcagactttgttgatgagtattttatagagttttcatttgatggttaaagaccattcaaaaggcagtgattatatgttttaattgatgaaaaaggccagggccatttttaaaagctaaaatagtttgggttactatgcaacctttcattgccattgctacaggctataatcacactgttttaatgattctctttttaaaaatccattcataattctttggaacattagtattgcaagagacagcatatataatggcaaggataatgttactatacatttaagtagagctctacagttcacaaagcattgacaacaatgctagaaaacttttctaacagcaaagcaatatgtcgcctactggggaggtcccttgaggtttgtaaagaagctgccaggggatccaggaggccagactaacagtttaaaacagaagataatcacaaaaatcaaagtaggttgttagaggaagcttcaaggtcactgctactcccaatcactgtaaatttagacctagggagctataagcaggtctgcaagttggttgcaaagatcagagaaaagaaggaaactatgggataactctgtgggtgagaaatcaatgcagacgaaacctaaccaagtgtttttccttctctcacactaacactccaagcatctcctagttttataattatatcaagccccacgtatataaaattgtttccgatgatattactcatttttttatcatcagcatcattagtaataaaaaagtggtgtgcataagctgtcaggattgttaaaatgcatactcccaggccttaaacatcaaacatcatcatgcagtaactttgggattagatctagaatctacatttctaacacaaaaatcccctagtaattctaatggtggtagtcttcgcatcacattgtgagaaacactgaccgatagcacctaaactagggtctagggtaccacagacactccatgagtaatacttgaattaaatgctttctttagggaaaaaacttttgtctgtttcaatacctcatggtttggttggggttcacctcaacaaaagacagtaagtatccactgagcacagttaactggactgaaggttttaggccattcattgtttcatacaaaactttttattgggtatccaatattggtgggatctaagcaaatttattaaaaggcaacaattaaatatttcttctatatttgcttcctttacctttatgttttgatattccattcttttttcagtaccaaaaaaagtctcgcatgttcttctagtttttcttttcttaaaacttggtctttaaaaaattatatttaatttattccactacggaaatttattttgtgtgatgtgacatagtgctctaatattgacatttttgcaataatcacctgtctcacgttttttgaatatttcatatttgccacactgatttgatttatcgactttctaatacagtcttttttttaaagagaggtaaaagttttatgatggcagatgattcttttttttattattattatactttaagttctgggatacatgtgcagaacctgtgcaggtttgttacacaggtatacacatgccatggtggtttgctgcaccaatcaacctgtcacctacattaggtatttctcctaatgctatctctcccctagccccctgaccccccaacaggccctggtgtgtgatgttcccctttctgtgtccatgtgttctcattgttcatgtggtgtttggttttctgttcctgtgttagtttgctgagaatgatggtttccagcttcatccatgtccctgcaaaggacacgaactgccagcaattccattactgggtatatacccaagggattataaaccattctactgtaaagacacatgcacctgtatgtttattgcagcactattcacaatagcaaagacttggaaccaacccaaatgtccaacaatgatagactggataaagaaaatgtggcacatatacactatggaatactatgcagtctaatacagtctttatataacatttatatacttttaaaaacagtaaacttttgttctgttccactgattttctattcttaaatacattttgtactgttttatttttaagctttataacatgtctcattacttggtattctaagtctctgataattattaattttttaattttcaaaatttcattactattcttgtctgttttctcctaattaaatttgcaaaggtcttaagaggttctaaaataaccttcaggcattttatttagaattacattttgtattggagaatctgaggaaaatttaaatgtcttttgtaattatgcatctgcattcttaggaatatgttatgtctatacagaaacttgttcaagttgtcttcagtcaggtgttaaggtattcttcatatagctcctactaatttattgttaaatttctctctatgtatttatatttaatgtacatagatatttttactcaaactatcatctcattaatatattaatagaaaagcaaatcatttgtatatatccatttatgatcaatctatttttttaatctgaatttttaaaatactttttcacttgattctggtgggcttcttgaatatatcatcaaataatgataattttgtctctactggatgataattttttcctaatagattgcaatcatagttttgtttccatccttttttgcataggataaagttgttacaataatgttaattttggattactagcaagcataattttctttactttaatggcaatgcaaagagagtttaagcttgtaataggcttgctgttgtttgaagtattctgtatctcattacggattttttttcttcctggtttaccaatagatagataacaggtagacaactgtttataattttgccaagtatctttcttgtgtctattgaaagatcatttaaaaattttataaagcctcatttgtaagatatgttgtcaccccagtaacatttctaatactgaaccaatgttgcttttccttgtttaataatgttacattattcttttaatataagcaaactaaccttggagtttaactattacttctatttattttatgaatttcttaagtccatttttatatgtgaaaaagttgaaaatataccttattgagatgtttaggatagtaggttgggcttttattgggtaaatttgtgacttagtgtatgagtgattactgaggggaaaaaaaataatcactaaagacattgtaagtgaaccagagtaaagttgtgttccttaagtgatgatagaggaggttgtggaatcgttttattttcctcattgcaatgcccaccagggagttttcttctaagttcagctgcaagatatccataggccacatgtgacaatagattaatttagaaggacacaggacaggagatatagctcatcagcagggcagcattgtcattttttcttcaatgtgagttgtacttgcagctttcatttagaatagggatcacatgcaagatgatacctatactgagtgagtacagaagcccacctggcttagaagcctagtaacccaaggcgtcagtagctcttgtcataaccccaaaggcatagctttcagggtccccagaaggggcagtcccagtcacatgaatcactgaactggtagaagcacaaagacatggcttcctttcatgcattttttgttctctcaatccaaatgacattttccactcaggggtcattttactataagcaacgtggcctaaaagtatagtaaacattcgacctttcccatgttttcagaacagagatataaattaaccaaagtacaaattctcattcagaataaaagcttacttagaaatacagtctgccctccatatctgcaggttctgcatgtgcagattcaaccagccatgaactgaaaatatttttaaaacacaatagagagtaataatataataaaaatacaaatgaaaaacaatacagtgggccgggcgcggtggctcacgcctgtaatctcagcactttgggaggccgaggcgggcggattacgaggtcaggagattgagaccatcctggctaacacggtgaaaccccagctctactaaaaatacaaaaaattagcggggcgcggtggtgggcgcctgtagtcccagctactcgggaggttgaggcaggagaatggcgtgaacccgggaggtggagcttgcagtgagcggagatcgcgccactgcactccagcctgggcgacagagcaagactccgtctcagaaaaaacaaaacaaaacaaaacaaaaataaagcgcaacaactgtttacatagcatatgtacattgtattaggtatcataagtaatctagacatgatttaagtatactggaggatgtgtagagattatatgcaaatactatgacattttatataaggacttgagcatccctggattttggtatccacaggggttctgaaatcaatccccaacagatactgaaggatgattatatgttctattatttttagcataattaaatatataccaatgtaatgtttttcatcctgtctatgtaaattaaaattccaactttaaaccctatttcttcttttgttcttcattttttcacaggtaaaatatggaaattatgctttcgtatgggatgcagctgtattggaatatgtggctatcaatgacccagattgttccttttacaccattggaaatactgttgctgatcggggatatggaattgcattacaacatggcagtccttaccgagatgttttttcacaaaggtaagatttgtgtatgaccaaataaggggagagatgaaatttagacaaagaatatccatttggttaccagatctggtttattacattttgtttcctttgttaggagaagcacaataaacaacaacaacaaaaaagatagttataagtagttgttcaataagacactcattacctaaaacatgaagtattgttttttccataagtagcgggaaaaataatgctacatataactggttttactctcaaaaaattgacatggaaaagaaagtaggtgtgttagtaatttctattagaattaaactagtagtctagtctgaatttttagcaacaaatgtcacagagttaagaaaatgaattcattctgaggatacaaaagcataacataaacttcaggaccaagttaaagctctgatggactgaagcagataatgacagggatgtttccacctgaatttttcaaaggaaatggttaagattttggagttccccgcttaacatcaaagtatatgtgagattttgtcatggaaatcaaggagataacttattgagacattatatccattttcaaatcagaatttctatgatgaaggagttgtttacaatggaagatttttaaatatatattttagattaacaatgcatatgaaagacttgggcctcaaaggagtgcacaaagattactgcatttcattatatctcctaccaaacaagcttggacctaagacagattaatatcttccacatagaagtatatccattttatactgaaagtacattttgtttattttctagattttcttctacctattctctagaatctaatgacagtccaagaggacagttccagatagtactaaggccctaaatttcaaacaacttgagttatatttctccaaattttaggataacaaaaaatccaggcattttgtgtgtatgtttttttttaaaagaactaaaaatcagtagttcacaatttgtgtcataactcttccattagcaaaccataaaaatctaaacctctctcatgacatgcaaaatgaagttagattaattctaaggtcctgtactagtcagcttttctgtgtagcaaacaactctaaagtataagtgatttagaaaagttacttctcattcatgaaacaaggctgtaatttggttgtgttatgcttcaagctgtgggtcaactgcagtcctactctgtgcaagcttctcattccaaggcccaggctgaagaagccgacctaacagggacatgctgttctcattgcaaagagcatttgtaaaagaggctggcagaaacctgcagtgcctcctgtgtttcttgcttggatgtggcatatgttccatctgcccacagatcacaaaccaaagcaagtctcatggccaagcccaaaatcaatagagtgggtaaatgtaccccacatatagggaaggaaggagtaaaggattatgaataggctggacgcagtggttcacacgtgtaacctcagcactttgggaggccaaggcaggtggatcacttgaggccaggagtttgagaccagcctggccaacatggagaaaccccatctctactaaaaatacaaaaattatccaggtgtggtggtgcatgcctgtaatctcagctacttgggaggctgaggcatgagaatcgcttgagcttgggaggtggaggttatagtgagccaaaagtgaaatacatatgcattaactgggaagcaaaatactaaataataatcaatcaaaatacatttattgacgagcaaattctaagaggaacaaactacaaaaatcaattatgccatagggaatccgtctgtaaagcacttggcatctagttggagatataagacccatgcacaagaaacaaagaacaatatagacatttctataaatgtgtgttgatatatatgtatataatatcagtattatttatttatattattttaaattgtgtagttaaggtactgaaataattgaacagcatacagagtagttaagcaaaggaaaatgagtgaaagctctccagagaaggtaagcctggaacttgaccttgatggggcaaggggaaatacggagaaggaacaaatagaagagacccttctaagggaagaaacacaccactgcttttaatttagttgtgaggatggaaaagcataatagaatgaaaagggatccagggtttcatggtaaaagaccagcagaaatgtttaatgcatgcttaacattacagagctagttgagaaaaggattattgattattgattagttatggttaattggctttttcattgctaaagatgttcttgcttttcagacttgattttctggctttttttttttttttgagacattgtttcgctcttgtcacccaggctgcagtgcagtggtgcgatctcggctcactgcaacctccccatcccgggttcaagtgattctcctgcctcagcctcccaagtagctgggattacacatgcacgccaccatacccagctaattttttgtatttttagtagaaatggggttttgccatattgggcaggctggtcttgaactcctgatatcaggtgatcctcccgcctcagcctcccaaagtgttgggattacaggcatgagccaccgcgcccagcgattttctggattttttatgtaaaaaataatgcatgaacgtaatagtaattaaagaaatgtttaataaatcacaccaagtgttgcatttcttattagccctgcagtgctttacctatcagagattttaattctcagaaaatgtactctagtgaactgctaaaaagtattattaagcattaagcattatttttcctttgtttgatatgcagtacagatgttggcagtttaaattgtttctttctgtggagtttcttggtaacgacaccctgcatcctgattccctggacatatggagaaaaggagagccaggaaagaagcaggacctggcgatcatcagtgtgccagctcctctctttatacacatgtgccacattaatttatcacccaaaacctctcgctaaattcagaaaatatttgcatttgttccatttttttatagccataaggaaaaagagatcttccctttctgttaactgattttaaaaattataaagatcatcaaatttaaccattttagtacactgtggtcagtatgttttatacatcagcatccggggccattgatattacatattactattgtgattattttcactgaaaatatagtatactaggtgatttttaataattcaatattacttttcaggtgactatatttctataacacaacttctaaaatattaagttactttaatatgtaataaatattagtatgtaaaataaaaaatatatagtgatacagtaactacatttattatctgctacctgccagacgtcttatatgtttatatatttcataggcactttagaacaatcatatgaggcattgcacatttgttcattatagcattgcttattagtgcatgactgctatgctacaagtacatacactgagtggatgagtctgcacctggacaagcatcaaattcaggttcggagacatgggttatatcaatacactcacatgtatgattgtatgtgagcgaacacacattggaatgacttcaaggaaccagtaagtgctagaatttatataaccatagaaatggctagaagagttttgcttccttttgtgtcctttctgcacataaactagataacttggcagcagaagttaaagtcagtctttttttttggtcatcagatgtgtgcgtgagtgtggtaagtaaggcttgcagtgaattctctacctgacacgatttgtcatcagatgttttatgtggttctcatcttgtaacttcttagtttaaaaacatttagtcatatgttgcctcattaaaggcattcaagaatgaagaaaactgaatttttcgggttgacttcattgtgcaataaataaagttaactccagtgttgacttcagaatcttaacaatgcagaaagctaaaaagataaccaaaaagtatgagctcaagtctattctcaaatcttaagtggatattgggaaaaattcattagtttaattttatagttcatccataaagaggtcacattttgcttattggcttctagaccctaaacttgggatatagaactacccaaagtcacaaaaacaattacgtgttccaagttgcatggagaataatttttcttagattcatgatagtgacacatatataaacagttgttcaaactaatcgcagaatttgagaatttttagaaatggaactaacagtagctatgccctttctgacagggatgaaagtagtccacaggaataaacaacttgcttagaatcacaaaaaaaagcaataaaattggaaaaaattcaaaatttctgatttcatatccagttttctggtcactgtacattctgtcttcccttatatttcttctaaaagcatataagaataatgtcaagcttatattcttatattgtccttactatatgctagactctcagctactacacataataacccgtgaggtaaatactgttgctgtcctaattgtacagatacagaaactgagacatcatgaagtaaagtaacttgtgcaagttcaggaagctgtcgattattagagctgagactcaaacccagagtctggctccaaaaactgggtctcttaaccattctgctatactgcgtttcacaaaaatgacacacacttttaacaagtgtgtttcaaataaacacttagggattctcttttttttttattattatactttaagttctagggtacatgtgcacaacgtgcaggtttgttacatatgtatacatgtgccatgttggtgtgctgcacccattaactcatcatttatattaggtatatctcctaatgctatccctccccactccccgaccctaggacaggacctggtgtgtgatgctccccttcccgtgtccaagtgttctcattgttcaattcccacctatgagtgagaacatgcggtgtttggttttttgtctttgcaatagtttgctgagaatgatggtttccaccttcatctatgtccctacaaaggacatgaactcatccttttttatggctgcatagtattccatggtgtgtatgtgccacatttccttaatccagtctatcattgttggacatttggcttggttccaagtctttgctattgtgaatagtgccacaataaatatacgtgtgcatgtgtctttatagcagcatgatttacaatcctttgggtatatacccagtaatgggattgctgggtcaaatggtatttctagttctagatccctgaggaatcgccacactgtcttccacaatgattgtactagtttacagtcccaccaacagtgtaaaagtgttcctatttctccacatcctctccagtacctgttgtttcctgactttttaatgatggccattctaactgctgtgagatggtatctcgttgtagttttgatttgcatttctctgatggccagtgatgatgagcattttttcatgtcccttttggctgcataaaagtcttcttttgagaagtgtctgttcatatccttcacccactttttgatgaggttgtttgttttttccttgtaagtttgtttgagttctttgtagattctggatattagccctttgtcagacgagtagattgcaaaaattttctcccattttgtaggttgcctgttcactctgatggtagtttcttttgctgtgcagaagctctttagtttaatgagatcccatttgtcagttttggcttttgttgccattgcttttggtgttttagatatgaagtccttgcccaggcctacgtcctgaatggtattgcctaggttttcttctagggtttttatggttttaggtctaacattgaagtctttgatccatcttgaatgaatttttgtataaggtgtaaggaagggatccagtttcagctttttccatatggctaaccagttttcccagcaccatttattaaatagggaatcctttccccatttcttgtttttgtcaggtttgtcaaagatcagctggttgtagatgtgtggtattatttctgagcgctctgttctgttccattggtctatatctctgttttggtaccagtaccatgctgttttggttactgtagacttgtagtatagtttgaagtcaggtagcgtgatgcctccagctttgttctttttgcttaatattgtcttggcaatgcgggctcttttttggttccatatgaactttcaagtcgttttttccaattctgtgaagaaagtcattggtagcttgatgcggatggcattgaatgtataaattaccttgggcagtatggccattttcacgatgttgattcttcctacccatgagcatggaatgttcttccatttgtttgtgtcctcttttattttgttgagcagtagtttgtagttctccttgaagaggtccttcacatcccttgtaagttggattcctaggtattttattctctttgaagcaattgtgaatgggagttcactcatgatttggctctctgtttgtcttttactggtgtataagatctctttctatctctctctctctacacatgcatgcatgcacacacatagacacacaaagagtagaacaaatcacaatccttggtacttcacaatactctcataatgggtccataaatagctacttttattcatttatttgattagttttatactccttagttgtagtcttttttcctataaactattagaatatttaatttaatattataactataagaatttttttcctattaagtattagaatatttagtgctttactttgtatttttacaagtaaaaatacaaattattcaaaaaattattcaaaaagagaacattagatctttttacctctctctatcttgatacttcttacactttacctcttgtttcctacctcctgttggaaagctcctgagctccttgagttcacacgtgtgtttgtacatctctagtgcccactttcttgtttagcatgcagtaagcattcaataattatttcatacatgaataaaagatctacttaactttttggctaaagatcagcccatttacttacagccagataaacctctgtgcattttgcttgcttgataatttctaaagtcttccttcttatcataattattttttctttcttggtttctataatttttcatccaaccaataaaaaagctaagaaaaaaaatctaagaagaaaaagaaaacaaacacagcacctgcctacccttctttccaactccctgctgtaataatttttatgctttttcccacaaggaaagtaaaaaacattcctttaacttgacagcataatcctaatcctttaataccccaattggaatggggtgctttccaagcattctgttcaccattcagcaaggggaaaaaagcagcccccattgattgcccacttagtagctccaggattggtcaacaaatggcttaagctctgtattcagctggttaaaagaatctctcagaaaggtacataaaaccagaagttaaacagttaactggcttccctttagagatgcaaaatataaactagccccaagctctgagagcagaagtgacattattgagacacatttgtaaacattaagcaatatcaaagtatacattaaactatatagtatagacaatacttgcaggaaaaattttaaggaaaacaaaatcagtgaaggttagaataaaaatggttactagacttgagcagggagaattcaaaaataaatcgaatttggatatgagagcaggtgcaggtaaaatactcaggaaaacatgagagattcacataaataaaaacggccatcatgtgttgaaaggatgatgagaaggaacaacttcactggaaataatattagttgagggatttaggtagagaaactaaaattgaatgtgatagactatcaacagctgctagttataaagcatctactacactaaacacttgatatgtttcatataatgcttgccacaactctgtgcattgcatttcataaatttgaggaaactgagcctcagacttaaatatcttgccaaattcacacaactaataacaaacagatctaggcctcaggttgaagctcgtgtccttatgcagcaccgttcaccagctttgtggggctctgagaagagaaatatctgtacagacgaggatttgaggagtctgaggtgttaggttagcttttaattgaagaaggccatttgcaagtattctagctgggaagcagtaagaatactacaaaagaattaggaaaagggattagaaaaaaagataagtttggagaaaggatagggagaacttggtgaaaaatcaaagaagtgcataaaatccaggaccctgaacaagaaaggctatgcagatttaaatggcaacaaacagccccctcttttctcctacttcttccagctgtcttacttctccttttcttggtcatctattacaagtttgcatcagctgtatttcatcatttttagaaaggcagtgattatttattttaattatgatcatttactacccggtaaataaataattatttctaagaaccatacaacctacagatttctattctgttgttgctcacatcacagtaacatattcctattggtattgttcttctctctcacaatacatcagacttttttttaatttatatatatgttttatttaattttatgtgtgtatatatataccactaacatcagctggtttcattgtatccacattttctgttccagatcaagaaaacaagataattaagatgggcagataattaagaaaggagaacatttgaagagtctcaaaataaaagcaagaaagaggacactgaaggttcactctcaaagggagacaggagtaggatgctataataatatatatattatatatatttatacatatatttttgctttaaaagaataacattttatgctataagatgtgaaaggaaattgttttcttttctcatataatacacatctatttagataaggactagcctctggaatccatacaaaggaatatgctattcctatttcagagcaacctcctctttaaaacatctgttttgaattgaggatttttaacttaaagaacttcaataaacaagaaaaatgagtaagcttttgtctatcattctttttctgtttcctgaatccttgtggagctacttttatgacggatatcctatgagttttagcaagcaccctgactgctacttctagtggagaatccaaataatttacatttattttagagtttagtctaaatagatgacagaataagtatagttagtgatatttccagtatgtgaatttttcaaaaatatttatgggctccatatgatttgagattagttttattagtcttgccaaactgtagccaaattttaaacaattataaacctttactctcaagaagcatatagcattctcactgctaagcacaaacctagacatcaaacagcaaccccatggggtagatttttaagtgatacaaatttccattcttcttgcactacatcatacagcattcagggaacactatattcaagatgcaacagtacccttaatgaacaagcatctttattagatttttctgagataagtcctgagctacagggaagataaatgactagtgcaaggtgcaaggcagtatttcagctggataataagcccatgatgctggaccaagctgcttttcaagcagcaagtctgattagcctttttacaaataagatttgtgctgtttctagatctcagtaaatattgtttattcagaaacccattggtttacaaaaagcatagttattttactgatataatctaggtgttactaaaggctttttaacaaaatattccagaacttaaaaccacaaatttacactgcacttgaaaatacacacacacacatgcgcacacatacacacgcacacacacatactctccagagtaattataagactctctccaaaactcttttattcccttatagttaaatcacatttttaacactcaaaacactcattctactcaacaaacataacgtcaagacactttttactgtttgaaaaattcagtctacttttaaaaggaaaatttgatgtcatcaaaaataatcaaagaacatgctactttttcataggtccttaaaatattgtaaacatagtgacatcatgggaataaacgtgtgggcttacataataattatgtctatagaggaaacaatcatagattttgagcactgagtgagcctttggcatgcatttagataactctctaatttttcaaatgtgaaaccaagaagggaagtggggtgccctgcccagagtataacccttggttaaaaccatgccctggagaccactagtccaggctcccagtccagtgtcccatcccctgccctgttctgccagttccttttgtttaaaaaagtcagtttttatccctaaaatttaccagtaaaatatatgttttcacaaacatagtcatgtcaatatattacataaaagagcaggaatattcattaggaaatactttcaacagggtcacaaacataactagaacatctgtttaaaaattgtcattacttcatagacacaagaaaatgtagcacaaagatgaatagagtgctttggaatgtgttctctaacttataaagaaactatgctgtagactaaaatagtagtcgacattcattgaaaactcaccaggtgccaagtatcactataaaggccctaactatgttaaataatttaattctcacaataagcttgtgaggtaaatattattagtagctttattttatagaagaggaaactaaatcacagaaatgatttgaaattttccaaaatcctaaaactgataagtgacaaagccaggctttgaacccatgctgtcaaagacaatactatcctggctcatattcccacaagtctaagaacatgcaccagtgctggaaaaggataataaggatctaaattgtcttcatgactgccgacatggctgtcttccttcatattaaaatgctgttgggcattttagtttaaatgaaatgcagaatattttcagaaacttaaatggtatgccaataacaaagggtcctccattacagggagggagagatccatctgaaattgaaactgtcttgcatcagctgaccagaagtaaatatattgaaaattgaaagctatgggacgatactgaaatattttcccttcctctcatcttcttttgctacaagttagtttaagactctacttaatcaaaactttaattcttccttcatggaagttttaattcatcattacattttaattggtggaattcgtaattgcctcttatctatcccatttcatagttctttgagcagctcaaataaactaacatcataattggtcagacagtctactcacatgttaaacgtttactaatatgaaacagaatctgatacttctagacatgaattattactaagataaaaatataagaatttttatatggaataagagtcattattctatatagcccaggtaagtctaacataagctctaacgatttctgtctttgtgaacgtagttctctgttttaataccaatttcaaatagagaaatatgtacctcaatgtgttcatttacttttttcataataatccattctgcttctgtcattttataaagctctttattttttaaatgttagtaactaatgaaaatgatcaaaatcaacatgtttttattttgtatgttgctgcctaagaaaacatatttaaaacttgcatcttttttttttttttttttaattatactctaagttttagggtacatgtgcacattgtgcaggttagttacatatgtatacatgtgccatgctggtgcgctgcacccactaatgtgtcatctagcattaggtatatctcccaatgctatcccacccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatatccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggttcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagcggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctgtccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggcatcagaatgatgctggcctcataaaatgagttagggaggattccctctttttctattgattggaatagtttcagaaggaatggtaccagttcctccatgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgatacccttccttccagttgatcgcatcggctcctgaggcttctgcattcttcacgtagttctcgagccttcgttttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttcaccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcttgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctagttgccgccttgcagtttgatctcagactgctgtgctagcaatccgcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccccactaaaacttgcatcttaatgatatttttaccaatgttccatgagcaatgtccatggcatgacagaaaggaactggcacgctaaaaaaaatcgtgagatttctactctgtaaggtttttaatctttatccaaaatagtggttttgatagtaaaatttttgttctgatgatttttctcaattttctgtgtattttccattaatgaaccaagatccctttagtactccctaaaaaaaccatcgtggcccttctagggagcctcttatattcttggtgctaatcagcatgaattttactagtattaatttcctcttttctgcatgtttttagcaagtgcagaaatttgccaaacaaattacttcttaaccagaatgtattcagtaaagtgactcaaaatcattcattaaggtagatgagaaaatagactgggtctcagaggctgtaaatatcagaccagcctgactcaatttaggacaaggggaatcattgaagggtttagtaaagcctagccataatcagaagcatgctttttgatcagtttgaaaaaaaaatatgcaatgaaatgaaaggaattgactagacgagagagtaccacataggaggccatgctgtatctataatgtctccaagaaggcagagatttgtgtctgttttattcagagacgtattccaaagtgcctggaagaaagcctaatacataatagctgtttgataaatattagctgagtgaaaaaattcatgaatgaatgacccaggcaaagtcaaaggcctgacctggagtgaaggcaaaagaaatgaaagggaaggaaaagatattgtgaacttagtgttgagcatcaaatggacacagaaatcaacggaaagaggggagcaaaatcattttgaaatctttagcctcaccggctgagagatcaagaagtcattaacaaaagagaagccagaagaggaaactggtttgagagtgaaagtgctaattttggtctaggtatgttgaacttggggcaccagaggatgatatacccatataaggaaatgtagggaatatgacaaagaaatgacaaagtagggtgggaatttgagagagaggctggagcgatggttattgacttgggcaaactctccattaaaacagtaaaagccaaagatagccaatggaaagggcatagagataaaaagaaaaaggttgaggcaaaaatgtgttttcaaatgtctcttttttgcattcctattctttccattccatggtcacaaacctaattaaatctcttagcacatcatgttgcctgtctcctggatacctgggtcatccctttctctccagactattcacatctaatacattttgtggacctcaccttatgaccagccttaccataaggcttctatagaaaattcagctctttattaaatttccatgttttatcttccctgtaccactgatgtcacatttttgttaattaatcatttcttgtgttcatacttgacatttcaaatatattctaaattcttagcttgcaaagaattacaaaatctatcttacacttcctttttcatcttccataataaagtaggtgttcaatgaatttttgttaataatatttgagggggaaagaagacaatcctatcatcactatgactactaaggcaagcagtttactagagattagaattcatgtttattcattcaatcagtaaatatttattgagcagttacttagtgcttgaaactctttgatttatctagagataaaacagtgaacaagactgacaagattattactttcctgaagcttacattttactagcaagtcagaggaagacacagacaataaataagaaaacaaaataaatgggataattttatattggaaaatttgccttaaagaaaatataactgggacagagaataaaggtagatcagcatgggggtgggacacagaagactatccaaaggagggaacattttattacaacctcaaatggaaattttggaggaagaatatccaatgcataagaagcaacagatataaaagccctgcattgggaaccagctgggagtgtttaaggaatgactaggaggccaatgttgactcaaagagagggaacaaacaaggcagtcatataaaaggagattaaagagttagttgggcccagatatacaatagaaccttgaaaaacatagtaaagacttaagagttttttctaatggcaaagacaagccattggaaatttttaaagaagcattttttacctctggctcttaaagtagagaaagatatatggtgagaaggagagagtgcagcagaggcagtgagcaagagtgaatgtagtaagagaagttaggaagccagtgcagtaatccaggagagagagggtgatgactcagtctagggtggtgtaattgagatgtgaaagtggcagctacaggtctctcatagctgtgaaactgataggactggaaactgtttggatgttatatgatgggtgaggtaaagagagaaatcaggataagcttattttctgaacaaataaatggatgatggtatcattaactgaactggtcaagcatgaacccaaagtaggttaacaaacaagggaaattaatacctcggctttgggtttagtaagcttgagatttttattagacagattaatctaagttataacagatgtataaatgtgaaattcaggagaaaacaaaataaataaaaattacaatttgaaaggtagaaggtacttatgaaagatttctgtgttagatgaaggactttgagcttgatgatgttagagattagtagttattaagggatgcttaaatgatctgagagatacactgaagtgggtgggaagagaatcgaagcagaaaaagataggcacctttttataaagttcctaaattctaggaatgagaatggcaaatgacttcattatacgcttttgactgtaagaaaggaaatctgaaatcaaatgttcctaagaaatttatctcacatagcgacatatttaatgatagaatgggctccatgattgctcaattcagaggttcaacaggacaatgttctcaagaaccgaagttcttttcacctctatactcatccatccatggtgagtgagacaaaactgtcctcaggcagacctgccttgtgacagaagtgtcctgtccacagggacagaggtaatatagttccttgttctcattcaggagaaatctcccctctcaaccagaaacagattaatataactctgtctcttcagctttattagttcatcttaggtcatatgtttacccaaatcagttcatcttcttaggtcacaggtttaccacggactgagcagatccacacaagaatatatactgatggcttagactgtgtacctaatgggatggaagaaatgttggaaggtatactatactataccatacctatactataacattccctacaactaatttaaagaattgacagataatagagaatataaggaacaaatgaaaaagaattaacacccacaataaaatagctatcatttattgcacatttattaagtgccagctacttttctaaagtttttacatgtactaactcctttagtccttataacaccccagaagagctgctattatcgtttcattttatagtcaaggacactgacacatagagtagctactcaagttatagttaataaatggctgagctaggatttgaatccagacaaatctgacttcagctgtcatgcccttaaccagtttgctctagttaaatgaaaatagaaagagggacgataccataaactcaactggaaaattataaacaggaacatgagaagggggattgtatgggaaggaagagtatgatattggtttagctatgttgaatttgtaatgacatcaagaagtctgaaaactgtggaacgtatgagacagaaggttgggtaagatggaggaaagaaatatggatttaggatttatcaataaaaagtaacatggggaaaaatcaagagaaactatgtgcagagaaaaaggaacaaagcccctaaggactgatattaaaggaaaaagaggaagaggctttagtaaagaaatgactagaaacatgccttataagtaatgacagcaaactatgaaatctgtacatcctcaagaccttgagcaatttctgtacaaagccattgttgaagggctatttcttaaatgagagaataaacagctgctatagaccgcttcggctcatcctgtgtttcctcactctaacacaatggttctccatttttagccaagcatcaggatcacctgaacggtctgttaaaacacatttctgggctccagccccagaggttctggtttcgcaggcatgtataatttttatttctaacaagttccaggtgatgctgtgctgctgatctagatctagtccacattttgagaaccactcttgtaatacatggtctttgacttctttgctcttattctctcccttgtatctttttcttgcttctttattctcttttttttaccatgttttttggatttcatatgcaaacacatacagttgctactactctacattattttatttaattcttgcaaaacatcactgagagaatgattattgtgcctgtcttatagattataaagcaaagcttagcacaaaggatagatactttagtactgaatcaataaacctaaattatacaacagactaacattctaatttctttttgaactaatattccccaattccacttatttcctttcttctacttgatcaaccatgatatcatcttcaacaaccaaaatcattttttaacggctattttgaccatatcacataatttttaaaatcgttctgtgcctgttgttccttttgcctgtatagaatccttcttattgatcaactcatttctctaacttggcctaatgtctcaaacagtgctttgcctataggaaatcaacaacatgatgttaactaatgcattgggtagcagtctttcagactttcacctaagccaatatcctacttggccactctccttatcccagtaaagtttcatttatttttttcttttattaacataataattatttgacaataaaaactttgccttttatagtcattaaagcttgtttggttttcatggagggtgaagaagaacttactaagaaaagtttttttcacttaaagaaggaaaacaagtctactatattcccaagtctatactccgagtattttctccctgcatcacaccataaagtctataggtctcttgataacttaaaatcacagaaccataaactcaaaactaagagtgatattttatcatctgtttcaaagccatctttatccaggtcactgtgaggaaatgaagtctccaagaggagagatgaatgggccagagtcattcaggtacagcctgacagagttagagttacagaaaatcccagatttccctattatcagtcttgtgtaattctttctgtcgcataactttataactccaaaatcctagtccatctccaaaacattatgatgttcagaatgtgactagctacataggttttgaatcaggcactatgaagataaaaaaaagaaaaacagaataaataaaaagaatcctacaagtttcctcccccagctcaccttgtatatgcctttccccaccaccacctccctgacccagccccccatctgcattccaaggcactagggtactcttggtgcctgcttctgtgagggccttgattcctaggctcacacttcctctggttaactcctgctcaatttcctatctcactttaaatagcctgtccctaaggtgaaatccagccacctttattgccaacttccaatgcctttccatagacagaaagcagccctaaggatatgttccaaaattcactggaaagtggggaaaaaaaataaggacaaaatcatcagatgttaactcaattacctcaattaaaagaactgtctttttttctgagattatatcctttttatatttggggaattatatgttattttatttatgaaaaagcatagatttttttttaaaatacctcaatgaaataaaagttgagcaacctctgtcaatccctccaactttttttcctgaaatttgaaagtcttggaatgcatattccttactcaaaattactgtgcaaagattcagtctagaaaaaggggcacaaaaataagaaatgtgcaaccaacttgctgtacaagaccctctgttttaattcctttttaaagcaacccagtgcttgtatagtggtgtgtgaaacataggagtttctaagcaaatgctttttagattccttacacttaaaaaaagtcctttgggatgttttatgcagaatgctacgtcctagtttaaatctaagaactcttttgaccttcagtgcatgtagaaaaatgtaaaaaataaatgagaaaattaacctgttcaaagaaaagctttaaaaaaattcttcaagcagagcttctccctgttatcattgattaaaataagaaggggaacaaactgaaaggtttaaaaggagttgtcccttaaaatattttatatacatactgcaaaaaaaaattcattctgaaaacaaaggcttctagactcagtttactgaatgcgaaatgatcagactcgtcttattcagatgtgaaggtgaccatttgaggtctcaaatagccattgtaaccaccctgcacaaaatcatttctctgaaaactggctacctctaggacacagattctgcatcacctcacaaaagatggtagtgaaatccctttaggaaatatttaaataatgagccaattcatattcccttcagagtttctcatatcttttgtcaacattgaaaatccatcttatccctcacagcaaacaaccacttcatgtgtttcctaggggttagactgttccatttcctttccaccaaagatgaccttgtgtacaggaccagttttgcaggcagcacaagagagttattctttcgataacataggatttaaaattcaggacagctaaatttcataggaagagctccaaaaggatgtggtcacttggtggagcatatactgtacacagctgataggcttcacaatgaaacacctggtaaagcgtatctttgaatccttaagcttccctttcttctgcatctttacactttggaaatccatgaagctgctgttaggcagagcatttaatggggatcttgcatcacctcaatattcccacttgtatgcctattttgatgcagtcacactacgagtctaatatgaaaaataacttttaaaaggcaatgaaaatgtaagtcaacctaaaaggaacatatatactgagactggtagattcagccatgcattatgcttaatatgttttaagttaacgtgaacttgtttgaaaagagatagaaaaatatatatacaaactagcagtgtttcatcccatttaacaagtatttgttaaccacctactaaatgccagacactatggtaggctgtggagctatagctttgaactatacacaaccccagcctccaaacctcttgctctctagaaggaaaggtgaacaagtgaatgagctattttctgtttggtgtgataggtgttttgggaccacagggaagcagtgtagacctcaggtgaaaattatcaggaaagcttcctagtggaattgatactggaaagattatttaaagaacaattgatgttggttaatgttatgggctaaattttgaagtcctaacctccagtacctcagaatgttactatatttgaatacagggtcttaaaatgtaattaaggtttaaaaaagtcactggggcatgccctatctaatatgacttgtgtctttataagaagaggttagaatacagacatgcacagagggaagaccacgtgaagacacaaggagaagacagccatctataaagtaagcaagatatctcgtaagaaatcaaccctgccagcaccttgatctcagacttcagcctccagaactgtgagaaaattaatacagtcatgtaccacataatgacgttttggtcgatgacagactgcataaaaaacaatggttccataagattataatactgcatttttctcgtaacttttctatgtttagacacacaaatacctatcattgtgttacaattgcccacagtattctgtatagtaacatgcagtacaggtttgaacccaggagcaataggctatatcatatagcctaggtgtgtagtaggctatacggtctaggtttgtgtaactacactccataatgttcataccatgacaaaaatcacctaaagatacatttttcagaacacatccttgtcgttaagcagcacatgactatgtctcttgttcaagccagccagtccatggtacttggttatggcagccctggcaaattaatacagtcgatgaatgacagtaaatgcagtaaatgctaaaaaaaaaaaaaaaaaaaaaaaaaaaatgaactggaacaaaagagacaccacttcgaatggagtattaatcaggaatattaatcaggaagtggcagcaaatgagcctgggaagatacacaaaggacatggggacttcttagcttcattgagaagggcctgagatgcctggccagagttcagactcaatcctgagcatgaagggatgccaccagaggtttttaagtgagattgaacataaaaagcttacattttataaaagtcactctggctgcagtgttgattattagttgtctgagagcaagactctttgaagctgggagaccagtcagaaatttaatctagatgagagatgataccaacctaaaatacagtgaaaatggggggaaaaagtttggaaacgtaaatttgagttataataaaggaacaatgtgagaacaaagttgttagaacaatctctgagtctcctccacgctgtcacatttccaccccagtgcttagtcttctcataatagccatatttgtaagagaaggcaaattccgtttttattagttaatatatttggcaacttctcctaaggcacctgccaactccagtgtatctcaggcttttactcttgaactctgaaacccgagaatgctaaattaattcacacttctaagaagaacatggattgaggcacattctataatacctatatttaaacacttcccagaagtgtgctattttgtatgtgtgaaaattgccaacacaacattcacaaaccctcttaacttgcatctccagccttgacgtccctgaagaagaataaactgccttctaaatgtagttagctaagagaaaagattaggaaaggaggagtagaggaaggagtggaaatggggggaaagaaaagagatttttaccacccactagtttgactgtttagtcaatctctttgtctcaacaacctacttttagtgcatgaaagatgtggttactctctgagatgagagtataatctctgctggaaagtatacatagtcagcgtgtctgattttcttaggagctctacctttggacaagcaggagttagcaagaagtatataaagtcagtgagtctcacacatgggaaaactttatttgccatctatgaaatgttcaaatattagaaggatttatttttattatccttttcttcaaagcactccattttaaatgtcagtaagcttttcaacaataaagatagatttcagcaaattgccagtcaaggtttttcttttatttcctgggtgtttcttaataagtggacttattgtagcccagatgtctgtctgtctagtggccagccttttcatatccacgatcattttctctctctcatcatatttcccaactacgctttactgcatttatcttcttaaaccatgtgtgactttctataccaggaaattttcaagggaacatcacttcattttgcttccaatagaagcccaggcacaaagagaaatgataaaactctggcccctgctttattcataaaacactttgcagagtgcatttagtaatttgccattgtaaccactggcactaagagctttcagggccgagttctgatgctgtatttagttcatactttgactgctcagctaaaacttccatttgtatgcatttattctgcttcacacattatgttgtcagtcacttgcaatatttcaaagtcacagcaggctttttctgacacatatttgtcagaatgaactgccttgattgctattattacagactatagtgcctgagtaaggggaaaaaaaacttatgtagtaccagaatattgaaactgcctaataaaacaatagatacaagagaataaaaatagaataaatgcatataaatggatgctttaaaaggccaacaaaatgtaggattacaaaatagacatatagaacccaaaaacccattcataaaaaggattggaattttttgaaaatgataaggagccgaatgagaaaattccactgccccagtgtcagtgagtaagtgagtatcacatacttcctttccagtaaccagggatttaagtagactctgctaatggatgctgtcattgagagaaattttagcatgaaatctcctactgaacaacaataaaaacacatgctttgaccaaaaataataaaaactatgaggaactaattagaaatccagatcctttatcattcttgataaactactgagcatgtaatctgaaaagacctgtgccccatttggctgctcttttctctaccttttgatcttacccatacttcagaactgaacaccatataagtaccatagaaatccacttgggaatcagggaatttctctgccgatagggatggcccttccttaggattcctcaaatttcaagacttgcataaagcataagataagaaaattaaataagacataataattagttttcaaacctcttatcaaaagtaaattataaaatacaaaaatctaaaacatttttattaatgccacagatcagtagaacagaaaaatctaagctgtgttgctcttgtctttggggcaattatataactttatgaatttgcttcacttcatatgtttctccacatattttcctaaagtaatattcaagaaattatgctggacatgaaaaatctctaacagatccactgtttggaaaatcatttctttttttaaaaaaagaaagttatgatgaagagtaattatcaaaactggaagaaattataaagtaagaaaattgtaaaagccgaaagataggtcatctacttgcttactctatttctagaaataagatttaattctttctaaagatgttgtgtttaatctgaatgttattaagaccccaaattaaggatgactcttttatttctgtttgaatctttataacaaaatattaaaattacttttggaaagctttaggaagtttaaattgttctaaatccctcattgtctcacctactcattgtcttggaacttcttacaaatattaatggctttttgatgcatattgattctttatgtaccatatgactaatagcataactctagatgtacactcagaaaagtcattacagtgatatatacaccaatgggattcagaaagcatttttttaatttaaaaaataccttcattagcatagttttcaaatttgtaaacaagttttatattaaaagcaataccttgttgaatattaaaatgctgagatacttaaaagaactcaaaagttatgcaatatatatcataaaaacattatatatatataaatgtatcttcagtacatcaaggcaagtttaaaacattaacaattttattaaaatatccattttatttgataataataaaaataattgattctaggagtcaattattttttctgagaaaaaaataattgtttactggagtcagtagtcattctactaaattgtttctatttaatgtattagaacagataaatgtattttgtctaagtgggaactatttaaatattaaataaatattttcaaccttaattgtattccacagtctatgggggcattgagaataataagtaccataaagtgtaaagattgggggacaagaaaagctctaaaatatattaggtaatttgtttgtattaattaacctatttgctatttttgaaaaattattgtcagcttagatctactacagatgattatgtctgttactaaataaagtaaatttagcctattcatcaacatgtaaatacctatatcaaataagacaaataggccgagcgcggtggctcacgtctgtaatcccagcactttgggaggctgaggcagacggatcacgaggtcagcagatcgagaccatcctggctaacacggtgaaaccccgtctctactaaaaatacaaaaaattagccaggcatggtggcgggcacctgtagtcccagctactcgggaggctgaggcaggagaatgccgtgaacccgggaggcagagcttgccgtgagccgagattgcgccactgcacttcagcctgggtgacagagcgagactctgcctcaaaaaaaaaaaaaaaaaaaaaaaaaaaacaaataattccagctgtcatttcaattgaattttccataagaggttcaattttttcttgagactttttaacagtatccacaatttcagacaagctcacatgagtttgttttttcaggtagttttaacagtgtgataagatggtttactgccctagagggaaaaggtgtcaatgtgttatcagttggtatgttctgggcctttggtatatatagaaagtctggcattttagtaactctacctaggataatatacattgataacatctatttaagaataagaaattcattagctagccctaccttcagatgatattttattcatatttttatttcttttcacacagtatttctttataaatctctgcttctacttcttaagtatttgtatattggtagaaactcactttatcttaataattataatactttaatgtatttagaatattgtatatcatatgtaatacttaggatactgtacatattttaacaaataaggagtgaatactgaaattaaactgtagattgactaaatgaaccactgttatagagcttcggagatacagaggagctcccaccaaatcctaaaatttttctctactttaaatactctatcatggaactattcgatttgatgggacataaatctttttatcgtaatgtcatcctggataaaaacatgcacacatgcacacacataaaaacaagcaaacaaaaaaccaagtaatactacactctttgattcatacctgtgcaccaaaggctcaagcgtagatgtaggaggaaaaaaaaaacaaaaaactgatccctctacttccagtcacttctgccccaacttcaaagaactcaaactcaaaccactagttctatttgttcgtttgttttctgtggctgagttcttactcaaaatgttctacttaagcctctccttgggggactgtctccaagctacattgaggacagagtctatagctagattgcctaaggtacaaatttcttgtagaacccaatacagctgccaatttgcttttgagggcaatcaagatgttcattagtaattgagttgaaacagagaggaacttcatttgtactgagtcagtgacctggatcgttttcagaatgagtgttgagctgaaatggaccattcatttctacttccattgggatcctgttcaaaaaggttattgctcttaccttcttccaacaacagtgataggaattttcagaagcaaaaaacaaggttttatgtttgccacttgtatcttagggcaacatttataataatgggatttttaatcaatcttagagcataaaataaaccctatcattttagactgacctgttggactaatttcaatgactttagctggtaggtaattgaaataggatgacagtacactggggtgaataagaggtttcaaaaatagacaaagataacaattagacatatttggagcatcaacagaagttagtataaaattacaggaattttagaaattaataaagaggtcttatttatttaatattgaaataataccatttaaataattttaacagcaaaggtcaatataaggcatgctatcaccaagcactattctaagagctttatatacctcttgttacttgcaactaccgtgttttacaaataaaaaaaactggagattacagaggttaagtgacttaagtagcttacccaagatcacaagagcagtatataatggagttggtattcaaacccttatagtctggctccagagtccatgctctcatcccctctactattaccagtctcaatgactggcaaaataagccatcagcattatattgccttcagattctgagtagttctctagagaatgaatgagtcataagggatgaggatgcttggctgaatagttttgcccccattattagagggtaagagcaattttagaatttcatagtgttcaatctccagcgaatagtttttatatagggaaactgaacgaagcaactgaaaaaactatttttactcaaaatttgtgcaagaacttgagagcacatgttaacaaacctttgtaatcagttagcagagcatggctcagaggataagtttttctccacacttctggggagactccagggccctggagcaagcatttgaacggaggccttaatggacttaagggcagagccagcccagtagcagcagcagccctgtcaccaggaagacagtctagcgtagcaatttagcagcagtggcagcaacagctaagttaaggaggcatgtttaccaggcttccaagttttgaaaggtcttagaatcaggcaaaaaaaaaaagtgccaaaaactggaagtaaaagggccatatgacatcccaaagtccagaagtgcatgtaaaatgtgcacaggtgattcccagaattaattgaaaggaaatttacagaggctggaggtctcacacttatgggtgcatatggaccagatgaatactgcttgtttataaagttgtcgtcacacctggctccattgtgggtataggctgagagacacagattatatattcaccaacgaattactagtattctttcccatacatcttttggttatgttcatcatattatatttaacttaaaaaaatgtgttaaaattcaatttgacaaataaaaagttctgaaattaaaagagaaaattttaatttgatagatgtcaggtcttaagaagggatgatgaatggaagattatattcccttttttagattttttagattttgcattctgccataaatttccctgcagtgaatgattggcagactagaataagacatcaggaagaagagatataatgaaagtttaataggcagattgcagacccaaacatagctgagtcatcagtgggaatttccattggtttctcagtctcttttaaatattaaattaagcttcactgttaagaggactcagtactgaagatgggagacctagttcttaaagcgaaaatctcatcaagatataagatctgacccttttgtattatatcattttcaattaaggttttaatgccctcttttcataatggaatctctaatttactttaaaaaattgctttcacatgactcattattttacatgaataccagcattggtatgataatagtgtcaaaaataaagcactattcgtgattttttttttctgatgcagggttggaggcttttctaaaaaaaaaatttttatagaagaagacttaaataattacagttgaatttaagaacattatccatatgaattatttctaacaaagaatatccgcatgtgaaaagtggcgggtatcctgtatttctagctacatttactcagtgttttaatgtcagttaaaatgctatcccagtcaaaacagctcctatacatgtaaaattatggttatttctcaaattataccattttaaagtgaaaccacattgaaatgatattattttgatatgccagcagatacatgtagtcacccaaagaagttttatattacaggtgcttgaagtcagaaaaaggagccttttttataatttcataatgagaaaaaaaggaagtcagagaggtacgatttaattcaaatatacatttgtgtattagaaatgattatggagtaaatgccttatcttattattttgattgaatcttctgtaaagaaatatgagaaatactctctatcaaatggagcagtagtcgcgtatctgcctccctcccccacaacatgtgagtaaaaagtttaaaaatatattttaagaatcaaagtttaaaattataaatatgtcaaaaattgtgacagtctgagatcttatatgacttgcaatctaccaagttagcctgccacagtttcatagatgctaacagaagactcaagactcctgggtcagaaacaagagtttattatgcatagcacaggcagcatgagccttatgttttcaccagttccccttgtctccagagcccatgcagataatacaaagacaggcccagatggatcctgctcacagagggcatttagaaagcccccaatcttacactgagactgttagaaaacctgcccaaacactgccccagagggagatattatctctcttatccacagggggaaaaaaaaagcaaaaaactgacctcgcacctgaagaaaggtactactatctcccaagtgtgttggctttacaaacatccttgaaaagagtccaggatgaaagttgtccccagatatgcagaaatgaaatggagaattgcatcccaacaaaatgtagtagtcaatcctcattattcacgattctgcatctgagaattggcttactcactgaaagtaatttgtaacctccaaatcagttcttgcattgttttcatggtcatttgcagaaatgcacagagtggtgaaaatttgagtttgctcgatgcttaagtttccagctgaggtcaaacaaggtgatattctatcatcttgttttagctctcatgcagtaaacaagtatccttttttcagtgtcatgttttttgcattttcgtgctttctttagttggtgactttgctttttaaaatgacactgaacggtgctgaagtgctgtctgatactcctaagtgcaagaaggctgtggtgtgtcttatggagaaaatatgtgtgttcaataagctcattcgcacttgaattatagtgctgttgccatgagcttaatgtttgtgcatccacaatatatattaaataagccttctataaacagaaacatgcataaaacaagtttacgggttaatctgttgatgaaaatgtagtgaccgaagcctcacagaaacctaaccctgaatttcttgtaggaacaatgattgaatatcagtgaattcagtgtttgcagtgattttatggactatcactaccatgaataatgataatcagctgtgtagtcggcacaaatggcagcacccttgcttccactctggctctcttacagtgtcatcaacaaaacaacaagagtggttcttattatataaaccgtaagtgagatcatggctcggttctcctcagagctcttctgtgactttccctctaactcagaatcaaaggcaaagttatcccaatggtcctacagcatgtgggctccccgccttgccagctctttccctgtggctcctgacatcacttcttccattccccccaacccttgctcattctgttccagctacctggcttccctgaggtttatggaacatcccaggcagcttcctgcctcaagaccgccttacttacttctgcctaaaaagctcttggattttttttttccaaatatctaaatggcttactcctgcattgctttcaggtgtttgctaaaatgtcaccgtctcactgcggccgtcactgaccaacctacttaaaggcacacgcccatccctgccaactctggttctcttcatccctctttctgctttgttgttctctatggcaccaccaccacctggcacactataaatattatgtttacctgtgtccttcccataatatgcagaaatattatgcaaatattatgcaaacaatagtctgttttattcactgtggtatgcccagtacctaaaacagtgcctaaaagtttttgaaattttcagtgacttttttttgcaatagagtaagctctatcttgatctgcttctaaagacagcaccagagaacatttctctgaaacataaataaacgtagagacacagctcaaaactcttgatcagactcagtaaagctagaaagctaattggaaaaaggtagcagggtgttttcaagctgtcttgaaaagagatgagtggtgaatctcttcatttttaaattgggagcaatgtttgtagtagcatgagagtttatattaggctatcaaaataaaaaaatgacttaaaccctattaactcagaaaaatgttgtctctgtaatttctttgtctaatagtaccagatcaaactaatccctcatgaaggaagaagagtgcttttccttgagaaaacaaaacaattagattctagctaaactgcccacaaaacacgaaatgtttcatttaactaagtgagaagacatagcttgtttaaatcctaaataaagaagcagtctccattaatggaaggcaagtcccttacaagcatgtttctctctgcacctaaacaggtatcaagcgaactcattgtgcttcctcatattgccacagagagacacagataaatggaacaaatgccaggcaaactttgaaacggtttgatttgatgttaactctaattctgagttttaccatcagtggttctctcatgctatcataacccaaatttctctaggccttgccaattgaggaatgcaaacaaggccatatcatcatcaatgagaacttcaaattcactgcttcatgtcccacagcagaacatagtgcctacagcctcccttcagtgattcatacagttatggaggtattttgagtgctcatgaagagtcctcttaagatttctcatctaataatgtgtcccccaaaaccatttgagagtcacattttggctgcccaggctcaactataacaatgcacagccacaccaacggtgcaaacctttgggagctgaagcagagccagtttccccacagtactcactgtgtgtccaaaatacatatgtatgtattatgtgtgtgtatgtgtgtgtgtctgtgtgtgtttgtgtataaatagaatatgaccccagagtaagagggttactgtaatatgaaggaggtagcggacagtgtaggctctaaggatcaggcagtgcttcatgaaggaaggagcatttacgtaaacctcagtctatgggccagatatacatatcatcagtgttattatggaatttttggctagaaaaacgtttcttccagtttttctgattcctatatttcaagaaggcaatctctaaaactttgagtgtattagtgaattcacatgaaaaacttatcatataaaaagtagttacccagggtatctcagtgagaaaatgtgggagattgctttagtgtatgctatgtgggatcatctttctcatacatcacctggcttaaacattatttttttcaaacgtattcggattttatggaacctggattctagtgctacaaaggacaatataagataagggagaaaatgagtggaatgagttgtggatcaggacttaataatgtatatacagtggtcaaggataaactctctaatatgtgagcagaaacctgaacaggtgaaggagcaagccatgcagatgcctgcaaaagagcatttcacacaaagggaacagcagtgcaaaggccctgaggtagaagcacgatttcatactcaaggaacagtaagcaggcagagagcagagagggagggtcacaggagtggaagtcaaagaggtggcccagggccagatcatttacaactttaatagccagtgccagggctttgctttagagtgagtaggaaggcactacaaagttttgagcagagaaatggtgctatctgaatgaaggtttaaaaggatcacagcagatgctctgttatggtaaactgtagtggacaaagtggaagcagacagtttcatgtgatatatggcaatgacttggaccataagggcagcaatgtgaagtatgtgaagtggtctgattctgaatagctgagacagaatttgctaacatgttggatgtggagtctgaaagagaagagccaagtatgactccaagtttcttggtttgaacaactagaagggtagagctgtcatctaatgagataagaggcctacaggaagaatattttggggtgggtagggacgtgaaaattgggagatcaattctggacgtgggacgtttgaagctgtggagtatacataatttcagctggacctgcctttgctttgccgtttattagctgtgagatcttgggcattaactcagcacttctgagactcaactttcttatctgtattatgaggatgatagaacctaatgtgtaagttagagttgtgagaattcaacaaaagaagaggtataatgtacctaaaacacagattttaagagaaagtaaaatgaaacaaaatcaagtattaagtaagtgattagtaatttgtgtttatcaaaatcatcatgacagtaggtgtggggtttcttataacagtagaagaattacttttaggaaaatttctatgactgtggtttaatgaaatgaattctaattaaacacttaagaaaggggatccccattgcataccatccagtttcaacttgtcttttatttttaattccttttctgggtttactatggtcagtattctctgctcttccataggtatgtcagttgttttctcatcacttggcaagaaagctaaatcttcagtcagtttggtagagatttctgtacaaagcaataaatgcactcttggctttattcctttgcaatttatatagtccctcagatggtcaagttatcaagatattattctgatgtatttgtctcatgttgttctccaaaattactaattcatactctccttccttaaacctcttgtttactgttaaataaagttttgttttatgtggggtagtgtttttacttcattcatcctgcctacattcagctcattttaagatgtgtcttttatatgcatttgtcttccattttctttacaaagctggttcacacaaaacagtcaaaactgcttcacttccagtgtgctccatcacctcaaaatctgctattttgtttgtacacttcgcacctgagttaggtgctgatgatgtgctttaaaagccaattttgactgctctaaatgctataagttgacattcattaagttgcttggatataccaaattttctgtatcttcttagaagtctctcctcttaaatttccggcttcatttgccatgatggttacatttgttctacctaacaccctttgtttgtgttacattctatgttcctgaacagaaaaaccctgacatgtcactgtgtgttttactatttatacttccttcctgaaatatctctttccctcacccatatgaaaccttactcagttttcaagatttggttctaatattacgtcttcctggaagtcacttcattctgcatttattcatccccacttttcttatcagaatcggttgagtagtagagcacttatatgcatatcttcaactgaccacaagcccctgaagggaaggtacaataactggtttaggttttatttcccaaaatgtcttgaatgtaatagatgatcagtaaatgtctattgaaatagtatgcttcttttaaaagtatgaccttttagtttttatctgctatgtcttcattgtcagcactgttctggcataacaatccatgctagttttattgtgctaaacacaattttattaattcaacaaatttgagcaccttatatattatatataagcaccttttattgaatttggtcctgagaatgcagcatatgcataatcccttccctagaggaactcacaaaatgaaagaaaaaactggcaagtaaataatattctatatgataaatgctacggtagtgatatttttcagagaggtatttaagcatctaaagagtttcagaggaagatggggtttggcatgtcattatgttagatttgggcgatttgaagagtgcaataattattataagcacctggaacagtgccttcctgtggaagccattctataaacactgttgaattaattacatggtggcacttagaatgtaggttcagaggacagtaagaggatatagctaaaggtaaggcactttaagtggatcatggtgttgatatggtttttctgctttattgttgacctaagctttcagtcacttatatcctcatttgagaagtctctggatcttacatgaatatgaaaatgaaaaaataagactaagtagcttctcagataattaggatgaattcataacaacagttcccagaatcttccttaagaaagacacaactactttagaaaatgaacctacaacattaatgtaagaaagaaggaaaaaacaaaatctttataaaattctttttaaatattacaacactccttcaaatgattgtcaaatttcaggttggtatcgggtgctctaattttatttgtaatgaaatagaacctttttatttatcagtcagtaattattaattgtacaaacatctattgaaaacatactatgtgatgacttctttactaggatctagagataaaaagacaaataaattggcttttgccttcacttagcatattccaactgattgaaaagagaaataaataagacaattcagtatatcacagttagagttaagtcagaggtgtgcatggatttttgagaacagaaaagaggatctaaactagactgggaaacaaaagggaaggctttttgaaagaaatggtgtgcttaaatggggtgattttaaaggacaaagacagactagcatggcataattactaggtagaagaatcctctaaccaagtacatccaggtatccaatatatctgttagattctctctctctcttttttttttttccaaaaatctgtgctcttcatggccttagtgataaccaggaggtaccacctatggagaagacttatctttactgcctttgaaaaagcataattctaccatgaagtgtcattgatgggcttaaattatcaaaagagaggtctgcagatgggtttcatggagagcagtggcttcagttgtcaagagtcccaggatataccatcctgtctgtcaccaagatgctgaaaatatatcactgttacttccatttgctgaaaatgaaagtagcactctttaccaaagtttaggtgaacatactgattaatattttagccataagatttataaagtaacatccccatataaatattataggagtgtttatcctgtgaaaaagatgagatcaaggaactggatttattaagccacataacgattttttcttttgttcaaattcgccatgtgaaacaagatttaacgtaatgcagtgtaggatcagcatagtgccttgagatggactccaaatatttctaataagaaatttaaaagaagtggcatattatggaactagtatttcttttcaagattatcaaatgtaatgatgtttttcacctttactatatttaagatgtttctgtaaactttgagtgattaaaagactagcatttttctccttatcttcatacaaacctgagacacaatgacttgttatgcattagctatggccaacaatagcttagtaatattttagttttctgttactgtcagataatttttataattttttatatacctaaagcttttcactcaagcattacacatttctctgtctttataaacagagtattttaatcccaaataatcactatgaaaaagcattattttaatgtgctttaagactatgataccatgagagattactgaaatgtatataaccgttttctcctacactcaatgaactttgagttctgttatctgattttcatagttgttctctttttttttgcattcagactgtttgcccttactttttataattcctattgctacctcccctttcaacatttccatctgtaatatgctatttcaaatgcaatttatttcagcaaatatgcattgaggttatacaatgtgttagtcacattgtatatgtgtatatgctagggattcagagataaatgaaacatggtcttagccttcaaagagttgtcaggtgagaaagaagtagagatataaacaagtaattacaatttgtgtgtgctaattgcaattattaggattttattctccggaaaatgtggcttgtgttcctggattttggcaaggtaggatgggccaggacaggacttaaaagggctcagcatcaatggataatggaagaatttaaagcagagagttttgaagtaaatcttaaaggtgcatgggagtgaatttcctgtggagaaagatatgtgctataaaatttaacaaatattttgtaaaaaatgtgtctaaaataagaacaaattactcacagttagactgaagatactatcccagttatgagctttggatagttacttcgtggcatcagttttgaccatttggggttttattttgctaacattatgttttatagtaggtacaaaatagtttggcatgcttagtaagtgatatctcatgagtgaaatgttgatgcatttactatgagaatttgtaataagagactgcattttattatagtacatcaggttttattgacactacctttccactatcagtattttctaatgagaaaataattcaaaaatagtattagacatacaggaagcctctgagttaatgtggggtcatgtttctaaatatactttctatatgagacaatttgtgtttatgatggaattgcatgtctgtaccttataatcatgcatagaaaatatgtccttaggcattaaataatcaacctacaagaaatttctggtggcaaacatatgtgttaccttttcatatttaaaataccattcttagcataatgcacagtacaaaaatatatattggccattttattattattatcatttaaaatgatatgctaccagacttattttggaaccctgctgaaattcctacatgtacagaaaaaaaatttagtgatatactgaagttaactaatgtcagtaaagcgaaaaactaatgaaactcactgtaatatattcagtctttgaactatctgaatttcaatttaacctcaagattagactttgtatgtgtctccccattcccttgcataatattcacgcaacacactccaaacacatatcttttatttcatgtagcaattttcaaagagatggatgggggaactgcacatcagtttctccagacagtatataggtacagtttgaaaaagtcagtcctcaaaatttttctttctactctacattcctctcactgggctccaacccaccctgcaccttctctctcacacatgaatacaagaaaaatcattactacaaaatttgaagatgatctggacctggacgtttttcagagcaccacttgctaatcagcttttgtggctgttttaaaattccaatgctatacccttgaaatacctaacttctaacagtataacttcttgatgaacttcccaggataaattagtggcaaaatgtgaccctagggattatgtatgtgtaggagcatataaagtctacacatagatactagtaaagtatggcaaaaagcataatttttcacttttacagcagttatatcttaaaggattctttctttgcactaggtacagtttagaacaattgtttattggaacgaatgataatatggttttttacatcttttcattcatatctgttcatgtcaaagatcatttctatgcaccctgaaactcaaggtgcagtaagctaaacttaagaaaactgaaatcctgtaataaatttatatctcttgggatataattgcttcctatccaataacaaagacccaagagaaagaagcaaaagtcatatttttttctaatatactgataaagagaatagcaaccatgaccaaatagaaatcatcaccaaagcctattcacatctcatacaagatcttgacattttaacttggatttataagcctagatttagatatacctacatcaatgatttatcaaaacaaaactttgaatgtctcgaagctgaattacttgcctatggaataaatgggctacactgatactttcacacagtgtttagaggggtcctacggtgcatcagtgtctgcccctagaggtaaggggaaggctgactactttgagttctaggcaagtagcctaggcatttcatccccttgtttcttccaaaacaaatctagttgtctttgttagtgacatggttgttttccacatagatttattttaaaaaagaacccactactaatctcatttgaaaatcactgagtccatccagtgggaccatgccacaagagcaaacactgtaaacaaattagcaagaatctgattctttcgggaagaccagactttgatgaaggcagcccagtgtgcgtttgctttatgatcaaacattctatatgtgtacataggactatatcagtatcaggttctgagatgggtcaataagacaggaatagttagtttgggtttgtttctacttttgccatagaaacgtggggagggggaatcaaagtagctaagcaatacaccccaaatttgaaactgtcctattttaatagagaagatcctaagactgctggaaaagggtctgacagaaccagtttcagagtgcctcgtcatgtttcgctgtggcagaaagcactctgagcagagtgacgttctaaaatactatgcactaaagagaagggtttgatgcaaacttttgacctaggcccttggtgtaaatggagggatttcccttaatcatttcagcctgagaaagttaagtaagtgttacccaaaagggttttttccccattttgagcattcaaaagtcttgggacatgagcactgcattgactgtctggtatagaagcctgttgcaaacttgatcagcccctgcccaggtacaatggaagggatcccacactgggagtacctgggtgtgagctctgccactgctttatactaattgtgaggccttagtacatcatttagcccctctacaactcagtttccccgtctatgaaattatggtgataatttctatctacctcacagggatgtttgtcaaaagtcaatgagattagaaacatgaaagttaaatgtaagtagaacaacactatatatattatcacttattaaaatgaaccaggttgggcgcagtggctcacacatgtaatcccaaaactttgggagactgaggtgggtggatcatttgaggtcaggagttcaagactggcctgaccaacatgctgaaaccctgtctctaccaaaaatacaaaaaaaaaaattttgccaggcatggtggcatatgactgtagtcccagatacttggaggctgaggcaggagaattgcctgaacccaggaggcagaggttgcagtgagccaacatcccgccactgcactccagcctgggtgacagagcaagactctgtctcaaaaaataataatgataaaataaaaaaatataataaaccagagcattcttaaacacaagcaatgaaggtatctgttctacatcctgctatttcaagtcccctttctgaccttctttttgctgctcccctcactaccagttgaggagtttatagagtcaaggggatagatccagcaggagcctgtgcccctcttctagatcattccccaggtgtccagaccccataattccctgctcaaactcccctgaccccattttctgggccaatggatcacttgtccccattacattctccaagggggaacccccccaccacagatgtaactccatacatccaagggtggccaagggaatagctgtttgtgggggtgtcgatggagtgtggacatgtacagcatgtcacgtgcatgtgggcaagaacccccatgggcagaaaagagctaaaagtggaaagaaaaggatatcatgcagctacaattcaaaaatgtattttactttaaaatttgatagtttgacttaaatatttagaaacgtggcatgccagcttccatttgtactttcaccctgtgctacacaaatattaactgtttcacatttgccatcattgatcattctgtgcaattataatttattcccacaatttttttctaattttaggactaattgttgttgaatattttaccctagagaggaaaataaacttttgtctgagcaaaatcccaaccatttcttcatgattatgccacctgctttgtttttgcttataccacagccatctaaccaatttgtagatatcctatcttttataccaggacagtgttgcctgatgggcacaatcctcttctcacatcagtttggaaaataaaaacattataatctctttttttcctttggtatccaaagataagccctttaaaaaagttgaatgtaaaaggatgataaggagattacatagtttaagctttatactcaaaatcattttatattgaatctctgtaatgattttgtgtaatatctttaaatagcatagaatactatttatcagcggtagaaccaatttaaattactttcagccctgatgagaaatgggaagagactgaagtacactacacattggcatttgtacagttggcagctgggcaaatagcagcaacatccacctacttatattaattatctaggttattacagtagagattaaacagagcaggtaagtcaggtaattagcttctttataaaaattgagactaccccttttattcttcactgcttccctaaatcaggaagcactttatgtattacaagcatctaaagaaagtggaaaaatctactgtaaacattttatgttttaaaaaaattattttaatttttcatctttgatttaaaagattgtatcaaaactttaaatatcttcccatctcagtgcaaaataatgcaaaaaagacaattattgccatggcctacatttgtacagggcctttttcttccagtattttccttttatatctattttctcatgtttgcatcatgacaatcttacatgttaaaaaatgtaacacaaacatcttacaatcactttttttcacaagacattatttttcttttattcatcatttattgacaattgaaacattccaaatgattctaatgaatgtagacagatctttccttgtcctaatccctaagctgtcctttaaacaagagccagacatacatgaaacaagccattgactttcgattgaaaataaccttagacattctaatcttttattaagcactgtccccaggggttgtaaactcaaatgccttcaaggagtgacagttaacaaaacttatgatgcgcaccataaatcaaacttgatgtgtgatcatacttcacatttgcttggttagttacattgattttcaaactctctgggtagtatgttcctctcagagcaccaactagtgaccccgccctctctagttccctcttttcttcttcacctccttcttcaaccctgctttttttttcagactcatgacttttggctttatcttcttttcttgacccccacattgctcctttgactcatggcatatatggcgtcttctgttttgaagctttggctctatctttcagacagtttgcaagtgccctctggctacatcctgtcattgctgctaggtgttatactctgaagtataaagtcaaaacaaattatatctaccttaactctgggcacttctggtgggtctgccctgtgcctcaggttcctgtccactaatactcgtgagcgtgagataagatcatcattctagttaaaaatccatcactactataagtattcaagttcatttttggttaattatattgaagtgccagtccatgtttgagtgctgtatttttatgtatagctgtcaggtacaatgctgtgcagtctctggaattaatctattattttctttaaaataaataaaaataatgggcactaaatttgtgtttcagacttcaaaccctccttctgtaatcaatgattagtgtgaatgtataagcactcattaacatttcattccctgttttgatttaaattttaactctcccattatgaataataaacagagtgtctgatcacatttgaccttttgaggcataacggtgctttttttttttatttctttaaatatcataaggcccaataggtcacttccctgttaacttttcttacataagaaatttaattattttaagagaaaaatccaaataatatctcagtaatcttttaagaaataaatatattttctttattgccaacagaacatctaaaaagtggacattaaaaaaatgagtttgaaatttgtttgatttttcaactgtacattaagtatatctgctatataatgaaagcttttttcctccccaaagattctcaaaaaatgtgttccagaaatacagataaataagtaaatggatggaagaggggggtatatttctatcaatttatcattatgtttattatttcacataagacttatcaaagatattctttggttatctttgataagtcttgattataagccaattatgaccaaccaaaaatggtcctatatatgtaaagtataactaacaaagtcaaataaatttataattaattcatcagctccttaaaacatctcacaaataacgtgaacctgtcatatattgcgtgtgtgtgtctgtgtgtgcatttctcccttacatctcaaaggtaataaattggttacaaaaagaaatgaagagaaatgaagtctggagtaacttgccaaagaccttgacttaaataactaaaattatatccacattatctaacagttttttttaatagatagactatcacataaaatcatttataacataatagtaacttgtgagtagtagttaaaagtacatgatactttgatagtgcattttctataagtgtttaataagaaaaggtatctggttcttgtaattatattgatagctaagatttattaaacacctactgcatattaaacactcttctaagtgcttatcatgtaggattttgtataattttcacagccatagtctgaaataagtactattgtggaaaggaaactaagagaagttgagtaacttacctgaggtcacacaccaaatgagtcaaggtactgcaggcaagattggcagtggatcccgagctcacacatctaaccactttgctctactatctcttaagagcagtgaaagatttaggagagaaaggggaaaatggcctgtttctctaactttatattatgcattatttacttactaagcttctgttttatttttgatcatagaatatatatgttattttttcaaggttaaattgcaaagtaaaagcattatagtgtaaggaataataatggcttatactttccactccaaagaatttcctaagcagaggttggaaacaattttcacgcgtcactgaaagatagcttccttcaactggataatgttaatgtttattggcacttaatagccttagacaggacagtattttgaaattcaagagtaatttgaggtaaccagaatatgaatacacccgggaagagttgtcatatttcaaaataaagcattcagtatgttgcacaaaacagttcatctgtattgattgccactaatgctagaacagttagatagaccaatggaactttcacacttgtggcatgaaaatagttcttgaagacctgtaactttgaacaaactaatcctctatgttcattatccatttaatgtggagaaatgttttgggtaaattattgttgaaagatttaaaattcttaaatgtatgctaaatggaaatgtgaaaaaatttattagcttcaagaaccaaattaggcctcaaagcaatgatctttctaaaaattctagatcatcctgcataagaagaagatagagtagcatagcttagataatttaatgtgcataaagaagaaagtcctgtgtctttattgatgacactgaaatttgaatgacaaagacatggcaatctggctttacccattttccgtggcttctgctcacacataaatggctgtaacctccacccccttgttatggttacaaattatgggattgtgtaacataatacaatgataacttaagtttagctttttactttgaaaataaaaacaccttcctgtgtccatgtgttctcattgttcaattcccacctatgaatgagaacattgtgcacatataccctaaaacttaaaatataataataatgaaattaaaaaaaaaagatattacaaaaaaaaaaaaaagaaagaaaataaaaacacctgagagtttccgcaagatggctgaataggaacagccccggtctacagctcctagtgtgagcgatgcagaagacgggtgatttctgcatttccatctgaggtaccgggttcatctcactagggagtgccagacagtgggagcaggacagtgggtgcagcgctccatgcacgagccgaagcaggacgaggcattgcctcactcgggaagcgcaaggggtcagggaattccctttcctggtcaaggaaaggggtgacagatggcagctggaaaatcgggtcactcccacccaaatactgcgctttccctacgggcttaggaaatggcccaccaggagattatatcccgcacctggctcggagggtcctatgcccacggaggctcgctgattgctaacacagcagtctgagatcaaactgcaaggtggcagtgaggctgggggaggggcgcccgccattgcccaggctcccttaggtaaacaaagcagctgggaagctcgaactgggtggagcccaccacagctcaaggaggcctgcctgcctctgtaggctccacctctgggggcagggcacacacaaacaaaaagacagcagtaacctctgcagacttaaatgtccctatctgacagctttgaagagagcagtggttctcccagcacgcagctggagatctgagaacgggcagactgcctcctcaagtgggtccctgacccctgacccccgagcagcctaactgggaggcaccccccagtaggggcagactgacacctcgcacggccgggcactcctctgagacaaaacttccagaggaaccatcagacagcagcattcgcagttcatgaaaatccgcggttctgcagacaccgctgctgatacccaggcaaacagggtctggagtggacctctagcaaactccaacagacctgcaacagagggtcctgtctgttagaaggaaaactaacaaacagaaaggacatccacaccaaaaacccatctgtacatcaccagcatcaaagaccaaaagtagataaaaccacaaagatggggaaaaaacaaagcagaaaaactagaaactgtaaaaagcagagcgcctctcctcctccaaaggaatgcagttcctcaccagcaacggaacaaagctggatggagaatgactttgacgagttgagagaaggcttcagacgatcaaactactccgagctacaggaggaaattcaaaccaaaggcaaagaagttgaaaacttggaaaaaatttagacgaatggataactagactaaccaatacagagaagtgcttaaaggagctgatggagccgaaagccaaggctcgagaactgcatgaagaatgtagaagcctcaggagccgacgcgatcaactggaagaaagggtatcagtgatggaagatgaaatgaatgaaatgaagcaagaagggaagtttagagaaaaaagaataaaaagaaatgaacaaagcctccaagaaatatgggagtatgtgaaaagaccaaatctgcatctgattggtgtacctgaaagtgactgggagaatggaaccaagttggaaaacactctgcaggatattatccaggacaacttccccaatctagcaaggcaggccaacattcagattcaggaaatacagagaatgccacaaagctactcctcgagaagagcaactccaagacacataattatcagattcaccaaagttgaactgaaggaaaaaatgttaagggcagccagagagaaaggtccggttacccacaaagggaagcccatcagactaacagcagatctctcagcagaaactctacaagccaaaagagagtgggggccaatattcaacattcttaaagaaaagaattttcaaaccagaatttcatatccagccaaactaagcttcataagtgaaggataaataaaatactttacagacaagcaagtgctgagagattttgtcaccaacaggcctgccctaaaagagctcctgaaggaagcactaaacatggaaaggaacaatcagtaccagccgctgcaaaatcatgccaaaatgtaaagaccatcgagactaggaagaaactgcatcaactaacaagcaaaataaccagctaacatcataatgacaggatcaaattcacacataacaatattaactttaaatgtaaacggactgaatcctccaattaaaagacacagactggcaaattggataaagagtcaagacccatcagtgtgctgtattcaggaaacccatcacacatgcagagacacacataggctcaaaataaaaggatggaggaagatctaccaagcaaatggaaaataaaaaaagtcagggattgcaatcctagtctctgataaaacagactttaaaccaacaaaaatcaaaagagacaaagaaggccattgcataatggtaaagggatcaattcaacaggaagagctaactatcctaaatatataggcacccaatacaggagcacccagattcgtaaagcaagtccttagtgacctacaaagagacttagactcccacccaataataatgggaggctttaacaccccactgtcaacattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaactgaccacatacttggaagtaaagcactcctcagcaaatgtaaaagaacagaaattataacaaactgtctctcagaccacagtgcaatcaaactagaactcaggattaagaaactcactcaaaaccgctcaactacatggaaactgacagcctgctcctgaatgactactgggtacataacaaaatgaaggcagaaataaagatgttcttggaaaccaacgagaacaaagacacaacataccagaatctctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagccagaagaaggcaagaaataactaaaatcagagcagaactgaaggaaatagagaccaaaaaaacctttcaaaaaattaatgaatccaggagctggttttttgaaaggatcaacaaaattgatagaccgctagcaagactaataaagaaaaaaagagagaagaatcaaatagatgcaataaaaaatgataaaggggatatcactgccaatcccacaggaatacaaactaccatcagagaatactataaacacctctacacgaataaactagaaaatctagaagaaatggataaattccttgacacatacactctcccaagactaaaccaggaagaagttgaatctctgaatagaccagtaacagaatctgaaattgtggcaataatcaatagcttaccaaccaaaaagagtccaggaccagatggattcacagccgaattctaccagaggtacaaggaggaactggtaccattccttctgaagctattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaagactggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctgtgacaaaccccacagccaatatcatactgaatgggcaaaaactggaagcattccctttgaaaactggcacaagacagggatgccctctctcgccactcctattcaacatagtgttggaagttctggccagggcaattaggcaggagaaggaaatataaggtattcaattaggaaaagaggaagtccaattgtccctgtttgcagatgacatgattgtatatctagaaaaccccattgtctcagcccaaaatctccttaagctgataagcaacttcagcaaagtctcaggatacaaaatcagtgtacaaaaatcacaagcattcttatacaccaataacagacaaacagagcgaaatcatgagtgaactcccattcacaattgcttcaaagagaataaaatacctaggaatccaacttacaagggacgtgaaggacctcttcaagaagaactacaaaccactgctcaaggaaataaaagaggataccaagaaatggaagaacattccatactcatgggtaggaagaatcaatatcgtgaaaatgaccatactacccaaagtaatttagagattcaatgccatcctcatcaagctaccaatgactttcttcacagaattggaaaaaaactactttaaagttcatgtggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcataagtaataccacacatctacaactatctgatctttgacaaacctgacaaaaacaaccaatggggaaaggattccctatttaataagtggtgctgggaaaactggctagccatatgtagaaagctgaaactggatcccttccttacgtcttatacaaaaattaattcaagttggattaaagacttacatgttagacctaaaaccataaaaaccctagaagaaaacctaggcattaccattcaggacataggcatgggcaaggacttcatgtctaaaacaccaaaagcaatggcaacaaaagccaaaattgacgaatgggatctcattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaataacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactggaaataccatttgacccagccatcccattactgggtatatacccaaaggactataaatcatgctgctataaagacacatgcacatgtatgtttattgtggcactattcacaatagcaaagacttggaaccaagccaaatgtccaacaatgatagactggattaagaaaatgtgggacatatacaccatggaatactatgcagccataaaaaatgatgagttcatgtcctttgtagggacatggatgaaattggaaatcatcattctcagtaaactattgcaaagacaaaaaaccaaacaccatatgttctcactcatagatgggaattgcacaatgagaacacatggacacaggaaggggaacatcacactctggggactgttgtggggttgggggaggggggagggatagcattaggagatatacctaatgctaactgatgagttaatgggtggagcacaccagcatggcacatgtatacatatgtaactaacctgcacattgtgcacatgtaccctaaaacttaaagtataataataataaaaaaaaaagaaagaaaagaaaaacacccgtatctgtttcagaagaaaaaaaaaccctaggttaaaaactgagggaaatatgattcaatatatctttcccattaatagggaaaatttaaattgctaacatttttaaggtcatacatttctaacctttttaagatgttacctttggggggaaaaaaagctctctatttgccattctcatcagcatagcctctctccctgggcttctccttggcatttgaattgtccaccatttccacctataggcctgcttctaaactataaccctgctcagatctcaagttacatcacaagagtctgtgttctggaagaataatgcactgaattttaatcatgataattcaggcttagtatctttaaatacaacatagcagatgcaaggttaaatggcagtttcagtctttgactggaattcgccttaagataagaaaagcaagttttagaacatgatcctatgagcctaggaagacagacttagccaaaatattcctatactctgcttactgtaaatgcatgtgattttggttctttcttgaaattggtgttctggtatttgcttaagagattctgagtcgtaaagtgaggagttattttaggagaaaatttttattttgtttagctaaacaattgacagcattactgcccttttcctaactactgaaacttggcaattagcattccagtgttttatgatttataaataatagttttgttacagttctcttcattaaatatgccaagatacatgtttttgtacttatgaatttttgtgtagggaaaatcatttattttatttaaaagtataagctatccacaatctctctgtgtttcaggaggttacaacacataggattgtcccatattattataaaaccaacacaattgtggtgtattaactgttaaagtaaaaattactcaatgacactttttaaagcatgataaggacgactttattcaggaacattgcaaaaggtatagggaccactgcaatgggattttgcagtagaggagagacataaggtaaggttattttcaattgaaattctatggcttgtttatcctatagcattaagagaaaaggaagatataaaattatatatggaattatagttatctatacacacctattcatacacactccagaataaaataaattcaaatgttattagttatctttggataatagcatattagattattgtttttgtctttctgacttttctgtattttccaaatttgtagtagtaaatgtaatgtttagttagatttttggaggatgttttctttatccagaatcagaaattctgaatttcagtattttaaatgaaatccttgtgttctgcttttgaagattacattattaatcacttaaaagatcttagtttgaagagaaaaatcagaatatgcttaattgacataatatattgatgctgaaggactgtgttttcttcatgttgaaaaagtgttctttttgttaccattgactacaaatgcttgagtctcagtatttctatgagataattttgttttgagtttcttttggggtgaaacaaagagaatgctaaattaatgagtttgactcaggtgttctcaaggccagttcattgacaggtgggcaagaaggcatttatagccaagaagcagagtggggctcaatggatgactaagaaacatcgagggtacaggggatgctggctaaaccagccttacaggattcttgccacaaacaggccagggtgatcagatatcacgtggggagtggtagaggatgaggaacacagtatctattgtatagggggagggttcttgctaaactgacttagcacagttcttcccaaaattggattttacatgaagtacacaaatggggctctgtgaagactcgggaccatgactaaagtttggtcaagcaaaactctttatcataacatatttagaaatagatttaaaatctgtaggatatgatatgaaataggtgagtgggggtggtaaaaggctctcttgttcaaggggtaaataaccattgctgaaaatggcaaatctgtgggagtatcttccatattagtccaggctatttgcaaacagaataacaaataacagtttatggcttgataaaaaggaaaaaaaggcaaaatgcctctcctggcttatgactataaggactctgcccaaataatccaatctcattcacacactttatcatgtaaagaagaaaagttagaaattgttaagtactggtgtctgtaccaagtagtgagtgaatgctttgtatccctgttctgaggacaatctcaaaaccttaccgatttttactcccttgctttcactagcttgttctttgatcttgggacttgtcttatcaaaatcatgtgctgttacctgtctcttcccttctagctcagacgtcacatcctcaaagaggtgttccttgactcctggaactgagccaggttcattgccaactctttgaatttccccaaagtagatctcctctcattttaacgtcacaactaaaacaagtgttactatttttaactcttggtaatttccataggagtagagatcagatctatcttgttcaccatcatagtttaatgtctgacctatagtaggtgctcactaaatgacaccagtagttagttagcaatggtgatattagcagtccaaactctgcctggataatctcatctcccttcatggatttagattatcacctatatattaggcacttccaattctctgcttcccatcaacttttctctaccaagttttagacacttatatccatgtgataagggagcagactctagaaccagactacttgggtttctattcttgactctgcccctatttccattcattacattctgtatacaaattctattcagagaagtcaaatcactttgaacaaattgtccttaatttctgtatgttctcagcctccttttctctaaaacacaggggagagaggctgtgagatacagtgtctgacataagttagtgttcaataaatgctagctcttgccattagtaccaccactactactgctgctgctgctgttgcagatgcagttattattctattattattattctcagctatttcaccctatttctaatagaaactatctaaaaatgaactctctgtctctccattgccaaaactatctctacgtctcgtattctctttcttagttcaccgaattcatcttatcaccatccacccaattacctagcagatgcctttgagtcacactcaccttctctcctgcccccagcttccactctgtaccatccagtgaatccctaaaccctgctcatgaggtcttatcaatatctcatacgtatctccttctctctatccccatggctctttttcaggtcccatcaccactagcttctttaccagtcttactgctttcagtctcctacctctgcagtccaactgttccctcagcaaatgttcatcagctactatgtgccagatattgcttacaggcttaagatatagaagtaaacagacgaatagaaaaaaaaaaatccccaccttcatggaacttgcatttcagtggtaaattatataacattaaaagtcagcaagtcccataaaaaaatacaaggtagaaagttgtggattggggtgggatgtttgcaattttaaaacggacagttaggacagatctttttgataaagtggcatatgactgaaaatgaagaaagtatggggatgagccttggagatatccgggagaagtgtgtttcagaaagagagctcacctagtgaggtgggaggacacctagttgctgaagaaatagtaaaaaggccagtgcattttgagtagaggccaaggaaggaaagaggtagaggatgaggtaagagtggcaattatgggccagatacatgaagctctggaggccactataaggatactggttttactctgagtgaaacagaagctattgtagcaatttgagcacagaagagacatgatctgactgctgcactgaaaaccgcctgaaagtgggaaagatagaagctgggagaacagttaggaggctactatggaaatccagatgatagatgctgttatcttggacatgagtgttaccagtggagacagtgagaagtgttcagagtctggatatatttgaaaattgatagctgatggattggaagtggaatctgagagagagaggtttataaaataagacaaaaataaaggatgtctctcaaatgtttggcctttgcaccagaaagatggagtaccatcagtagatatggaaaattgcagaaatcctaggttgcaatgggggtggaagggaaattattggtagttcagtttggggcatattaagtttgagatgtctattggacatcccagtgggagatcttagccagtttattttataagcctggagttctggggagaggtcctggctagaaatataaatgtaggagttgtcagcagaagagaagaaggctgaaggctgagctttaaggcattcacatgttaagaggtgagatcaaaaggcagtacaaacaaagaacaccaaaaagtaacagccagggaagcagaaggaaaacagtggtatagcacccagagggcacttgaagaaagaaattcaaggaaggattgatttaacaaataagatttagaattgaccactggattcataatgaggagagaagtttggggagaatagtgaggataaaaatagtgaggataaaaatccaattagtctgattaaaatgagtttaggagaattgtagaagagaaaatggaactaataagtacagacagctttttcaagtatttctgttataaaagaataaagaaatggggtggtaattgaaaggagaactggaatcaaagctaagttttaagattataaaagtatattatgtatgaattctaatggaaatgatctagtagagaggcaaagacggatataggagaaaaataatcagccaaggagaaaagtccttcagaatgacatgaggaattgtcccttgatgggaggactgacactttctccattataaaatgagggaagaagagccacctatgcaggtgcaactgggttggatggcaggaagataaagtagttcacatctgatagtttctgtttatcagtggaatataaagtgagatcaacagctgagaatgaggggatagaggcagtctcacaagtttgattatgaaattgctgtctcagaaaataaaaacaaggctactagaaaaacagtatttttttttctttctctgtgaggttacagtgtaaatctccaaatctgatagaaagatgaggcactcatcttcaggtgtttaccacctgtacacctgaacattttcttctacttgttcctgttatagcctcactgctacttgatgcttgctagaattaattaacaatgctatattcttggtatctaaaaggcattttatatatgttatataactggatctttataataaccttgaaaggtagagtattttgtccttatttttcaaaaggtaaaaccattttggagaggtcggataacttgcccaaaagcataagagtaataattcgcaatatctggatttcaaccctgatctgtgtgattcaaagtgttatttctatgctttgtaaatatacctctacatagaaagacattatatttcttcctttaaggatgaaaggcaagtacaaaatatttgcatctatggatgtctagcataatgcctggaaaagagtggccctcttataagtacttgtcaaaagacagaatgttttttatttaaccatcacaataacattatactgtccatttacacagatgagaactaaggctaaataactcactcatgatcttatagcaagttagaataagtgaccaatttgtaacactaactcagatcatctaactcctaagttctcattacttgttacaggcaaaattgtgtccctacaaaattcgtatattgaagtcctgagccttagtacttcagaatatgactgtatttaaagacggggtttttaaagaggtaattaagtgaaagtgaggtccataggatgacccttaaaaaagatgactgttgtccttacatgaagatgaaattagtacacaaacacacgcagagagaagacgacgtgaagacaatggggaggaggtgaccatctaccaaggaaggagagaggtttcaggagaaaccaaccctgctgacaccttgatctcagtcttctagcctccaaaactgtaagaaagttaatttctgtggtttaagccacccagtctgtggtactttgttatggcagtcctaacaaactaatacaacatctctcccactattgtagaaacaaagcatttcacttcttccatgggtgtcaatatgttgaattactaactcaatatgttgaactatatggccttctgagaaataattcagttgtgccaaagtccccagcaatcataatcacttaataaatagttttggataaataaatcattaacaaataaatttgcataacaaagataagcctctaattgctccagatcagacttccttgaactggagaaatgagtgactctgcccatcaatgaactgaccttgagaacacctgagtcaaattcattaatttagcattttctctttgttccatcccaaaagaaactcaaaaaaaaattaccctatgtaaatactgagactcaagcattggtaacaaaaagggcactttacaaacatgaagaaaacatagtcttttggcatcattacattatgtcagtgaaggatattctgatttttctcttcaaactaagatattttaaatgattaataatgtaatcttcaaagcagaacacttggatttcatttaaaatattcaaattcagaattcctgattctggataaagaaagcatcctccaaaaatctaactaaacattacatttactactacaaatttggaaaatacagaaaagtcagagagacaaaaacaatcatctaatatcctatcacccaaagataactaataacatttgaatttattttattctggaatgtgtattaataggagtgtatacataactataattccatgtataattttatatcttccttttaatgctataggataaacttatttgcaaatcttttaaaatctgtatacaatttgcacagtagctacaccaaactttatgtaaacattctttttttggctttgataaaaataattgatctcatcacatgatcctatatgtgaaacaaccttgtgggggtacatacatataaaatatgctttcttcaaacaaatgctaggctataaaaaacgcacaataagataacttctgaggcaggtgtggaggaaggggcttctgagaagaagtactgtcactctctactgcatgtacttctgtgttatttaaggagcattcattatttttgtaatttaaataatttaaaataacactgcagtgaacatatttgtgtataaaactcttcctaaatttcaaattatggtcttggtataaattcccagaaatgtattattaaatcagagggtctgaacattttgaagccttttgataaaaactggcaaattgctttcctaatgagttgtcatgagtatattcttgaggaaaatagtaaacaattgaaccagaaagaaatatttctcatcacaaatttaaatgagcttggctcaccacagttcaattctaaatacatacccttaccccttttcactattttctctcactgagaaagctgaactagataatcatttcaatataatgtacatatacatagtgcattatactggaatgattatctggtttgaactttgaactagataatcattccaatataatgaaatgaaaggcttattttatatataatatgttgttttatatataatatgttataacatttttatgtaatattataacactttatgttatgtagctttatatataatagtttattttatatatattataacatacataatatatataaataagtctttcattttaatatcactaaaaaagcatacttataaaatattatatatgtatttagtctgcttgacttttaataaacacttgaaagtctttttctgattataaaaaactgtgcaatagcttttaatatcaggttattttattgatttaaaatgtgaaatacaaatagatgtcatctttgttacaaaatatctatttccatagttaatttgattactttaaaattctaaaataaacttaatgatgatctttggatgtttcaaatgatagattgattagaacaaattttattcagagcatgaaataattaggttggtttcctattttcttgaaagataattatcagattattcaaagcgttttatggatgtgttatttttgctttaatgtggtcaataggtctagacacagaagttaaaaaacagcacaaaaagttcaaatagttggttgtattttaagcataaaaccaaggagagtagcaaggtatcatgaaaagtgtccagggttttgttatgggcagacctgagttcaaatctcaactttgctgtttattagctttgtgacctaaaagttattagaagttatttaactttgcttagttttagtatttttcatttatagaatagaagaggaaaacaactgcaatggcttttaacactgtaacttaattgatgcttaataaatggtagctatttttatcatgctgaagacaagaaagatgtgtgctatttcacattttttaaatagaaaataaattatagtatctattacctgaattctatagctatgctcacatactagagactattttatttccatctgcacataagaatttacatatatatagatattttctcattttcattctctgagatctgacatataattttatatactaatttcaaatataagtatatttaaatataaagtttttaagtaacatgtaaacagtgtgtgtgtgtatgtatgtgtgattataatagtcctaaccatattcattcattcaacaaatattcattgaacacttttacatatgctcagtattgttctaggaatcatggaaatcaagaagtcaaaaaagtcaaaaaaagtgacaacaattcttacctacatagaacatgtattcaaatgcggggcggggaagcagtgaaaaggcaaataagtaaaaaatatagcacatattaaaaagtgatagctgctaaggagaaaaatggtcaagaaagtgagataaaaattgggggggttgcaaatttagaatagagtttagaaaagaaggccttactgatatgccatttgaataataacctgaagaaagtgaggaagccagccacatggatatgaagtaaaagctttccaggcagagcaaacagcaagtgcaaaagtactgaggtggggacatgcctggaaaagccctataaatgccctcatgggggtattatgaggattaaatgaatttagcacatgtaaaacaccaagaatgtatctgctacatagaaagagctccataaattttagttattatttgcagttcttagcattagtcattttatttaaaaatcattaagtaatatttttatatttgtttcaaaattttcagtttctatccaggtatttggaattatgtatacttagcctcatatcatttaggccattgtgtaaataatttctagttttaatcatatgtaatataatgacatattctaaggtaagacaggttctatccctcctttcctactacatttaaagttcttgatttctcctgtatctagcacagtaatgacgtacactttatacatgtttataaagttttcttcattgactgaaggaatgaacatgctattttttggtaactacttacagtttttgcagattgtcctcattcactacacgacagtttaactgtgttttctcatgcagattataagttggaaagctctcattagctcattcattaatttttatgattgcctacaagtatcattatttagtgcaatataaatatggtgaaaagatgctattcatgtagggagagctgttataaatcaggaagcttgttagtgattgccagttgaactaagatctgctatgttttactacatttcagaaaataaatccatctggccttgagttttactatttcttttatctatttgctaaaggttgattttgcattaacaagaaattataaaagtaaagacttgaatatgtctaacattttgaatcagcttatttatattagcttccagaagcaaagggtaatactcataaggtcaagactagtgttgcatttagaaactgtataagtcacagtattatctgggtgaagtacaatgaacatttgtttgacaactttgacatctgcttcgccgtactagaaactcttaatactggaatccgcaagcacaaatatacatctgtttgactcaaatgaatattagttgaagaataatgacctgaaaactagatatcccctgagggtagttttataaaattaccaagctgttttgttttctatttaaagtgtgtttgacatcagaaaagactacattttatatagcagaaatatgagaaattagtctaagtagtttttaggagaaaatatgcattcttaatgttactgttctgagcatggttgagtggtagcatgtaacttttctgtacctaaaatttcacagtaaaaaattgaagtgctgtggtaaattattattaatactgtattgttctatgaaacaaactaagagatttaattttcgccattagtcgaggaccacagtaatttcattgtgtgagaacacaataaaaccaccacagcaccagtaatttgggaccaaaaaatctgaaaaaatatatattatggaaataattatttactgtaaagcaaaacttcttaaataagtatgttgaggagaaaactactataaatcagactttaagagacaataagtcccagaggacccaagaaatataaatcaagacaggaaatgtgattgtaaaacaaagagcaaagaactgtaaatcaaggctggatattccctaagagagacacatgaagcactggaaggattttagtcaaaaggtaggagagtttgtaccatgacggaaaagaatagggctaaaatttaaatatcagatagggaagaaactgtttataagacgtgtggtttgaactcagtaatcactacacgtttctcatcttcatattcagcccattgtcctccgtctcaattgcactttcatttctgtgatcctgctctcccaaacactgctatggctcctccccacttaactctgccctattgcctggccatgtacccaaccaacctcctcactgtgtcttccgcaaagcccccagaacctactactttgttattatcaaggtctcatttagccttactgtttccattcagtaggtcttccacatcctcatgttgatttacagcttacttgctacgcatgacacctcttgctttggctactgtcatgtataggcctctgggtcttgcgatccatgtatgatgcagtttcaatcctctaccactgatgtctctttccattgcattgacttatcacttctgttttaacactttttgaaatccatgattttaaaatacaaacatcttgccacgcctcccagtccttatcactttacaaacattcctccatattctaaagttcatggttgtattatggaatcaaaatttttctttctcctcatccattttcttacagggcatcaacgtcgaccacccgtttaactgtcttcagagttacttcacttatcatatttgatgaacttgcttttcatttgacctcaggcactcacacacacatgacagtattgtgaatttataattacccggaaatgctcaccccgaagatcttaaactccatatatttgtatcaaagaaatgttcagaatggtggccggggcggtggctcacgcttgtaatcctagcactttgggaggccgagacgggcggattgcctgagctcaggagttcgagaccagcctgggcaacacagtgaaaccccgtctctactaaaatatgaaaattagcccggcatggtggcgggcgccattagtcccagctacctaggaggctgaggcaggagaactgcttgaacccgggaggcggaagtcgcagtgagccgagatcgagccactgcactccagcctgggcaacagactgagactccgtctcggaaaaaaaaaaaaaaaaatggttactgagcgccatggaagggcactggaggctggaaagactttgtcgtatttttcatagataagacttttagcctcaacctcgtgtattttttaattcatccagaatttacctaatactcatttattgtaggactgggctataatggcacaatcgaaatgcattaaatcaaattgtaagaagagtaatttatgttaagacgtgtagaaccaaaagactagaatgcctatgtctatttgtcagtgcacgtttcttctgtacacataaaataattactgcaagtttgctttagtaaacaccagaggaatcatcaaaaggaaatgaacaataatgaataccataagtgaattaggatagcttggtacacccatctcctgccatgctctatggtcaggatgatgcctgtgttagacggtgctgaaaaatcaccaacaccttgtcattgtttggctctattttctctatgtgtgtatattagtccttcaacagacagttactagagaaagggatcaaactagttgattaggagacagccagagagcatgggactagaagagtgtccactatgccattttcttagccatgtggcttctacaagtcacttagcctctctaagccgctcaacttcttaaatgtgaaaagacaatgctatcttcctcttattagctatgtgaccacttaatgagataatgtatttgaaaatgctctgtaatttgcaaaactttataaaatggatatatgcatatctgttttaacaaacatgccaagccaagcaacatactgagattccttggtaaaaccacactataacttcacaaagaacgtatttacacactgcttaagatggatttcttatatgtaaataaccataatcattccatattaaagcttatgaaattctatttccaaaggtaacatattccacatgtttttcccagctgatgaagtataacctaagatctatatactgaccatgttccacccttctacatcatccgttctttgcctcagctggctgatctttgtcatcttccacacttgaccttcttgatttcttccctttacttagctggcttctctctcaaactgtctgcttccacatcagctgtcagcatttcctcactttgcattcagtttcttccactgccgataatcaactgctcaatttaacacttttaaaacttatctctgcaaaaataagaataacctcctaattatctcactcaatactctctttccagcactcaggctataagacgttgctgcaggatttgatacttcttaaaacctctcctcccttggtgtttacaacaatgaagaaaactgagttgacattcacatagaaaaatgaaagaaactaaaatctttttttgtaattatactttgagttttagggtacatgtgcacaacctgcaggttagttacatatgtattgttttaaagcattagcgaaaactctcaaataattgccaaatttcaggtccacttttcacctcaaatttgaaactagaagtgcaatactctgccataaccactgtcacaattctcaataacttccaacatcctgctcaaatatcagtttgagcttttcctgcccttttaatcactccctcctctataatcccaaattttggcttgtaatacagcatatatcagacccagaattgtagtattttacgcgtattaatctacctttacaggcttctacagagtccatgcaaacatgcaattcgttccacattatagatattcaacaatggatttttgaagaaaaaactgatgtcataatgcattaacccactctatgttattttcctgaaacatgctattatgcaaaaaatactaaaattattgtaaaatcaaagacatgtatcttaagattattcaatggttttacaaatattaggcaattcaaatttggatatttgataaacactgggtttctggaatttagagacaaggattttaatgtgactgttttaatgaagcaacacaagtgctaatatttttatttatttcacaactgaattgaagtaaataattatttccatcagtaatgggaaataattcttttctgaaaagaagtagactagtttgtgggctcttagaatccttcacacactatggttgaagttgattggcttatcattccaattcttgtgaacaagtgacagagagtttgtgggctacacatcaagtttaagaactcaggttataatctagttccaaaaggcagacatagcagatgacggtcactttcacttgagactccaggaatttggtctatttagttcattttgtatatatgtgcttttgttggaagccaaggtggatttgttccatgccaaaaatcaattatcatccatattttaatttactgtccagaagaagatgcagtgccagatgctaccgaatattagtcactttcttatttcaaaatgaaagacaggggagggggaaagatgttggtcaaagaatacaaaatttcaaaatttcaattagataagtggaataagttcaggagacctattttataacaaggtgactatagttaataacaatacattatatctttaaaatttgctaaaagaatagatttgaaatattctcaccacagaaaagatatgtgagataatgcatatgataactggctcaatttagtcattccacaatgtgtgtatatatatatttcaaaacaatacgttgtacacgatacaattttgtccatttttttaaaaaagaaaaattttaacacctttcttctattttctatttttaaaattactggattctgcttatatttgatctatgcttactataaaagtttacgggatatttttggtaactgcactttcaaaactcttaattataactcttgtacatatgctgataagagtaattagtcaaatgttttcaggttcacttttcaactctgtcaaacacttttataagctatcatttggatcattttttctctcctccttcaaaaaattatagaaatcgctgtgaattccaaatgcgtgtctgttttattctgttaaatcagatacttatactgacaacctatcaatacactaaattagtacatgtagctaacaagcatgtacaagtttaactgctgtataacaacatttaacagatcaacaaacacaacagcttgtctctgcagggtttaataaaccatatttatccacagcatctgagaaaaacagaagagactctgatatatgttatgttctttttataagtacatgaaaataaatatgtaaaagtaaatgtggtttctatttctattcgtgagagtagaatgtactaactgaggtcataacttgaactgaggtttcattaagggggaaagcactttgtcttttatgttctaaaatagacttcttgataaagaaaaattatgcttaaagattaattaataactggctggcattataaagtgttgcaatgttaaattataataaatattgattttaggaataagttttgaatattttatttttacattttctctgtaaatttgtgttagtccatttaacttcaaaagtattcttcaccacattatttaaggatcacacttaataattttccactaaaagaatcctgtttaacagaagtaatatgatgtgataggttaaaagcaaatattttgatattaggcaagcctgggtttaagccccagttcttccacttgttaattaagtggccttgagataattcctctgtcttccttaggcttaattccctaacttgcaaattggtgaccatgacagtttctgttttcaatggctgttatgaaaattacatgagaaagtaggtaaagtgctaagtagggtgcccatcctataacgtcctataattagcttcaactcttacacctcctcaacatctgttgctgttataattgttatttattactattgtaacaccaatgaagaaatactgttattgcaaaaagcatttgagaaattgtgaagaaaattaccaattttttaaaaggcaagttgaggtgaaagaagaagaagctaaagcatttggaatgagttcagtaagtttggtgaagtaaagacaattgaacagatacaattagaccatgtcaaaattgttaacattaatgtaaccccaattaacctttttaaaaatataaatagccataaaagttaattaaggtatttactctctttaaggagggagaagtacaggtgaggacgtattaagacactgaaagggtagaaaggatacaggtgctgagcagttgttatgcaagaactatgctggatgtactttcctcagaacacttccataagatattaatatctatattttgcaaataaagaatctgaggttcaaaatagccaagtagtttgtccaaaggtcacatagctagctaattgaagaagctggaattaaaacccaggtttttctaagccaaaagccctttatagttctgtcttcagttgtgtgagattatgaatccaaaggtggaaccctgagtatgaaagggagagtcctgaaataggaaaagttaaagaactgaagaaggcttttatgttttactcagatttttctctttaaaattggttataagttatgacataaagtttaaaatattagatgatattccaactttctctgttttgatgttataaaaccttgtgaactgggactccaaaattattgacataagctgggaatttattctaaactgtgacatatttgctctaaactagacttctaaccaactgaaattcaatgacttctgaaatgtgggttctcattcaactagacaaaatgtgtcagccagaaatgtatgacacagtggaggccagaggtttttacagcagcaagtccctaaaaaaacaacaggatcaaatatgctatttttaaaaaattacccaaagatagtttaaggtctgtgctcttagtataattcccttttgtctcactttacattgggatactttcaaatctcctgctaagtggattgacattacaaatgactctaatacagagcaggtttttcctgaactttcctagacagtcaagtggagagatttctaaatataaaccatcttattcatggtttcattgctgtatataaataaaacctgtcccaaccctgtatgaatttttaaataattttcattaataatctcttgggcagcttcagtctcactgtgaaggattcactcttgaacatttcgattgactcaattaattgtcaatcttatttagaagttctaaataagagagatagctattataatttgtgaatgatgcagctagagttgcaaagagtagctcattccatacttcatcactcatttttcagggtatattaacaatgtctttacaaaggtttgattatatttctaaaatgaggtaactctagaaagaaaatatttttgaagctgttcctctctctttttctcactacaagctctgtcccctaaggcaattttatctgagggttcagcacatcatctaaggatataaagtagtcttgctgcttaagcaaatgaggcattaaggctgttttgtattcctgtgggctatcactgtctgtactgacaatgcagtggtgcctgctgcttgagataggggtaggaagggtggtttggaaggggattgcacgtgtgtgccataatgaatctgttttatctttgaacaattccatatgctcttgtgaagctatcaattctttcttttcctttttttttctccttttaatgccaagataaattgatcctagattgctgctccaaatgctgacaccactgaatatgaaggtgtcattgtaaaatgaaccatagcaaattcttaataagcaagcttcacaaagagttatagtttttgacattcagatatagacttatccccagtgaaggaagctttgttcagcccatgcatgctaagaggaataaaaaataaaaagtaatttgattggtattaaatatgttttattccttcctatattgagcaatcatatcacatgacttgtccacttccatcttacaggaaaattggaaaaggaatgatttcaaatcaagaactttatttctaaaaaagttggaacgagtttagagctaacgcttccagtgctatctggaggagatttaaaatctgacttccttgaaaacttcaaaatcagttgtgtctgagaaaaacaaattagtaaattctatagaacatatgctataaaaacaattactaaagttttctaagctgattatttcaggctaatttctcttctaaaaattagtatatcctagggagcctactttctaaattaatgggagcaaatgcttagaaaacacttttatacttgataactcagtttggaaaaaaagaatatgggaattagctctatgatgattattacaatttacattatcttgaacagagaagaaacagaccattttgataagttcaagaacattaacttttttttctctttacaagtcctgcataaaaactcctcaatggatgttgctttaaaaatatataaaaggcaggtgtggtggcatatatctgtagtcccagatacttgggaggctgaggtgggagaattccttgagctcaggagttcaagtctatcctaagcaaaatagtaaaaccccatctctaaaaatacatatatattttttaacatacagatatgctacaaatttaagacagtttattaatttatatgtacaaaagcaacctacatatttaagataatataatcagtaattataatataatataatcagtctgatatgaagttttgtcttatatttccagctgtgagcaactttaaaaggaattcattaactaactttattacagtatttccagaaaatagttattctgtgccacattggtttggtgatgcttgattagacttttattatgaaatcgactcttgtgtctccaaataataactgaaaatgcaaacatttcaaaaagttttaaccctagatatattctcagtataattcaacctgttatatataaattggctttttgtaaatagattccatacaccaagaatgtctagatttcaatgcattctgcattaagtccttctgtaaaacaaataattgttttgcttattaatcataactttggatatctgtttgcaaattggcatcatatttgctcacagttctgcaattcgtctttttctctaaacattgtgtttttgaaatttatccatgtttatatacaggtagctctagttcattcactttaaatgcttcacagtattccatcgtaggaatgcattaagatgtgcttattattttattcatgggtatttgtattgctttcatctatttgctgttaccataatgctaaaaaaaattattgtacatatctcctttggcatgtatgcaagagtttatctgagagaatatacctgaattggaaacacggaatttatggcacaccttcaacattaatggcaaatagcttctgaaagtgtttgtatcaatagatactacctcagcaatttctggaagtttcccctgctcattcatttgttcatttaataaatatttattgcacattcatgtgacagactgtgttctagaaggggatgtatagcagtaaaccaagtttataaaactctctgtctaaatgcagtttgcattctaatgtggggagacagaaaataaatataaatacataatatctcaattgggagaagtactatggataaaaatgaagcaaggagaggaataaagagtgctagaataggagatgcaattttaaatacagagatcaaggaaaactgtactaggaggtgatatttgagcaaataactgaaaggggtgaaggaaaaaagctatacattttcactcttacttgatattatcacactggttaacttgtgttagataaatgaaggtaaaaatttgtctcattaggatttttaatttttttctgacatcaagcatgtattcatgttaatttaccgtttgtgttgtccctattgtaaattgctagctaatattttaactcatttttctaaagtgttactttcctaattcttattgaataggagagatccattattaaattttgggggtatatagtaggtgagtatatttataaggtacgtgagatgttttgttacaggcatccaaagtgtaataatcacatcagggcaaatgaagtatctatcacctcaagcatctattatttctttgtattataaccattccaattatactctttgagttatttttaatgtataataagttatcattgactgtagtcaccctgttgtggtagcaaatactagatcgtatttatttttttttatatgtactttaagttttagagtgcatgtgcacaacgtgcaggttagttacatacgtaaacatgtgccatgttggtgtgctgcacccagtaactcgtcatttaacattaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgagatagtttgctgagaatgatggtttccaccttcatccatgtccctacaaaggacatgagctcatccttatttatggctgcatagtattccatggtgtatatgtcccacattttcttaatccagtctatcattgttggacatttggcttggttccaagtctttcctattgtgaatagtgccgtgataaacatacgtgtgcatgtgtctttatagcagcatgatttataatcctttgggtatatacccagtaatgggatggctgggtcaaatggtatttccagttctagatccctgaggaatcgccacactgacttccacaatggttgaactagttggcagtcccaccaacagtgtaaaagtgttcctatttctccacatcctctccagcacctgttgtttcctgactttttaatgatggccattctaattggtgtgagatggtatctcattgtggttttgatttgcatttctctgatggccagtgatgatgagcattttttcatgtgtcttttggctgcataaatgtcttcttttaagaagtgtctgttcatatccttcacccactttttgatggggttgtttgtttttttcttgtaaatttgtttgagttcattgtagagtcttgatattagccgtttgtcagatgagtaggttgcaaaaattttctcccattctgtaggttgcctgttcactctgatggtagtttcttttgctgtgcagaagctctttagtttaatgagatcccatttgtcaattttggcttttgttgccattgcttttggtgttttatctttctaactatatttttgaactcattaattatccccacttcccttcttcccaccactaccctccccagcctctggtaaccatcatcttgctctttatgagttcaatcgttttcatttttagctcccactagtaagtgagaacatgtgaagtttctctttctgtgcctggatttttttcacctaacataatgaccttcagttccatccatgttgtttcaaatgacaggatctcaatttttatggtcaaatagtactccattgtgtatatgtaacacattttctttatcaattaatctgtcgacggacacttaggttgcttccaaatcttcactattgtggctagtgctgcaatatacataggagtgcagacacctttttgatatactgttttcctctcctttgagtatatacctaggagtggggtggctggatcacatggtaactctatttttagtttttaaggagcctctatactagtctccataatggctttactaatttacattcccgctaacagtgtacaaagattccttttgctccacatccttaccagcattggttatagcctatcttttggataaaagccattttaactgggggtgcaacggtatctcattggagttttaatttacagttctctgatgatcaatgatgttgagcacctttcacatacctgtttaccattcatttgtatgtcttattttgagaaatgtctattcagatcttttgcctagtttttgttttgttgttgttgttgttttgtttcttttttctttttttttttcttcttcctgaaacagagtctcgctgtgtcgctcaggttggagtgcagtggcttgatgtcagctcactgcaacttccgcctcccaggttcaagcagttctccctgcctcagcctccctagcagctgggattacaggcacccaccaccatgcccagctaatttttgtattgcccagtttttaaatctgattaatcgatattttcctatagagttgtttgagctccctatatattctggttattaatcccttgtcagatggatagtttgcaaatatttttccccattttgtgggttatttcttcactttgttgattgtttactttgccatgcagaaactttttaacttgatgcaatcccttttgttcatttttgcttggttgcctgtgcttttgaggtattattcataaaatctttgtgcagaccaatgttatagagtttttccagtgttttcttttaggagtttcatagtggaggtcttatatttaagtctctaatctattttgattcgaattttgcatatggtcagagataggggtctagtttcatttttctgcatatggatatccagttttcccagcaccatttattgaagagactgtcctttcctcagtgtatgttcttggcacctaagttggaagtgagctcactgtggatgtatacatttattcctgggttctctattctgtaccattagtctatgtgtctgtttttatgccagtaccgtgttgttttgatcactatagctctgtagtataattggaagtcagttaatgagatttctctagttttgttcattttgcaccagatgactttagctattctaggtcttttgtggttccgcataaattttaacattgttttttctatttctgtgaagaatatcattggcattttgatagggattgcattgaatttatagattgctttggatataattgacattttaacaatattgatacttccaattcatgaacatgaaatgtctttccatttttttacatcctcttcaatttccttatttgtgtactattttttatgtcctcttcaatttccttcatcactgttttatagttgttttacagatctttcacttctttgattgagtttattcctagatattgcatcttatgtgtacttattgtaaacaggattatgttcttgattgctttttcagattgttcactgttggcatatagaaatgctactgatttttgtatgttgattttgtatcctgcaactttactaaatttgtgtatcacctctaatagttttttgtggagtctaggtttttccaaatataagaccatatcatctgtaaaaaaaggataatttgatttcttcctttgcaatttggatgccctgtatttctttctgttgcctgattgctctagcaaggacttccagtactctgttgagtaacagtggtgaaagcaggcatccttgccttgatctagatcttagaggaaagactttcagttttcccattcagtataatattagctgtaggtttgtcatatatagcttttattgtattgaggcatgttctttctatactcagttttgtgggagttttattatgaaggaatattggtcaaatgcctttttatcatcaattgaaatatcatatgatttttctccttcgttctgttaatatgatgtatcacattgattggtttatgtgtgttgatctatccttgcatcgccggaatatatcccacttggtcatgatgaatcatctttttaatgtgttgttgaactcagtttgctggtgtattgttaaggattttgcatcagcattcatcagggatattggccagtagttttccctttttgttgtgtctttgtctagcttagtttcagggtaatactggtctcatagaataagttgggatgtattctctcctactctattttttggagtactttgagaaaaattggtattagtatttctttaagtgtttgataaaattcagctgtgaagtcatcaggttctaggcttttctttgctggaagactttattacagctttgaactaagtacttgttattgatctattcaggttttgaatttctccctgcttcaaccttggtaggttatatgtatctagaaatttatctatttcttccagattttccaatttgttggcatatagttgctcatagtagtctctaataatcttttgaatttctacaatatcagttgcaacatctttttcacctctgattttatttatttggctcttctctcttttttcttagtttgtctggctaaaagttttttgattttatcttttcaagaaattatctttttcttttattgatcttttgtattttttgttccaatttcatgtgtttttactctgatctttattatttctttcctcttactaactttgggtttggtttgttctttcttttctagttctttaaggtatatcattaggttatttatttgaagtttatatacttttttatttaggtgcttattgctgtaaatcttcctcttagtattacttttgctgtattccaaaggttttggtatgttttgtttccattttcatttgtttcaagacatttttaaatttccttcttaatgtcttcattgaccccactgatcattcaggagcatattgtttaatttccatatgtttgtataattttcaaaatttcttttgttattgatttctagtttgattctatccttgtcagaaaagatacttgatatgatttcaattattttaattttttaagacttgttttgtagcctaacttatggtctactgaatgaaccatgtactgaagagaagaatgtatattctttagccattggatgaaatgttctttgaatatctcttatgtccatttggtcatagtgcagactagtgtgaaacactagtccagtgtttctttgttgattttctatctgaataatctttccagtgctgtaagtgggctgttgaagtctccagctattattgtatcaggggtttatgtctctctttagctctaataatatttgctttatttacctgtatgctccagtgttaggtactgaattaacccctttatcattgtataatgaccttctttatctcttttcttagggtttgtcttgaaatttattttgtctgataaaaatatagctacttcttatcttttccgattcccatctgcatggagtatatttttcgatctttttatttgcagtctatgtatctctataggcgaagtgtgtttcttgtacatgagagattgttgaatgttgtttttttaatctatttatccacgctatgtctttttattggaaagtttagtccatttacattcaatgttattattgacaagtaaggacttactactgccaatttattatctgttttcagattgttttgtggtcttcccttctttcctttctttcctttctttccttcttccttccttctttcctgtcttctttttgaggaaatgatttttctttgatggcatattttaatttcttgctttttattttttctgtatctgttacagagtttttgatttaaggttatcatgaggtttgcaaataacatcttataacccattattttaaactgatgataacactgattgcaaaaacaaacaagcaaagaagaaactaatgaaaactacactttaacttcatcccttcttttaagctttcagtagtttccatttatatcttactgttttaagtcttgaaaagttgttgtagttgttatgtttgacagattcatctttcatctttctactcaagatacaaatagtttgtacaccacaaatacagtgttataatattctgtgtttgtgtacttgctattactagggagttttgtacattcagatgatttattattgcttgtttacttccttttctttcagattgtaaaacaccctttagcatctcttgtaggacaggtctggtgctgtcaaaattccttggcttttatttctcatggaaagtatttctcctttgtgtctgaaggatatttttatgggatataccattctaggataaaaggcttttttccttagcactttaaatatgtcatgccactctctcttggcttgtaagttttccactgtgaaaccagatgtattggaggtcatttgtatgttatttattccttttctcttgcggcttttagaatcctttctttatccttgacctttgggagtttgattattaaatgccttgaggtagtattctttgggttaaatctgtttgatgttctataatcttcttgcacttgaatattgatatcttcctctaggtttggaaagatctgcgttattgtccctttgaataaactttctaccctagtcttactccgtgtctcctctttaaggccaataacttagatttgcccctttaaggctattttctgtatctcttaggtgtgcttcattcttttttcttttatctcttctgactgtatgtttaaatagtctatcttcaagctcattcattcttttttcttcttgatcaattctactgttaagagactgatgtgtgtcagtatgtcagttgcattttttagcaccagaattcattaatttttgttaattattttaatctctttgttaaatttatctgatagaattctgaatttttttctctgttatcttgaatttcattgaacttccttaaaacagccattttgaattctctgtctgaaaagtcacaaagctctgtcactccaggattggtcactggtgccttttagtctgtttggtgaggtcatgttttcctggatggtcttaatacttgtggatgtttgtcaatgtttaggcattgaacagttaggtacttattgtagtcttcatgatctgggcttgtttgtacccctctttcctggaaaagttttccaagtattcaaaggaattgaatgttgtgatttaaatcttcggtcaatgcagccatatatacattagggggcaccccaagcccagtaatgctgtgaccttgcagcctgttagaggtactgccctggtggccttgggtaagatccaggaaatttccttgtattacaagacagagactcttgttctcttcctttacttttcgctaaacgaatggagtatctctttctacggtgagctgcttgatgttgagggacgagtgacacagcactgctgtagccaccatcactgggactgtgctgagccagacctaaagccagcatagtactgggtcttgcccaaggcctgtaacaactattatctggctacaactaatgtttattcaaggcccaagggctctttggtcaacaggtggtaagtacagccaggcttgtatcttttccttcaggacagcaaattcctttctggcccagggtgggtcttgaagtgctgtctgggagccaggacctggagttgagaactttagaaatctatttggtgctttattttactgtggctgagctggtacccaagttgcaaggcaaagtcctttttactcttccgtctcctttcctcaagcaaaaagaatctctccccatggccaccactgccccaggcccatggtgagtactgcctggctaccactgatgtttattcaaggcctaagggctcttcagtcagctggtgttgaatcttgccaggactgaatctcccccttcagagaagcaggttcccttctcacccagggcagctgtagaaatgctgtccaggagctaaggcctggaatcagggatttagtgctttaatttactgtgtctgagatggtgcccaagttgcaagacaaagtcctttatactccttcttccttttttgtcaagtagaaggagtctattttcatggctttcccacctgggaatgcactgggtcagacctaaagccagcacggtactgggtattgcccaacacctgtgccaagtactgcctggctactgctgatgtttattcaaagtccaagggctttttagtcagcaagtgatgaatccttccaggaggaaatccttctcctaaaggcagagggttcccttctggctcagggtatgtctagaaatgttgtctgggagctagggtctggaatagggacttcaagactccgtttatgctgtattttactgagattgagctggtatccaagttgcaagacaaagtccttgcccaggaattgctgttcttttggcttagactgcctttcaagcttatttagaaccccagagcacttcagcccacggtggtggggcttgataaaactcaagttctgaccagtgggatggatgattcccctctggctagggatggtctaaatgctacctctgtgtgcgccagctgaattctgccccatattgctctccaccatgacagggtagcactgagttccagtgcaaagtcccacaatcagtgctgtttccatcctgcaagcacacattctccatctgcaccacatggctgctgctggggcatgggcgggtggtggtgtagacaattcaagactgtctttcctaccctcctcagtgcctctttcctcgatacaatgttaaaatcaggtactctaagtgctcacctgatgttttaatcttatgaagctgttttcttgtgtggatagttgtaccgtttggtattcctatggtggggacagttgctggaaggttctattcagccatcttgctctgcctgtgctctgagagcttttcagtttttttgttgttgttgttgttttaatacattagggataagattcctttgttgttttcatgtgttacaaatatcttccaccatttttggcttaactttttacatatttacaatattttttcacacagagaagttcaaattttattattacttttattgaatttgccaatcttttcataatggtttatatttctttcttatttaagaaatcaatccctatcttatatatttttctccaaatattcttatttctgttctttttcacattttatctttaatctacttggaatctatcttttagtgtgctgtgaaatagtgatgcaattataagattttcttccatgtagataacaaattacactatcatcatagttgtatttttaatgtacagattgtatctctgcttaaatgtaatttgcagaaagaatgtcttaaccattcccattgagttatatcccacttttatatgtgctataatgttttataattctccttcttaaaaatcaaaataattttaaataattgattattcatgtaattatttattaatttctggtttcaccccttctcctccccaaaattataaatttcatgaggacataaaccatctctcacttaaatctataaccttggtcctgacgtggtacgtaattcagaataaatgcctgtgaaagtattcaactgatacataaataaattattttatttccataatgtgtgagatgaaaatacattgatttatgatgccttgagtttttaacaaggctgaaaataaccttaaattttccacgatttatgtgatactgagtaaacgctactgcttgaactcttattataagttttttatttgtttctaaaaggcttccacttacacagctggcttcttccatccaatttgtaagggtataagagatacaataggtatccagtatgcaagtcagtaagacatgtaaaatctgtgacatcgcatcctacctcccacctggccaatttatctacaattacatagaactgtatatgagccattttcctgaatataagagttttttgttatgttttgtttttaccttttgggttcttgaaatgagttcaacttattaaaatttgggaaattctttccaaataatttagatgttagacaatgaatttctaatgattctcaaggtattacttctttaaagttggaacagaatgtgtaataatcttttctttttcagtaaataatataagttcattttacaaccagttgctcacctctagcctagagtaccttcaatgtttccagaattctgggctgtcagtttttgacattttaaagtcttatcctgacagtttgtttgttgttgttgttcattttctgccttttaaaaaaatagttggggagttcaggtggacttcataactttgacagagatcttaaatgtggaatttatttatttatttatttatttatttatgcattcaaatatttaatgagtgcttactatttcccattgattattctaagtggagaagatacaatggtgaaaaagacatgcaaaattcctgcactgattgcgcttatattgttctagggaggtacattacaaaaaaaaaagattatataatgttaggttgtaagaaaaatagattattgggatagagagtgacaagcagggtgcttttttagatagggttaccaaggaaaagaataaataaaccctaaaacaagagttttactttacaatcctcaagagcaaatctggtgaatgtcctaatttactagtatcaaactttttcactcaaaactccagcttaactaattcacacctgttctttcccaaaactcttcatatgtttccattttctccatccatatatttgtaaaagttaatactgcatcctcaatctatgttggtattcatatgctttttcttatactttgccatcttttcatttttttttattgtaagttcaggggtatatgtgcaggatgtgcaggtttgttacgtaggtaaacatgtgccatggtggtttgctacacagatcatcccatcacctaggtattaagcctagcatccattagctattcttcctgatgctctccttcctcccccacccccaacaggccccagtgtgtgttgttcccctccctgtgtccgtgcgttctcattgttcggttcccacatgtaagtgagaacatgtggtgtttggttttcttttcctgtgttagtttgctgaggataatgtcccccaggtccattcatgttcctgcaaagaccataattctcattcctttttatggctgcatagtattccatggtttatatgggccacattttctttatccagtctatcatcgatggacatttaggttgactccatgtctttgctattgtgaataatgctgcaacaaacatatgtatgcatgtatcttcataacagaatgacttatattcctttgggtatatacccagcagtgagattgctgggtcaaatggtatttctgccgctaggtctttaaggaattgccacactgtcttccacaatggttgaactaatttacactcccaccaacatttccttttgctccacaacctcaccagcatctgttgttttttgactttttaataatagccattctgactggtgtgagttggtatctcattgtggttttgatttgcatttctctaatgaacagtgatgttgagctttttttcatatgattgttggccacatgtatgtcttcttttgaaaagtgtctgtcatgtcctttgcccactttttaatggagttgttggtatttctcttataaatgtgtttaagttccttgtagactctggatattagacctttgtccaatggatagattgcaaaaattttctcccattctctagattgtctgttcactctgaggataatttcttttgctgtgcagaagcccttcagtttaattagatcccatttgtcaatttttgcttttgtttcagttgctttaggtgtcttcctcatgaaatcatttcccatgcctatgtcctgaatggtattgcctagattttcttctagagtttttatagttttgggttttacatttaaatttttaatccatcttgagttgatttttgtatatggtgtaaggaaggggtccagtttcaattttctgcctatggctaaccagttcttccagcagcatttattaaatagggaatcctttccccattgcctgtttttgccaggtttgttgaagatcagatggttgtaggagtgcagtcttacctctgcattctctattttgttccatcggtctatgtgtcttttcttgtaccagtaccatgctattttggttactgtagctttatactataatttgaagtccagtaacatgatgcctccagctttgttctttttgcttaggattgtcttgactgttcaaactcttttgtcgttccatatgaattttcaaataggtttttctaattctgtgaagaatgtcaatggtagtttaatgagaatagcatcaaatctaaaaattgctttgggcagtgtggccattttcacaatattgattcttcctatccataagcatggaatgtttttctatttgtttgtatcatctctgatttctttgagtagtggcttgtagttctccttgtagagatctttcacttcactagttagcaatattcctagatattgtattctttttgtggcagttgtgaatgggagttcattcatgatttggctctcaacttgcctgttgctggcgtataggaatgctagtgatttttgcacattgattttgtatcctgagactgctgaagttgtatatcagctggagaaacttttgagctgagacagtggggttttctagatatagaatcatgtcatcttcaaacaaagctagcttgacttcctctcttcctatttgagtatctttatttctttctcttgcctaattgccctggccagaacttccaataccacattgaataggagaggtgagagagggtatccttgtcttgtgccagttatcaaggggaatgcttccagcttttgcccattcagtatcatattgatactttgccatcttttcaaccttcttatttcctagatatgtgcccacttatatgctgcatataattctgcttacctggaaccatttaagtatgcatgtacttgggtatataagagtaaatatgtgtatataaacctgtaggcagcacagtcagaactgtgtttacatatgcacatacacacatgaattaaggataaaagatatagaaaagatgagggaaacaactatcctgagcattgctagatatttccaaaataattacgtattaaaattgaattatcattgcagagccaaaacacagcagggggcagagttcagaaatgttcctctaggtcagctgtgccagttctgtaatctgtgagcaaattactcaaaatatagcagggacataattaaatatttcaacactattgtcaacagaatatattaagcacttaactccttaaaaagacaataattgtaatagtggaatccactttatactagtcatactcaattcagcttttaaatgttatctatttaaaatggacagttattacttacaatatatatgtaagtataaatatatttaatatgtatgtaaatatatgtgctatatatacatttataatgaaagtatacatatgatataccttttaaaatcaatacatacttaaatattaagttagctctccctccttcactaatactagtcattctagcatgccttatatctactcaatttcttttcaatttcaacatgaatttaaaagttattgcttaaatctaaggaatttaatatacacaacagaactttataaatgtattcaaagaaagggtctctagatcaatgcaaatttttttctttagatcattactaaaaacgcatagtcagggtcaaaatagagctggaattctttttacctatatttaaaaagtatgcagtgaaaagtattcaggctcaactagataaagaagctttacagagtgctttatcagcttcaataattaaaagatttcctgctaactattcaataagagtcttctttatagctctgctttgcagtcagttctttccatcacttcctttgaaaagtctaattaaagtggaaggctttatttctattcattccgtgtttgccatattggacatagatactaaaataactaattaaagactatattggctctttttaaattcttgtcctgttggaactttatggggtatgggagtggaaggagaagtattttctcagttttagtttttaaagttggttttttattgtcactctctcaatattaattatcttttgggttaatggaagtaatatggataactttctccctgatgcctgtattgatgctgtaataggtgttttttttttagagtaactgactagtgaagaattgaaactaaacacttcagagcccttatattccccttgttgtattactggagcattacttaagcactgctaactatcttttaaaaatatatttgctgtagtgttcaaagaaacttgcatggaaaaaaagccattttctacttcccagaaacagatgttttcttttttgtgtgtattttcgtctatatttataaccatacgtttaagatcataataattatatgctgtatatggcttacaaggtttttcttttccttattctaattataaactctagccagtaagtgtctccataaaggtgatacgccttttatagaatcaagtgctaagataaagaatcttaaaagcttattttttactgttagaatataggcagttgaagggttaaaacaagtcaaccataattcaatgagaacattctggcccttactacttactatcttgagagagttataatagagtaagaaacatatttatgcaagtgagtgtaatacaggaaagaatatgatgttgttaagatgtagtacaaagtgggctgggtgcggtgacttacgcctgtaatcccagcactttgggaggccgaggcaggcggatcacgaggtcaggagatcgagaccatcctggctaacacagtgaaacctggtctctactaaaaatacaaaaaaaagtagtacaaagtattttagaggcacagtgctttgtagttgatcaatgaaatacttacagaagatttcaaaataagatacatatggatgtgtacttgtatatatacccctatatgcatttccaggaaaatggaatcataaagatttggatacaaaaaaattattttcatttatgtttggacatgaggaaggaagagacatactctagaattctatcagaagattgacattgcttgagcaactgctcagtcatacctctgagaatagtcattttaaataaaatgacaacttttaagaaatactccatattcaggcaaagttccaatgacgtaatggtcagaaatcttaagttgatgcattttagaaaaagccaaggataccttctttgaagatatagtttgctttaattttattttaagttccatgaaggtaggaattttttcttttttgtttgatgattcatccaaagcacctaaaacaatagcttttacacagtagctactcagtaaatacttattgaacaaatgttgaatgaaactcttggcacatattttggtttcaatccattcctgatggccagacaactgggcagaatcatggactgaattctttaaaaaaaaaatccgtaggaatcaatgcagtacagaggataaaacacaaaactgaaagtcaagacatttgagttccgctgataataactagttgtaagatgatggtcaaatcatttaatcttccatccaagaacattctttctcttctcaaattctatgagtcaattttcagccccacttataactcttaaaatttcatagaaggttatccaagcttttcatgcatcaaattgtccttgtgataaagataaatcatagctgatgatggatgattaaataaggaaatataaaaattctttgaaagcttttggatgataatatttatatattatacgaaatataaatgttatatatattaagtatatctatgtgaagaaaatgtgacaattccattcagttatgtaataacattttaactttgataatatattacaaatatttcagattaacataaacacttaaaagagaaaaaacacttaagatttattttcttccctatagatctagctatctatatatattaagttgaatctaactcaattttacaagtttgacaagataaacagaagaatctgatacaaacttatgtagattaagcaactgcaaatttgtgaaaagttattttttctaatcttgggttagaataaaaccagaagacaatggtagattttatttcaatccaagggacttttttttttaaggagaaaactgctaaatgctccaaaggctcatctttttatagataaagtgattttttttcttgcccacatcatagcttttatggtattttggattttcattttcaattcacagaagggctacttccgctcacaaggcagtgttacacattttcaaacaatgaaaaattacaaggcatcaatcagatccatagggaaattgagtttctatgatgaaatctatagttttactacacacttaataaatacttaatactaatgatgatctcatacccactcatcactggacctaaatgtttgctgcaatatcctccacatgattccaatagtctgagcaagactcacaaaagccaggtcactaagcaaatacacagtgcagtatggcatgggcagttagttccagcagatagaacaagcatcttttcctggacatttcctgtgcagtctgattgactccctgatgtttcccattcactccaagctgctttttccctcctccattcaaaattgcagaattctctccctggtctcaagctgctgtctctattcttaaactatatgctcaacttcctaccaccccaccttattttttgatgaagtctgtttcatcatagaatccttaaataacaaatctcatagaaaagagtctactctgctcctgtgtataacattagattttaatgatatgaaagaacaaagtccaatagttggtttggagagtgagagcccccaaaaaaaatgactacaagaagagaacaaatgagtacatattaagaaatttccattgcaggccattcattcctgatagttgtagctctctatctcattttaaatgataggcagcctcaatcaacttttgatgcaatattaaaaagaataggaaacaatgattatgtagcaaccaaggtcttagatggtccagaaaccttatattaatctcttcccctaccaaaatttgaggccaaacatgctaaagcatgtagagtttgctcatttaattttacctcctttcattttctcttttcattctttgaataaaatgacaatatttcacgaaacagtcaggaagtaaatacagaataatagaaaagaaaatggtcacagacacctgctgggcattttctatacaccaggtactgtactgagaattttgcacatattggaatgatgcatctgtatgcttcacaaactgatatcattaaatggaccctgcttgcaagaagcaaactccaaacaccttctttcaggttattggttagtcatataagaatcagcaaacatgaactttcttttttccatcaagtcaaaagggcaaaaggaggaaagtttaatcactacatagtaatctcataaaatgtagagttctgcgtaaacataagtcacctaaaaaatctctatgatgggactaatagataccttcaatgggtttataaacctccagtgctttgtgttacagagcatagcaagaacaacatattcgttgttgttgttgttgctgctgctgctgttttctcctcccagtgaacagtttggctgtgcaatttataggatgaacacaagatatgtttgcatcctgagatttgccagtaaaacattctcaagtcctttattaatccccatttttaaaaattcagatcattctaattatactccatcactcaacgaagttttacaggaaatcaaagaatttgttttcaatgactgaggacaattaaacttggttgagtctgaaactttgtgatgtgtatttcaaaggtctttctcaataaatttttaggttgtggtgtatttatcagcctaacaaaaggattaatatagctcctaaaaagggataaaatattaaatagtcaaaaagggatcgaatattaaaaaatgtaagttaggtaatggatggatcaaagtgtcaataaaattgaagacattcttagcaacttaaatactttgaattgggtggttagaatttgttcaccaggctaactatgtgtgcaggaagaatttttatatttcaggaatgtctaggttaacaaaagctaaatattcagatgtaataaaggaaatagtttttagtcctggtgtctaaagtgaaaaagcattaattcaaatcccaactccaccactgatgagctgttgatcttatcaaaccttttaggcctcagcttctttttctgtcaaattgttataataatggtatctactctctgtgattggtgtgagtattggaaataatgtatataagatacttagcatagtgtctgtcaagtcataaaaatgcaataaaagttagttgctgttgtaactgtatacttttagcatgtttgtctttaaaagacctataatttatttatttaattgctaaaatttgtctccatttttcttgttcagagattgttttatttaatcttcataataacaggattaagtgagaagagtaaattctctaatttctaattctatagttgaagaaacttgaaatcaagaaaaagaggagaaaataatttcttttttcttttttttttttttttgagacggaatcttgctctgccgcccaggctggagtgcaatggcatgatctcagctcactgcaacctccacttcccaggttcaagctattctcctttctcagtctcccaagcagctgggattacaggcatccaccaccacgccgggctaatattttgtatttttagtagagatggggtttcaccatgttggccaggctggtttcaaactcctgaaagtgatctacctgcctcagcctaccaaagtgctaggattacaggcatgagccaccacgcccggccaataagttgttaatattatactaagtactagttatttatttactatatactttataccttatcacatttaaccccaccccaaggttatatgctagttattactcatgaattacagatgagagaatcaaggaaattattcagaatcatatcactagtgagttacggaccaggaactttaacacaaatttctaaactcagaaacatattctatgttatttctaataaatatggccttatcactaatcaacacatcagtgtcacttcaaacacatatctagaatcaagttcatactcttcacaccttctaatctttgtgtccccccaaaaaagaaactatctcctagattcttcatctatattaatggttttacaatccacccaatcactcaaactgaaaactgccagttggccttggcctcccactttctcaccacccatatttatggatcacttcctgagagttctctctggacggacttgcagctctgtctcctgctctccatctccactgttataacctaaggtactcatcatctctgcctcatattttatcatacactagttccttattctggagaattgaatacctttacaaacaaagcagccatacctatctttctaatgcatagatctatttgtttcccctactaaaaagttttcaatgtctcttcattgccttcagagaaaattctaaacttcttccaaacagatactgaaaaccatgtaaccaccccaggttatcccactccaacttctctgtgttctgggtacagtggtaagtggtgtttcttaaacatatttacatctacttactgtttttatgattttctctttgtctgatatgactttcatcaattggatagggtaagcttcaacacattattcaaagaccaagccatcctccacttagcccctaccagaatgaatcatgtgtttttccatagtgttttatacctgttgctgatagaacttcattcatcctatgctattacggtcagtcattaccatgtgagtaactcttgagcaggggccatcatttaagaatattagtattaccaaaatatcacatgggaaatacttaataatttttgagaaataaatgaataaattacatattaaatacataaatggtgaaaccaagaattatattgcaaatattaaacagctgcattttacagacacaggcaaatcagaatgaaagcacagatcaataaaaatgggcccagaccaggagattagggtatggaccaatcagaattgatgttagctacacacaaccagcttggactgaccatagtgaccatatacttgcaccaggtgcagctcatgtcacttaattctatgcaatataattttttcaatggcttttatgaacttttaattctatttaagataatttttcaatggcttttatgaacttactatttcccccaggggatataaagataccatcaatatgtataatttgagtaaattcagtagtttgactaatggatcgatgtaatagcaaataatttattacctgccctctgtgcatcaatctcactttgaggtaaccaagccttcttagttgagtaagacataaaccctgtcttctgggaatcatatattacagaatcttctcgatttttattctattatttagtaaaataacaaactggtaaccaattaaaggcagactacattcttcacaatatctgatttgatttgtttctttaaagggagagtccattctaacgaacatactatcaccacttccaaggctctctgtcaacatacaaacattctttccattagaatgatcctccttgacgagggtggtttcaggcaataaaatgagttactgttgaaatgtgaatgatgaagacattaaacatatttaaaagacacgaaatgagtcctacagaagtttggctaccatccagattcactttttcctcaaacttctgtaatattcaaaaaggacaaatactcctgattttaaacccaccatgctatttccagggagccatgactgctaggtaaaatgttcaagcgcatgcgggattgtcatcttcctgaggtggagtagagacaatccttgcaatgggaaggaagatagactaggcagccaacctcctttacagagctaaggtcataatttcatggcctataattttatgttgcatcgtatcttcataggtagttacttattatgcttttaacttaaatatgtgtcacacatattcttttgtaggtatgtaatattttattaattttttaaaaaatatgcagctaactcgtggaatatactattaggaagtcataaaaacattaccaaattacatgtaatttctcttctctatgtccttcattgggttacctgttgatcctttaatcaaagccttgtaattacgaaaagagacgctacatgagtgcccatatgaaggtgattaaagggagaaaataagagaccgagagaggaatgagtggggagagaagaggagggacagttgatggtgtcccctactagttgtccagtaggggagagagaggtcctcactgcaccatgttccagagcttatttttgttgttgttgttttgagacaaagtctcactctgtcgcccaagctggagtgcagcggcatgatctcagctcactgcaacctccacctcctgggttcaagggattctcctgcctcagcctcccgagtagctgggattataggtgtgcaccaccatgcccagctaatttttgtattttttttagtagagatgagttttatttttaattttattattattatactttaagttttagggtacatgtgcacaatgtgcaggtttgttacatatgtatacatgtgccatgttggtgtgctgcacccattaactcatcatttacattaggtatatctcctaatgctatcactcacccctccccccaccaaacaacagtccctggtgtgtgatgttccccttcctgtgtccatgtgttctcattgttcaattcccacctgtgagtgagaacatgcggtgtttggttttctgtccttgcgatagtttgctgagaatgatggtttccagtttcatccatgtcccttcaaagaacatgaactcatcattttttatggctgcatagtattccatggtgtatatgtgccacattttcttaatccagtccatccttgttggacatttgggttggttccaagtctttgctattgtgaacagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctttgttccctgactttttaatgatcaccattctaactggtgtgagatggtatctcattgtggttttgatttgcatttctctgatggccagtgatgatgagcattttttcatgtgtcttttgactgcataaatgtcttcttttgagaagtgtctgttcatgtccttcgcccacttgttgatggggttgtttgtttttttcttgtaaatttgtttgagttcattgtagattctggatattagccctttgtcagatgattaggttgcaaaaattttctcccattctgtaggttgcctgttcactctgatggtagtttcttttgctgtgcagaagctctttagtttaattagatcccatttgtcaatctttggctttggttgccattgcttttggtgttttagatatgaagtccttgcccatgcctatgtcctgaatggtattgcctaggttttcttctagggtttttatggttttaggtctaacatgtaagtctttaatccaacctgaattaatttttgtataaggtgtaaggaagggatacagttttaactttctacatatggctagccagttttcccagcaccatttattaaatagggcatccttcccccattggttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcaggctcttttttggttccatgtgaaccttaaagtagttttttccaattctgtgtagaaagtcattggtagcttgatggggatagcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacatctcttgtaagttgaattcctaggtattttattctctttgaagcaattgtgaatgggagttcactcatgatttggctctctgtttgtctgttattggtgtataagaatgcttgtgatttttgtacattgattttgtatcctgagactttgctgaaattgcttatcagcttaaggagattttgggctgagacgatggggttctctagatatacaatcatgtcatctgcaaacagggacaatttgacttcctcttttcctaagtgaataccccttatttccttctcctgcctgattgccctggccagaacttccaacactatgttgaataggagtggcgagagagggcatccctgacttgtgccagttttcaaaggtaacgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattaagataatcatgtggtttttgtttttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcgaggatattggtctaaaattctcttttttggttgtgtctctgccaggctttggtatcaggatgatgctggcctcataaaatgagttacggaggattccctctttttctattgattggaatagtttcagaaggagtggtaccagttcctccttgtacttctggtagaattcggctgtgaatccatctggtcctggactttttttggttggaaagctattgattattgcctcgatttcagatcctgttactggtctattcagagattcaacttcttcctggtttagtcttgggagagtgtatgtgttgaggaatttatccatttcttctagattttctagtttattcacatagaggtgtttgtagtattctctgatggtagtttgtatttctggggatcggtgatgatatcccctttatcattttttattgcatctatttgattcttctctcttttcttctttattagtcttgctagcagtctatcaattttgttgatcctttcaaaaaaccagcttctggattcattaattttttgaagggttttttgtgtctctatgtccttcagttctgctctgatcttagttatttcttgccttctgctagcttttgaatgtgttttctcttgcttttctagttcttttaattgtgatgttagggtgtcaattttagatctttcctgctttctcttgtgggcatttagtgctataaatttccctctacacactgctttaaatgtgtcccagagattctggtatgtggtgtctttgttctcgttggtttccaagaacatctttatttctgccttcgtttcattatgtacccagtagtcattcagaagcaggttgttcagtttccatgtacttgagcaattttgagtgagtttcttaatcctgagttctagtttgattgctctgtggtctgagagacagtttgttataatttctgttcttttatatttgctgaggagtgctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgtttttctgtctaatgttgacagtggggtgttaaagtctcccattattattgtgttggagtctaagtctctttgtaggtcactaaggacttgctttatgaatctgggtgctcgtgtattgggtgcatatatatttaggataggtagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttgctgaatacaacacactgatgggtattgactctttttccagtttgccagtctgtgtcttttaattggagcatttagcccatttacattcaaagttaatatcattatgtgtgaatttgatcctaacattatgatgtcagctggttattttgctcgttagttgatgcagtttcttccaggcctgagatgaggtttaactatgttggtcaggctgatcttgaactcctgacctcatgatccgcccaccttggcctcccaaagtgctgggattattcatgtgagccaccatgcccggcccgttccagagtttttaataagaatatctgggagctaaagaagagtgcatttagtcagcaagccacttatggatccgctgaataaaatatcaagttctagtaaatttcaatctacagacaggagatccaggatgagacaagactgaaaaacctctaaattcagattacagtttagaaaagaaataaaatctctggatttccaggtattactggaataacaccacctctatactccaacagtgtcgtatgtcttcttcaatactatttctgctacctgtgacactctttcttcctcccctcccctttcttgctaactctgctaataccacttcctcagataatacagataatcattttctttttttttttgagatggagtctcactttgttgcacaggctggagtgcagtggcacgatcttggctcactgcaatctccacctcctaggttcaagcgattctcctccctcagcctcccgagtagctaggattacaggtgcccaccaccacacccagctaatttttatatttttagtagagatggagtttataggcatgagccaccatgcccggcacagagaatcattttctgaaacaccaaagctaagttaggagcttcttttgtacttactgcgtaacactctgcactttgatttatggcacccaatgcatgtataattaaatggttcagcttcagcatctatctctgaaattgtggacatgcaatttccaggacagcagagagactgtgctttcttttcatccctgtgtctctagggcctaatacagagcctggcacattaggcaatactcaataaatatattaagtatatgaatgatgaatgagtgaatgaatgaatgcatgaatacataaataagttgcctctggaccatccaagcagatatatttagtagaccactggaattatcattctgagtgcgaaagagagattagggatggcaataaagattgaagagtcatcaggttacaagtggtagtgaaattcataggagagaataaatctcttaggaagagtaaaattgcagaagactgaagacaaacaagggatgtagatctcatggaaacaattcagaaaacttcctcagaaaatatgagtgcagcctagatagtagttaagaactcagattgttttagtcacactgacttttaatcccatctccaggtcatatggtgtgaactaggtaagtgtggagctcagctgtgctggagacagctaagctgccaggtctcagagcagctgattaaaacaacaagccaaaaaataaaagcgacaatcaagcctttaatctcttcctgcagtagtgtaatcaacaggctgaactggagagccaagagagcattggctccccccaatcccattgcacttgcccatggaagatcacattggtcaagatgaggtagatcagcacagatattggggtcatcttattgctgagggagccccaaacaaaaggcttaagcagggcagggggttgacaagaaaacaacggaaaagagccaggagtggaaaagtactgagtactgagtcagagtagggacaaatgtcaagtttttccctttcttccctgtaaggtggtttcagcagaggcacctgaaggtggcccctgccaaaggctccaaacaaagagagctctgaatgatggcactgggggtaggaatgcaaatatgcataaactatggtctgccagggaggcctgaggccttgactgcaactccctttagaaactgtgccgcgctggctgcacaccaagcccggcgtggggagggcagtttccccgtgacacctgctgggcaaagctttcgtcactgactatagttggccctgaaaatcactcacaggtttttggccaggaagcagactgctcagtaagttacttgaactctctaaatctcaatgtcctgatctatgcctacctcgtgatttgtaaaaaaactttgctaaattcttggcatatatgcagtgctccataaatgagaacccacaggagcaggttgaggcgcaggggcaccactgagactaagagaacagaggccaagaaggtcatgactgaaaatcatctgttgcagtcgacaactgagttgttagtgaccttgggagagtagattcagtggagcaaagacaatgaaaattagagcgcaataggttatcagcaaatggaaggcaagggagagcggacaggaatcatccactagtctatgaagatgttggtgacaatgagaacgtgtgtgcagctgatgaagatacatgagactgtacagctgtcatctgatttgtaaggaatttgtcccctgaatgcccttaaaccacaataaaatcattagtatggttttaaaagctaactgagtacattgttttagagaagatggagactacagcaaggcagggaagagaaaaagccccaggacctggggtgaagccttctaagcagagtcagtgacagctgagtcacgcagaggactctgatgtcaccacagagcttgtggtatgcagactcattccagatgggcaggctttccttcaggatccctcacttatctcttctcctctctaaaagactagacactttccaccactactagccctctttctgtacatctgtcagcttttatccccagaaagcctgggccttgacagtcctcatccctgttgctctctgtttctgtaagccaagttttgcttctgttcagcagactgagaaacatcacagacccgtcttcgcacagaatccagcaaggataggatctcttctcctgactcaaccagaaataaatttacataatttattacacattaatatttttgaaactaaggacagaccgtggttcctctgtaaagactgaagcatcaagaaaaatcagcagctattctaaagaggcaaaaacataaaacccccatcagaatcccattacagtactgagaccataggagaaagctaacatgcatatcatagattttccatggaggatgtgaatccatagcatagtgaggcctatgtaagaggatttattatactttttatgtgacaataatatttccagggctttcaggtacacctagtacaaaggcttttcctagtactaaaatgccacaagagacacatgaagctcagtaactctttaagttgtagcttaaatcacccagatttttgcatttgaaagaaagcatagaatgcatgcacaatcaatgtaaagtattacataaaataatttaatcatatacaactcagcaggtttatgcctgctgccatttctctcctgtttctttagtagactatcattttctgcctctgctgtttacaggaatatattttatttcaaaagcaagatttttcttggcactcaactcatccatgactttattgttgaattttttttaatgttataactcaactctttgtgtggttaaaatggctgaggctcttttatgttgttcttatgttttcttcccccatcaagcattctgaccgctgctgtcaaaatctgataataaatgaagatttctcccacagtggacctcttataaccatggcaactccatcagcagctaatggtcacattacaaaaatgcttttgaaaaaggcagcttctcacattgctttagtacaaatgtcctttccttaccttctctccataataattctaagaaaacaacacatcccaagcaaacatttgctttgttgtgcatatgtggggtcactttaaaaaataaaaaaaaaaaaagaagagaaactacaaataataaaagagaaagattatttgaaagcatggcactaaagtaggaaatgatactgatggcttagcagcattaacaacatatttgtattgtttttacaactgaagtcaatgcagctattgcttcttaagaatttgataatttttattgctgttacttcaccctaccatcaaattagggaggctttctaaaatgcttattttaggtttcatatgaattgtctctgagcaattggtcacttgtgggaaatgcagctatatgtacacactgatatatcttcttttctgtctgagactttcatgtgcttttatatatccttgaaaaaaccccataggagaattagcatatggacttttcagcctgcctcacacaggttcacaacagaaattcctgtctgagctctgctcttagacactcaaaagtgctctggcttccttatttacaaagtagatcaaaactagtttctaacatagaaattttctccaagtgcctgcttctgaaatggcctgcctgttaaaacaaaggaggatgttttccacattaacttcttgttaaaatgatgtatctgtctgaatggaaataataggcattcagatagagttctctatctccatccatatgtcactctgtctgtctacctacctacctgtctataaatacctacccaaggaaagagacttcctcaaatcccaaacatttcagtgcttgagttttgttttgttttgttttcccccaatttgctttcaaatatcaatcgtgatcaaaaagtaaccacagattagaactcagtgtcagatttccaaatctgcaggatctgttgatgctaatgacactaatattaggtacatttcataaatgtaaataattctctccctctaaggttttcagaactaaatggtctatgtaggacagacctaagagtaggaatgccccaggccacagagcaagcagcaaagctattttattaaccttaattacaatttgatttttaccttgcccaaaacctgcttttttaaaactcttcttaaatgtatcctttctctataaaggtcctttaatcatggtggataggctttatagttaagacctccttagatttgcattgaaactctgcttctttctgctggtaaactgggcaagttactcaaactcacttaatgtcaaagcatttatttgtaaaaccagaatgataaaagttctccctcagaggatagctgagaacaatagttggcttaatacatatgaaaacacccagctctgtaattagaagaaactaaattctccaggaatattttccccccattttttcttccccatcattcctaattctcactctctccttttccttagaataagtagtcatgagattaggctcatctttctgatttgctcatccattttataagtcatttttataagagcgtaaaattatttgcaatctggtaagataaaacaagttgaactgttgactgcaagattgtcagtagtgaatgtttggtttcccttattgaaatcaaaagttacaaaatttcataacatacataaaatcaccaccacaaaaatccatctttcccaacataaaattaaattaaaaataaaatgagtgtctgttagcatatcaaaaaatgatgtttcccttttgaactagttcaccaagttcatgcagaagaatgaacttggagaattctatcaccgacagcccagacaacagactgtggcctgatattacttatcttagtggtgggagtgtatgaggttggtaggaaaacaacagcaacaaataaaaatgccaggatggtctacagaaaaagtttatttaaaattttttaaggcaaattttagagaaagtttcaaaagggaacattgcacgccattaatttttgccctggcacacaaactttcatcctttagaaggaaccagaataaatttgaagcttttaataaaatatttcatggggtaacaaaagcaacattaaacattaataaataagtctttgctgcaaattcattttgaagtgtagtcatccaagtgcaatatgcattgtgtaaatgtaacttttggaaatattaatactaataaagtctgagttcatgaaatgttcttgcctgtcatcttgagaccaagatgcatcgtcaaattgcaagcaaacattgtgaaatcaaaacccagggctgttggctcagtgagatgctgaatgagaaattgttaagtaaaaaagaccaaagggagaaaaaatgttgttctataactaaacaaatggaatcagtaaaaagtcattatttctctaagtacacatttgactacacaaaggagccactgtgttcatccaatgtgtcccagtggtcataggccttggttattcaaaaaggactttttcttttttgtcattacccctaccttctgtactgtatacaacctaaagaaagttttatgtatacaaccaacaattcattttccacatgtaattttatttttttctttcaaaggccaaatcttccattggaataaaaaaaaatcaccaactctttaagttctttcattttctatctaagcctccatattatatagaaaaactgatattgcctctttaagaagtgtaattttacctacattgatcaatgtaactctggttctttacaaaaatgatggaaatgttcccagctcaaattataatttcaggcattaaatgataggttcccttagaaaatgtgagcacgttttctttagggcaatgttgacattggctagtcaataaaataatgttttcttctgtattaactcatttagtggaaacaagttcagggttggccagcctacatgaccaccttagtgaaatcctgaaatgtgttattgttttctcaggtaagtattgagaagcaggaaatttttctttttctgttttgttattgttgatgttgttattgctgttcttcatgatgacatcaactgacatatgcctagcattctgtgtactatgcagggaaactaattcagtgtactatggagagaactaactcagaaaagaatgagaaagaggatactgggaaagaggaaaggaggaaaagtcactttgtaatttagtataatctaagtaccaagactgtatttctgttcaaaacgaacaacaaaaaaggtgaaaggcattgtctgtctactggaaaattctaagtttattaaacacaaaaattcccttcctaagagatttctgagattccctattttggccaaagttatacatgatgatgatgattagcacacaaagataataaataatgaagaaatcagtgaatatgacttaatagaaatgtccttatattttaagacccactatagcacttactctgctgctaggcactcctctaagcatcctacaaattttaattcatatcatacttgtaacaaccccaggagatgcattctattattatccaatcttacaagacaagaaattggaccaaatagaagttgtttgtccaaagctacatagctaacaataatatagtcaaactttaaatcaagcattctggcttctgagactatgccttaatacccattaaccatgctgcctcaatgtgctatttagcagaaggtaagcctgcttacattgtcaggttgatgtacctatattcggctcttttaagttgtattggtagtcactcaatatttcagatagtctattggggcttctaaaataataatggtttgctattcattaataattactaataataagtcaattattattttagaagcgatagtgatccattattattttagaaggaatatttgattttttttagtagtttaggatattggcattaaatctaagagaaaagcctgaagtaaaggcatggctccaatttttttttgtatttatggtaatcctacaggttgttaccttacagacttgctcaaaaaaaaaaaaaaaaaaatccatcaatgagcccaaaacctgaggttgtggatgacctttgatttaagggacttgaaagggtctccagatcaccatcattgaggtaacacgttgagctttggagacagacaaatttgaggtttcattctcaccttaccatgtactatctttgtatccttaggcacattcttaatctctcagcagctaatgatttttagttgtaaaatggaactaataatgtagtttcttggagttgcttggagaatttacatatgatgccatagtaaaagctcaaagagtgttagttcctttcctttttattgacaatatcatgactataattatattttcaagtaaaatgggtatttcacaacacgttatctctgtctgcaaatttctgcaaataactttaagatatcaaagatttcgtgaaattgaacatctttgagagagagaaagaggataaagtagattgtcatgatcctaccttctacacctcaaatctccaccactagatttgacttaaacaaaatacagaggacattatcactagaaggctacattttaaatgtttgggtttcagctaggcatcattactcacacctgtagttccagcatttggggaggatgagacaggagggtcacttgaggcaaggagttccagacaagcatagacaacatagcaagaccctgtctctataaaaaattaaaaaataaaataaaatgagtgtctgttagcatttcaaacattaattaaatatttcagattatttaggtcagtaaatagtacatttccccctgcaaagacacttgtttcccacattgaccctcatatcgaaagattccatctctcaagaaaattgagtttatgtagtaatacttaatttaactcccattttcattgaaatcctatatacagatatagtcaagtttcttatcagcatgaaaccactagtgtgctcacacctaattgataaaattccaacccaaagcaaagaaacttaacatattcactcatctttattgtcttattgcaagctaattgttgtagactgtaaaactattcatcaataattagttcatatccatgatggaagattatatttcccagtcctgttaaattcaggtgtggccatatgacttgctttggccaagatatgaacggattggaatatgttaattccaggtgaaagttttcagagtagtccagagctgagacctgaaggattaataaatattagccaggtaaagagaagagaaaagctattctagacagaggaaatagcatgtgttaaacctggaagagattggcaaacccaagcctttaggttagtgtaattagagagactcctggactgcagtagtaggaaagaggtaagatggtacaaatttgttcgtcatatcaaggactttatattttttagcaagtgcagtaggaatccatataagggttatgagcatggaagtgacatgatccgatttagttttgtaaggagagctcagggttttgtacacagaacaaattggagacagagatagtggaatctgttaaccacataaaagactaacatgattatccaggctggaactgatagtggcttgacccagagcaatggctgtggaggcgcaacaagagggtagattttaaatataactaggggaagacttaataaatgcctaatagacttaatgatagatagaatgtagaaatagaataatagggagtcagaaggatgactttggggctctaaattaagtgactaggtggaaggagactccatttatggtgacaaggaaaacttgcagatgtgcacacttggagaaggagagcaaatatatttaacctgagaacataatatggagatcccactgagcaggtgatgcttagagaagtaatctggacaggtaacagattattagattattagaaagattattataatatgattattatgatggaattatttagaaagagagtagaaaaggagaagagaatataaaagcccctgctatccaggtctgagtaactctaacattcaactggagagaggaagaggaatgtgataggaagactgagaaaaacagagttttaataaatcgactcccactggaaagcacttaattgattcttcagcttgaagatataggatgggtatattttcctaaaagagagcagccatcagtagattctgaatctgggtcagtcaggagctactgactgacctcaggggatgatagaagagggaaggggcacagcttctttgctaagcgttggtgaaacttcagcttcttcacagttttatttaaggccaaaccatttctttattttctacggtgtttcctcaaaaaaagacactattgtcactctgtatgtttgcatttaacacactagtatgtttaaactgtgtttatagtcttctagaagctgtataaacaatttgggtcccgccacaaactaggtacaatttcttcaactatagcctagtggtacaagaagccatttccatgtaaaaatcattgtttttgcaccccctcatcatgccacatagattcaggtgctttcaccttcctcaaactgcagggcccatgttacttatagctgcaaattggcccactggatataaaaattcctaaaggggagaaaaaacatgggattatcccatttttaaagggataactatttagacatattgtccttggtctaatcactcacctgtccctgacttgatattaggtactttaagggactcctaatttgaaggaaaagttgccactatccaaaaaatgatgccgtttctctcaccccacccggctaaggtgagagcacctggtaaccaacttccttcagtacatttatcctccagagaaatttgcctaataaattccaagagcttaacaaatactagttttctcattttctgcctaatgcaagcttagaactcagcttccggttgacctgattactttcctgaattctaggccctttatcaatgctaacaataaaggccagtctcatatctactgttttatttaatagtcacaataaccctataaaattcatcttcataaaaatgccaccctgcctcttgttcaggcaggaattttcttgaaagacaaattttaagttacccttgattgaggctttagaaacaatagtcatgcatgacataatgacatttcagtcaacaaaggaccatatagaagacggtggtcccatgagattataatgctgtatttttactgaaccttttctatgtttggatatatttagatacacaaataattgcctagagtattcaggatagtaacatgctgtacaagtgtgtagcctaggagcaataggctacactgtatagcctatgtgtgtagtagtctataccatctaggtttgtgttaagtttactctctaatgttcacacaatgacaaaattgcctagtgatgcatttctcagaacatatctccgccaagcaacccatgactgtatttcagagctcatggcagcaacctcacgttccaataagctacgcagaaccctgggtagtttttgggaactgacttacccatcttctacaatccggttagacttagctctctaatccatctagaccagctattttctttggtcatttctattgtctcaatcacttacgttaaagaaagtcttttagagatgttaatcaggaagtgctaaccaggctgctggagttgctgtagcgccagcctcagatcttttgagacataaagtgtatagatacatatgtgcgttacttacgttcctgtcagtcaactggttgtctcatcatcttcagaaccataagacataacctaaaatgatgcttgaacttacttcttaaaatctaaaaccacatttctcacatagtcatcacacatatatttctaataggatagtacaatacagtgataattcacctctctgtatagtctacttgggggggcaaggatatttaaatttcaatggcctgaattccagtcttggttctactatttttttttttttagtgatcttaacttttttgagcttcagttcattttttcctcttctgtcctacttacctgcaaggagtattatggagctgaattaagataatacatttgaaagcaataaagagtatttttcatatctggttgataataatttaatgactacatagtttcaacaaaatacttctatatattaaggctggtttcagttcctgtctcaatctcattttgcccacaaagaagagaataatcaagattagtggttcccataactaactgatttcacctgagaaactatatatatatatacatatatatatatatatatatatatatgtatatatatatatattctcagactctacttaccaaggttttgactcaatggaccaagatacagacccaggagcctgtattttttaaatgctcctcatgtaaattgctacagctttttggaggaagatggcaatgagtgttaacatttaaaatatacttaccctttaacctgataattttacttcctgccagcatacttcaacaagggcagaaagatatacatgcaaatatgtttatcatagctttgtttatactaaaaagacaactttttatcaacaggagactaaataaatgatggcacatttatacagtggaaacttaggcagttgttaaataatgaaatgctggcattaacagatgtccatggcacacattattcttaaatttttaacaagcaaattaaacaacagttttatgatctttttgatgaaatgttaaaagtgttggccgagcacagtggctcacgcctgtaatcccaacaacttgggaggccgaggcgggcctcctgaggtcaggagttcgagaccagcctggctaacatggtgaaaccccatcactactaaaaatacaaaaattagctgggcatggtggtgcacgcctgtaatcccagctacttgggaggctgaagcagtagaatcacttgaacccaggaggcagagcttgcagtgagccaagatagtgccattgcactccagcctgggtgacaagagtgagactctgtctcaaaaaaaaaaaaaaaaaagtgtttgtggtgtgtttgttcatgtgtgggtgtataacagacacacattgaaccactaactatggccaaatctaggaaataggtttgggaaatagagcaagggaaatgtgagattttactttttaatcaatacaattaaactttttttcttacagttatgattcacaatcatctacatttttattgtcaatgtcatcacttagcagcttccttaaattgcccccaaatataccctgaacactaatttcttcattcatttagcctatgaataaatatgagtagttatgcccaataagtgccaagtgctgttccaggcactagcaacaagccagactacaagctttgtcctcatggattaagcatcctaacttttctgagccttagtccttccatctgtgagactgatatattactctcatagagtattctgaggatgaaattaaacgatgtgtgtaaagtacctaacatagaatatagcaccatagatgtgctcggttattgtaagctacaatacaagcatatgtggttttactgcactttgctttattgtgtttacaaattgaaggtttatgtcaaccctgcaagtctatcagagccattttccaaaagcatgtgctcactgtgtctctgcatcacattttaataattctcgcaatagttcagactttttcattattattgtatttgttaggctgatatgtgatcagtgatcttgatgttactatcataattgttttggggcacaataaaccgaacccagagaagatggcaacctcagtcaataagtgttatgtgggttctgactgccccactcacggaccattcccctcatatctctccttctcctctggccctcctgtttgctgagacacaacattgaaatttggctaaataataaccctacaatagcttctaagtgttcaaatgaaaaaacaaaaagagtctctttcatttgaacacatgtctctctcttgaatcgaaaactagaaataattaatgaggaaggcatgttgaaagctgagataggccaaaagttagttgtcttgtgccagttagcccagttgtgaatgcaaaggaaaagttcttgaaggaaattaaaagtgctactccagtgaacatatgaatgataagaaagtgaaacagccttattactgaaaatggagaaagtttaattggtctggatagaagatcataccagccataatattcccttaggccaaagcctaacccagagcaagatcctaatgctcttcaactctgtggaggctgagagaaaagaggaagctgcagaagaaaagtggaagctatcagagattggttcataaagttaaagaaaagaagccatctccataacataaaagtgcagggtaaagccacgggtgctaacatggaagctacagcaagttctctagaaattctagccaagataatagatgaaggtggctacactaaacaacagattttcaatgtagacgaaacagctgtcttagtctgttttgctttgctataaagaaatacctgagactgagtaatttataaagaataaaggttttttggttcatgattcttctcgctggaagattgggcatctggtggaagcctcagggtgcttcctctcatggtggaaggtgaagaggagctgctgtgtgcagaaattccatggtgagagaggaagcaagagagagagggaatgtgccagactctttttaataaccagcttttgtggaatcaataaagtaataactcactcatccccaaggaagggcattaatttattcatgaggaatctgtcaagataacacaaatatttcccattaggccccacctaatgggaatcaagtttcagcatgagatttggaagggacaaacatccaaactatagcaattgccctctattggaggaagatgctgtctatcactttcatagctagagagtagaagtcaatgcttgacttcagagcttcaaaggacagcctatcttgttaaggctgaatacatttggtgactttcaatgctcatttaccattccaaaagtccttaataattatgccaaatcttctactctgcttatactctataaatggaacgataaagcctgggtgacagcacatctgtttatagcttggtttataacacattttaagcccaatgtggagacactgctcagaaaacaagattcctttcaaaatattactgctcattggcaatgcacctggtcacccacgaactctaatagtaatgaacaaggagataatgttgttttcgtgcctgctaacacatttattctgtggcccatgaatcaaggagtagttttgacttccaagtcttattatttaagaaatacattttggctgtagctaccatagacagacaatctgggcaaactaaattgaaaaaccttctggaaaggagtcaccattctatacaccataatcttcaggattcatggaaagaggacaaaatatcaacatcaacaagagttgggaggaagttgattccaatcctcatggataactttgagggagtttaagactttattggaggaagtaactgcagatgtggtggaaatagaaagagaaatagaatggaagcggagcctgaagatgtgactgaattgctgaaatctcatgataaaacttgaacggatgagcaaagaaagtggtttcttgagatagaagctactcctggtgaagatgctgtgaacactgttgaaataacaaaggattttgaatatttcataaatttagttgataagacagaggcagggtttgagagggctgactccatttcaaaagacattctactgtggataaaatgctatcaaacagctttgcatgctatagagaaatcttttgtgaaaggaataagaattgatacagcaaccctcattgttatcttacttcaagaatggctacagccactccaactttcagcaaccaccctgctgatcagttaccagctgtcaatgcttgggcaagactctccactagcaaaacaactgtgactcacagaaagctcagattattattagcatttttagcaaaaatatttttaattaaggtatgtacttttttaggaataatgctattatatttttaatagactgtggtatagtgtaaacataaattttgtatgtactgggaaaacaaaaacatgacttgctttattacagtggtcctgaactgaacctgcaatatctctgatgtatggctgtaattgttattgctgtcatcatcaccatttttttcatgaccaactgctcgatccagtgtaggttttctggggaaaaaataaatttcatctcaagaacgttaattgctgaccttgtaaacaatgtgaactacatttcctttactgaatcacagcagacttagaaaaaaagagagaatagaaatcaattcaatgagagaaaaatgttgccttctatttatttaatacatcccttagctacagaattcttatttcctcggtttaacaaagtagattacacagcagaggctgatgcacatttataaaaatatatgacattttgtttatgtcagtggggatgaggaatcttttttttttggagataagagtaccaaagggcagtgagtggccccttaatcctaatagcagatacttccatgagtgaaaaccacagttaatgaagctctgaaagtgaacctctttttacatttgtacttgattttgaaacatgcaaaacatagttgaagccagtgtgagcttctctttcgtaaggactcagaagctaaatatggagccaagtttaactatccaattaaatgtactgtttacaaatgaaaacaattatattttcaattaacaggaagatgaaaaatgcaattactttagctatggcatattttattttatttcttttttgtttgtttgtttgttttattttgactttgtgctgcaggcagagttaattaactctttcagcaaaggaaaagaaaaacattaaacaatgattatgtgtgaatttcctggagtgatcccagttaggtagcaggggcttgattgtctgattctgtgagctctaaaagaaaccccaaggtaaatagaagtactgcagatagtgtaaccatgagcaacaggtatttttgtgtcaaaggaccaaaaattgtccttgtaagtgtataggtctttggtatattctaaaagttaatttttaagttgagaaagataaaaggacaagtggtatcctgaagttcatgtgtcataaaaattattttgtggtagaaaggctaagtcactaaatattcattaagaaataagtgttgtgtaaccatttatctaatcattgtactaggaaatagctacaaaagtaaataccataatacaatacaatacatacaataaaactgctcttaatgagtagttctactgtaatcagagtcacatgaagccatgacataagaatgctttatttcatatatcttatttcatggtaccctagctgggttactctagtaacttggttaagcactagtttcaaagcaggatggtcaattcttccaacacatacaggccaatatagattgttttttcctacaaattcttgaacttcagattttacatttggattacagtctttctcaagaacaatcattttgcaacatgttttcattcctggatttgatcttagtaggactaccaaaatgcaagaaagtacaaaatgttaaaaaagaaaacctcaaagcattttggtagtcgtatttttatgtttgatatgaacattatttaaaccaatgaaatacaatatattgcaatacaatatttcaaagtagcatattcttttaagagatttcctgttacatagtcaggctatttaatttgctcagtataatgattaaaataaacttttctggtgataatgtctattgtgagtattctaattggtccactctgattgtcttgaaaattccctaagaaattaactcttttttatagatataagtgttttggcaaatgtcacagattttttacagaaggattagagaatttttttcactcttgtctttttggtatgtatgtgttttatataagacaagggtgtattccaaagctacatctagcaaaatttatgttttagtgtttcaaaaaaaaatctgtgccatgacagtcattagatctgatcatgacacttttgaaatatttagccaaagtcctcttattccaccgaaacacagttggaagcaattatttaaaaccacacataatttatctggaggttttaaaacatgcctttgtatataaatagcttttttcttccatactgctttgcttagttcaactgtgaaggcaattaatttttaaagagttgaaagaccgttccaaaatacatttatctctgctgatccctaaaatttttctgagtgaaccaaatacctaatagactctacagataactctcttgtgtagctcttatctcagccataatgttacattcgtgtgattatctaacaaatgccagtgttccctctgcactgtatgcttgtggagagaaagaccatctcccattgcttgttattgctctctagcaccatttcagtgcctgtagttgcatgtaaaaattgttcaatacttatttgttaaatgaactttatgtaatgggggacactttgtgaaaagtcagtaatcactccttgacttagtttcactcttttcataaagtctaatcatatatacacaaaaactgttgtacatatctattgttcaagtagggaataatatgtaaaatgtttttagtcattcagtaaaatcacatactaaaaatcaatgtcaatttggttttttttttctgtcattgttgatttgacagaaaaatcaatgttgatttgttttcccccccagtggacagaaatttttcaagtcaaaaatttattaaatactacctgttatttgaaatcatttcttttaaagacattcaaaaaattatgacatcttattcgttctcacatcgtcaccatgagataagtactatttttcaacttgcagaggaaatgtcttctactcaaaaaaagaagactatttggttatattggtttctagattaataaatgcccttggatatataacatctaacaacttaaggaaattcgataaacatttagaaaattaataagtataaaaagtgttatgacccaaagcatagtttatatactatcaagtaaaaatgagctataaaattaaccataatttcacagaaaagagtatttgtttggaagtctaacaaagttgagacattatacagagagacactgtatgggtcgatatctcaagtaagccatcatctaagaaccttgcaaatgatccatctgaattatatatatgatccatctgaattatatatacattataataaattataaatatggccaacagttaatttctttggtttttctaagggtaagttaccccagtagacagtaatatcaatagaatgtttttcattcagaaagattcataagactccacaaactgaaataatagaattttggaacaagaacctctctgcatcactcagacgactccttggagagttttaggaaggccagttgtaattagttgaaacttgtctttgaacaggcgtctagagctatttcttctagtaagaaaaacgcctgaaggcactaagtgattacaggaatcgaaaccaagattttacttaaaggcatgtgtgtaacatatcatgcgtactctcctcaaaatgccctatggatcttttttcttttctttaatttaggctccccaaaaaaataatgtgtgccaaatgatccattctacttcttgccaggtctggcatgatatgaagcctgacagggacaataaggggacaaagcaaggaggagtactgaattacttttcttgctttttttttttatgttaaggaacaagcccaaagaaaaacatagatcattgtgacaaatgcattgtatctttataattcattgtagttggcaagaactcctaccaagtaataaatgttaagcaaaccagagccaccattgcataggtaggggtattcttccactacagtcacatcatttggcctcagctcaaactactgactttgtcttgatgattttcttcattgcattagtaagttagcaaaagtgggtgggggtggggatccctgctttattcctccttcactgtgtgtgagcaaatgcatgcatgggtggctgaggtgcgggaaagaagaagagagaatatgcagaggttaggggatttttaaaaacatgtaagttttgttttattttgttagtttaaatttgcccttaggtattgttcaaaatgtcctcatttcctttatgacacaagggcttttagaggaatgactgaattaaaagacagtttataaaagttgcaagatatagggaaatgattgtttacaaaataaggcattgatgaggaaggagacagaagtgttgctgggatgactcttcaaggggaaagtgaaagttcagtgactgacaggaaaacaatcatagcttctgtgcttcatagagctggcctgccactcattgcccctttttcactctttgattcaaacatatacaggagggagaaagtggcattgagcctcctccagctgacaaaggaccagagaggcaaaccgaggctgttagtctaccaccatgctattcataccatgccctctcctgaaatgctcatacacccactctctacatgttataaacataaagccttagtcaaatagccacctccgctatgacactttctttgaccacttttgccaaagtggcgtcatccccctctacagagctaagtaatgattctttaagaaaccctcacaatgctttttgctctccatctcttagccaaaaacaaaacaaaacaaaaaagtctttggttgtttaagctaacacaaattacttcactcccttatgcctgagtttctaaatatagaaaaatggagataaagtcagtaactacctcacagggtgatttcgagaattatataactgaattgctacagagtgaacaatgcaggtgaagagataggtgctcaataaatgtgagacatgttaactatcatgactactactgccattggtgagcacacattatatagttccctttcttgagctttgctttttattcagcaaattgatcgaacgcatcctctgtgcaaacaactgtagttggtgctacagaacacacaaaatctataagacaccattacctggcctaaggagcttgtaatcctttcaaagagataaaacacattactttagtgttggaacaaagcacaaaattataagaaaacttccaaggaaagttcaaaagatggatcaattagtggtttctccaaacctgctttagtatcagaatccccttgggaaagtgctgtttaaaaatatagattcccagacaccaacccaaaaatagtaaataagaatctctgacttgtagccaaggaaattcaagtgattccaatgatcacccagtaggaaatccctagaatagtcacgtacaattggaaataaaaggctttctgttaaaaggtggtcttggccaggcgcggtggctcacgtctgtaatcccagcactttgggaggccaaggtgagtggatcacaaggtcaggagatcaagaccatgtgaaacccggtctctactaaaaatacaaaaaattagcagggcatggtggcaggcccctgtagtctcagctactcgggaggctgaggcaggagaatggcgtgaacccgggaggcagagcttgcagtgagctgggatcgcgccactacactccagactgggtgacagcacaagactccgtctcaaaaaaaacaaaaaggtggtcttgaccaggcatcgagacacattttataagagttaggatagaaggaagaaagagtggtgtcacttaaaagagatgagttagttcctagccagtgatcttctcaataaggatgaaatattatcttctgctaagaatcaaacaggtgaaaatacagttcaaggtttgggaaatgtggagaaagttggaagagttgtaacatgttttacagggataactagaggtgaattaaactgagggtccattatgctacaatatctctcactgcaatttccaaggccagtttatacctaggctagggtcattcttcttaaattcccagaagcttatataaatgaaaatgcactgacattatcaataaaagtgaatttttaatatcactgacaataggatcattaactattgtgaattcttcatgtctgttaacaaccttgtttcttttgccaagtataaaatttcaaatttgatctcatgaaaagtctaggagtcagattctcataaataacaacagatctatccatttgctctttgttgatctgtagctggcatctgaatatatgaattcccctagggtgagaatgagactctataattaaagttaattggtgttgcttttcacctgtttttcttcttggtgagtgaactcttttattcctctcatttttccacatcaaattctcagtattgcaatgggtctcccacagttccaggcagtttctggttcttggggggaaatgctcctgtggcattattgattgcagccttcatgagaaggacaatgatttactgtgttgcttcctgtgcagctgtgaatttgctgtacagtgacagggccttccgtggcatcctctgtctcaacttgacaggagatctggagagtgagctagctgtattgaaatgaaagtgtcctcaccccaaatcacattctgtccctcaaactaaacccaggtcagtgagaggttagcgaaaacacggttaagaatgtgctaaagggtgatactgaaattgaggctgtccccactgtcttctcaaggcctgtaacccggcttgccctcctaaaagcttcatgctgtcattccttgccgcctccttattttcctaggctttccacaactgcctgctttcttacccatactcccaatactgcatgctatgattttggggaggacacattcaggccattgcacacctgaacattctttttttttttttggctagagtatcagaatgggcacttgaccttaggcagcactgtgtttggacttatacattgttcatgtcaatgtttggttctaaaaggaaaaactgaaaacctattgcaaatggactccactgtattactgtggctgtaccacattagtctttataatgattataacaatagctgcctggtatggagaacttaatatataccacataatgtggtgaacactttgcatatacaatacaatttaagataaatattccattccagggattaggaaaactgaagctcagagggatcatgttatcttgccagtacatagtcaggaagtaatgataacagaatttcacccacgttttcctaactaatactcatactgttcttttatttatttatttatttatttattttgagacacagtcttgctctgtcatccaggctggagtgccctggtgcaatcttggctcactgcaagctccgcctcccgggttcacacccttctcctgcctcagcctcctgagtagctgggactacaggcacctgccaccacgcccggctaatattttgtacgtttagtagagacagggtttcactgtgttagccaggatggtcgcgatctcctgacctcatcatctgcccacctcggcctcccaaagtgctgggattacaggcatgagccaccgcgcctggccaatactcatactcttaactattacattctccttttccaaaaatctcagtcctttaattattttccctgcttaaaatttcctaaaccttatccacacctcattatcattctttgacttctctttggtcataaattatttattatgtgtatccttccatctatctgtgtacttgcacattgttttgcaggtaaaatccatattgtccatttattttgtgctcactcaacacctggtatatcagtgttatgcttttggagtctttggaaccgttagttttctatatggatcataccctgacttatcataagtggaagtgataagaatggcctgggggtaggacaagaagggagagaaaataaatagttatcactgattctcagagggatgccgagactaaactgaccctaccatcagattgttagatatgatcttcttgaatgctgtttgctacacctcctatctacatgcctacaggcagccttcacccagagctaaaagaaagtggaatccaaatgtttaaaaaatatttatttagaagcttaagaactctacccaaagttctcaggctaggattagtaacattaggttgtaatgtccactcttctctttcttccatactctgagatgttctccccagtaccagcttatcttgttatgcatcttagaaaaattctttttattattattattatactttaagttctagggcacatgtgcccaacgtgcaggtttgttacttatttatacatgtgccatgttggtgtgctgcacccattaactcgtcatttgtattaggtatatcttctagtgctatccctccctcctccccctaccccatgacaggccccagtgtgtgatgttccccaccctgtgtccaagtgttttcattgttcagttcccacctatgagtgagaacatgcggtgtttggttttctgtccttgcgatagtttgctcagaatgacggtttccagcttcatccatgtccctacaaaggacatgaacttatcctttttatggctgcatagtattccatggtgtacatgtgccacattttcttaatccagtctatcattgatggacatttgggttggttccaagtctttgctatcgtgaatagtgccaatatatgaaagtccctggggaatcttgagagccctttgggccagcatcaagactcactgagctgtaatttagtgcttaatgccataaggaatttggaatcaatttttatacagtcatggatcacttagtgatggggatacattctgagaaatgcattgttaggtgatttcattgttttatgaacatcgcagagtgtacttacacaaatctagacggtatagcctatgaaacccaggttatatggtataggtgtatttcttctagtctacaaacctgcactgaagactgtgggtaatagtagcacaatggtaagtatttatgtatgtaaacatatttaaacataaaaagataaagtaaaaagatggtgttataatcttatgggaccactcttatatatatggtctgtcagtgaccaaaatgtcattatgaggtacatgactgtaattttctgtaatgtgtgttgcagctcaggcactactgggaatattgggtcacagtacaagtcctcttttttcatcacaactacagaaaaattacttcaaaatgcatcaactattatctcatagagtgtagcctctcatagaaagaccataagagtaataatatctacaaagtggatctgttctcacgttactcttctttctatgacagtatgtccatttgttatatatggaatgccattatttgcagtgatctatatagcttgagttttaaatcagtatacttttatcaaacggtatacctttttgttctcatctagaaacaaatagacagagtgtagtatccagtattgcttaccaccatatacaaggtaaagattcaccacaatttaccaatactctgagcaatttagttgctgacaaatataactggctattcaaacatgggtaaattgcacttctacaattattcattagggctcctataataagtatttcagatgcctacttagctgggttgctttcatttctaattcataaaggtttaaaacagatttgagaagctgattatgcaagggttggggtaaagtggagaaatagagggctttgcaactgcctgcattttgtacatacacatttacagtattaccagacctatttctgaataaagagaccagcctcttggtccctctgacaattgttatcaggactgaatggcattcagtttttatcaagcctcttctctgagttattgaagcatcccataatatcatcaagtaagtaaacgttgtgcatgtagctcttgccattatcatggaaaatagcaagtagttctcatgaacttgcacaggaatggtgcaagtaacatccctttcataacagcaacgtatccacaccatttcatttgtctagccacatagacacatagaaaggtaggctattccttttatatctattggtaaattttctttcgaataactgctgagaacttcactcctataagcagttggtgctgctggttgaagaaaatagatacattatctaaagtaatagataagtctcattaagaagatggaatagactaattcccagcatatctcccatgcgtgggaaaactaaattgtgaagtagagcagtaacacatcaattatcctttctgcacggaattagacgagcctcactgctactttgtatcacattatgtaattttttataaataactatttatgtcagatcacctcagtttgctgccttattaaaaaaagatagctaacacttctagcttactaatcagatttattcctgaaactacttaggaatccaggtagtctatttaaaatttacatgtgtacttaaggaatccttattcctactaaggaaatagtgttaacatatgcccaaagaggtgatgttttatattaacctaaaaataaaatgctatacatttaatgatgttacaattttaacgaagatcggcttctaccaactaaagtgaagctagctatcaccatttagaacaaagtttttgaagatcttgtgttaaataatgacataatcagtttaagtagttgatcaggtttgccacatcaagttatcatatgtgaagtgctagaaaacaattcagtttcttcagtagtttaaatctctcttgctttttgtctacatagttaatctttattaacttattatgttcacaacacaggagttaagttaatgaaagcttgtatatgaagaatttgcttgctaaagtaaataataaaatttggtacttacctgttttaatttattgactgtgtggtaaaaagtgaaacaccataatgacaatagaaatgctttgcaaattatgaagtgatatttttaaaaagaaggatataacatttatatgtatcctagtttttaaaaacatcttacttattaacgaggagaagaagaagcatacattctaaagcttctgggtctaagattagtttcactccagatatgattcagagggagaaggaggaaagtcagaaggaacattccaaaattggaaaagtgctaaaagggaaagtggcccctaagtgacacccatcactctgcaatcatgacattgctgctgtgctgcgtatttcacaatctatgtttcttagtctgcccaggctttccaaacaaaatgccacagactgggtggcttaaacaatggaaatttatttctcacagttcttgaggctagaggaccaagatcaagcaaggtttcagcaaggtagatttcattctgaagcctcttctcttggcttgtagggaagctgccatcttgctgtgtgctcacaggacgtcttcttcatgtaaagagagagcaaacatgatggtgtctcttctgataagagcactggtcccttcaaatcaggtccccattctcctgacttcatctaaccctaattaccccccaaaggccccatctcaaaatatcattacaatggggcttagcgcttcatcatataaactttggaggggcataaacattcagtccataataacatgagattgagtgcttttgttttttacgtccatgacaaatcaagttaacaaatatttattgagtgaatacagaaggaaagtcacaatgcttgtggtgtaatgaataggatgaaatacatattttaagattcctgtcctcaaggagttgatagcctgattgagaatataagaagtgcatcagaagaaaaacatgcatcaaatataaataataattcagagtgaaaacagagacgtctcaaggcagtgtatggttcaatactaaatgggcagttctcaggaacatttttgcagaggagatggaatctgagtcctgagagatgttcttcacagaagcatgagaaaagaatgccctcttgtcattcacttattcactcatatttactaaaggatattatgtgtcagaggttagaaatacaaaattaatagtgcatagtttagtatctgccctcaaggaggctaacatccaaaaaaaagaaagaaaaacaccactaaattcaagatcaagtctcaactccttaaataacttacaggccttgcttctccagcgtggttctggttctccccatattcatgctcagtctcagggaactccgttcgtcttttcagaatgcctgtactttcttcctgctggacttttgcacaaactgcttcctctacctagagtactcttttcccaatctccatgccatcacctgttctactaattcctaatttctcatctaagacaacacttactccaaaatgttgttcctaaactgaccatccttctaaaaccaaggtctggtgacctttgcacggtgccttctcttgtgctgccccattccgggcatgtgaccaccctgcagtggaactatccagtactggaattggaggttaacatccaaggaacagttttgggattttttcctccatttataaaaccttagccagttgcagtggctcacgcctataatcccagcactttgggaggcagaggcgggtgaatcatctgaggtcaggagttcaagacaatcctggccaatgtggtgaaaccccatctctactaaaaaaggcaaaagttatctgggcatagtagtgggtgcctgtaatcccagctacttggaaggctgaggcaggagaattgcttgaatccgggagacagaggttgcagtgagccgagatcgcaccattgtactctagcctgggaaacagggcgagactccgtctcaaaaaaaagaaaaagaaagaaaaagaaaaaggaacctcatagcgtatttggattcatgatggaaagaagtttgcaggtagaattcactttttaaaatgtctaaaatgaagagaaactgttctcctgtgattctaggccacctcaagagaaggttatgttactgtctaaacactctactaaaaaaagaaaattgaagcacttcatttcagagctgtaataatgctaaatacaatacatctaaaaattaaaatataatttaaaaaaatagtttagacttcccatctatgaaaatgtgggtaaaacagtaatgttattttcccacagttgtactattgttgatgatctaactcactcctggctgagagtttttattatgtgcactgaatttatccacaaactgtaatacaaatatgctctgagttttttaaaatatgtatcagtgtacaacctctaacttagatgttgtttgcatcataaaataattctcccgctattaaagcctactagagtagttctcagaataatgaattccttccttatatttaaattattattcaactttttagaagtttagaatttgtgcaaatgctaaggaaaatgtttgtctcttcaaaaagtatccttcttaatcttctctttcctaagagtatgtcaaagctgcatatcacaatctttatccattttacaaatagcatacaactcaggatctcacttattttaaaggttaattgtcagactcaaggatatgaaaatatacataaatgcataacatatatactatacacaaagcaaaataagtttgactttatgacaccttttcataaacatgcatttgaaagttttgcataagaaaaatgaagagtgactctaaacagagatgatcgttgccagtttctcactgcagaatgaaatattttttctcctttaccctataacccaaatatcacactgagcttaaggatgaagctgacattttaaaagatcaccaaaagcgttctctttccaattgcaattatgccctctatctcagtgggagccattgtctgggtcttctcagctctctagcatctttctggcttgctttcattaccctgattatctattcatttgccgcccagtactcattttatgaaagatcatgtctgccatttctgtaatgagtgcttgacttttactgccagcataaacacataaaatatataataattaaagttcactagtcaccaaagtcttgagatccgtcatgttgctaatttgattttttaagcaattgcttctccgcgaacagggctgattttgcccccttaggcagtgcaagacttatggttgaaggagatgactctaacctagagagatcaatttgaatgggcaccatatatttcaaatttaaggttcattttctaccaaataacatgtctataaattatgatgggtcttagagccaacaaaaatttcatcaaaatttgaacataaatgttgttctaaatgttaaagattaaacaatgtgcttttcaaaacagttaaatgttatttaattgtgtagcttttatggagaattgtttaaactctaagaaaaaagttaattggaataactacaggagcctacacaacacagattggaaacttcacaatgtgttgacttacattaagtaaggacaaggttccagaacaccacttccttattttgaacacacttccttgttctgataacattggcaaagcaccctaagtgccccatgataatgaattcatctgacctttaatcacaaagcgattaatgaactcatgagatactcatgtggctctctggggacataaagatgtgtcatacaaagtgtaatgtttgtaaatggatacagtggaacacgtgttagccaagggacttgagtagcagactctcagtttataaagaagcaggaaataaagaggtgcttccatttatacagattttctttagagataataaagatcttgatggtgtattcaaaaaaagcacagaagccagaagacctgagtttgaaagcagaatgtatcactttccagccatgtggccttgggaaacttttcttcacctctgagcctcaatctcctcacctgtaaaaggagaattagtaatatcagacttcctaaaggctgttacaagagtaagaggtacagggtcgaagggaggaggggtttgaagtgatcaatcagtcaatcaatatcattcctccctcacaaggttaagaagtaaatcaaataatatgcactgttttgaaaaggcctttataaactgcagcatcatgcatgtgtttatttttgctattcttttggaaaataggtactctgaataaagttcacagttgtttctttttccccatacacagaatggatgccttaggaagacactagtaactacataaggacatagacattgttttgtgaataaaccagatctgaccgattaagtactttatcaaattacctttttcaaatttgaaagtaacatatcaggtttgaagcaacacaggaaacttctctttttaaacaggtctctgctctgcagcagccttcagcaataactgagtttataattaaatccagcctgtgtattcagccctgcagtggggagctgggcagaccacttcacctcaccggcaggagttaaatgtgatcccatctcccaggtccagtactaacacactgtcattctcattaagcatgtgtagtaattctttaccaattctaaaaaactactaattaatttacagtacttctggtcacacataattaaaaaccattttcatatctttgattaaaagagacacaaccttttctgcctcagttcattgtcttacccgttcttagtaaatcataatcacttccctggaatttctttttttaggagtgtaatatctgctcatatcgccttgacttcaggctcaagctcccattgcctagaaaatgattcaggaaatacaaccctcagaagacaaatactacctcatcttgaataagtgaggcagtcatcttttggaacatgggcacttccaatctcagaataaatgctcagatatattttacaatataatcagaaaaccaaagaaattcaaaattcacttgaaggattatgtggccattgttcatatacagtgcatatgtgaaattctctctcagcgtggtgaaatgtggactcaacacatgatcactctgtactcatttaaagatgcacatgtcataacagatattactacatgttaatacatattaatacactattgaaagagcactggaataggagtcaccatctctggttctaaaacggactcatactttccaatgattggacttgctatatcacttaagccacctcaacttcaatatcttcatcagtgaaatgagaacttattggcttatagagttattttctctgaggtttccaaaataagtcagaaactatagccagaaggtcattctggcagcttgcctgtttttacaaataaagcccacttgtttacttactttctacggctgctttcacactacaaaggcagagttgagtagttgtgatggacaccatatgggccacaaagtctaaaatattggctatctgacccttaacaagaaaagcttgctgacctctagtctaaaagatgatagttatgaatttatttgaaataccatgaagtactattaacctatatgatagaaactcttggtggattgaaattaagcaactgccatttggctcaactagctagaagaaatagttaaaagttcaatttaaacaaaggaaatagctcctaatagtttcccttacactatttgatattactgaggtattagatgctatcaataaatatttgttgcacttaatgttaccaactgatcactaagagattttgcttaagaaaaataatcgattgatgattgattcacaggaagttgatagaattgatttttacaactctgatatgcaaattgtaatattagatatgccaatcaaagtgccactatgcttaattgtttaaatcttaatctttgagaagtgcttctgcttcgatgcaagattacctacgttttccaaagctaggatgaaaaaattgatgaatgaatgaaaaacctattgagctaaagttttttctgaaaatcatctgcatgctattattaatactttctcagtaaccatggagaggaaaattttgtgaaaacccagaaaatgaatttaataatgtggatattatgagccaaaatagatttattcagtgtgtgaaaaaaataactttttttcagaaatttcaaaatttctttctcagtgataactgacattaaacagtattgagtaatgggactctctcctaaatatctttttaattttggttacataaaactcataagtaggtactgataaaatatttttgaaatattaaaatggttattttatcctcacgaatttctacccccaaattgcctcaatacttccaaattgaagaagtaccaaaaggtcttgtatcatagagtttctggcgttacatagctataattatctttcactatgacaggacaagaagcttgaagacctagggtgtaagaaggatattcaggagaggaaaggaagccttacttcttctgaccagaggattctaacagaggtcaggagaagagaaaggcaagaagacattagatagattgaaaggcacaacaagggtagaagacctaatgcttctcttccctttagggtctctgggggagttcccagggcacaccaggctctttaacaacagagaagacctcagatcattaagaatgcagagcagcagggtcaggaaaaagcacaggttcaataatcattcccaggcctccctttctttcctgtgcctcgcatgcggggttagagcatatggacctgccttgggcccctccacagtgaataacaaggtgaggtcatcataccatctggagggctacagaatcatcaggggctggataaagaaaatggcagaggctcagaaggatgtagagcaccccaacaaaccaaaggaggctgagtcagcagggaggagcccataagccctacattagccaacttttagcacctatagcctttgcagactttagcagcagtcacctattaatctctaaaactgaacccaagcccatcccacctcaaaggagagctgccaaagcgaattcaaggacctgcaagagaccagccaccacctttcccctaaatccctaatttcagggatataatgctgtcctccataaatcctgataccattttgaaaaagagtaagggaaaagagaagaaatgggaagaattgagtaattctctcaagtagattgagctaaagctagagacatgttaaattattagatgagattaaattttaaatcatattgggctaaatttagttttttccccactgctcagtaggcacagtcctcctaagatcaattaagttatagagaaaagctacattttctctgcatacccaaattgtagcatgaatacatttgctatcacactataattatattgtttggtttagaggaaacatattgatgagacgtttactcagggtttaagaaatctctgaaactaaagaagatagcttttctctgcatacttacatattagaagctgtgtgagataatggagagaaatgtgctggaaggcagacctgagttctaagcccaattcaactatttattatctgtgtgagcaacttaaaaagtcatttaaactctacagcagtgagattgtgtgttccatgtgaaaaatctagggaatcattatgccggattacttagcgtcttcatccataaaatgggggaggagaaacagacggggaagcaataatgtctgcaacctttcccattctaatttcctagtagaaatgactaaaaaggcaggtgtcatttttcttaggtaaccagtaaccagtaacttttttagtttggttcagtaggaattcacctatgggccatgattccagaaaagtttgagaggaacttattgacagcgatggtatttaaggacaaaatcagagtgacctatgtgggattagaaatttgcgtccaactttcagcaacctgttttgtaacaaataaattaatttgaaaatcatttcctagagtagtgactaaaaatggtaagggatcaaaaattagtgtgagtctcaaacacaaatgaggctaaaaaggctcttcaagatgaatgcctaaacctgttggatttctttaattttaatatgaaagaaggatcttttgattcctctactcccttcccctgaaatttcctcatttataccaataaagaaatcagtgcaattttcaaattgcaattaagttttatggacttctaaaatttttctgttcaatgggatcacaaatgttttaatattttggatgaaaaaaaggaaatgagatgtccgtgtcagtgaatcaatcattcattgatcatatgggcatgtaattctccattaagaagtatgtaccggaacaggtccaaagaaagaacaatagtgatacatgtgacaataataagtctagctttagagttgcaatagccttccgcgtgccaggtaatgagcttttcatgcatcttgctcactgagatcgtcacgtgtggtcttattaattcacaccacaatgaccctcaaaagtaagtgttgttatgcatcaccatggtgtaaaaatagcaggaatttttctgactatactccaaaaagagattttagccgttagttcatcacagtctaatagctaaacttatttctaatagtttaagtatttacagccccacaaagtctatacttcagcacttcaatcccatagattaacaataaccacagtaactctttgctctctatgagcaaatactgccatcttgtggaaattgcacgccaaacagaacattattgttccataaactcaaaagtttttcttgtgtttattaagaattttgcaactcaatttttgcattgtcatacatacgcgcacacacacacactcgcacacatacatacacattattgttgcttataattacaaggtacaattctttagattttcaagttcaatttaaaagggccagtgctttgggaagattgaagggaacatatctctttgcttattataagaattcatcctattcatcttccaggcagtgcattatattttaccacacttgctttacataatctttaaattgggtttttgttaaatcataaaaaggaggccatagtgagaccattctgatggaatttccaggaacactagattttgtagcaaaatgttatgacagaactctggacttagagaacactttcattcccttccaacacttgtagcccatgccagcctgtattcctggaatctgttgtcaggggtgactgaggggtcagatggtccaatttctctgtacatccccaaagatgaaatctccctgcaatgccccagccacttgtgctgccgtgagcataaaataaacaatacaaagagatttttgtggcatattcgtacttgaagcacctagagagggtgcttccttctttcccctcgatgatctcctatcgctcagctggctgaacctaaaaattctgcaattaaatgattttttttgggtttaaggcttttaattcctattagaatttaaataggtgaggtattatatatatatatatatatatatatgaggcatatatatatatttcaataatgatttctaaagtcaaaatattttccaagtttagaaagaataaggagacaaaattaaataaaatgaaatgcaagggccccaaataccactgagaagaaagtgtaggcagtaattaagttcctgaatgaaggaaggaataaatgaacatgaattgagggcattaaaaaaatggcttcacagtgtcactcaagcctctccggtggaatgtgcagtcgtggtttagaataaattttgtacccaaggaaatgtctggaatgaagtcattcttcaactgtttattaaatggatagatgaataaaacaggaatggaataaattagaaaacagcatcaatcgtaagaaaaaagaataggatctgatatcagagtttaggattcatttaccaaaactgtgttgagtatattccatcaataaatatgcacctgctctgtaggaggcaatatggaggatgagtacacactctcgaaaatggaacagactgatcaagtaattataaatgatgataagtgctatgaaggaaaattcttacactttcacagtgtattagttcgttctctcactgctatgaagaaatacccaagactgggtagtttataaagaaagaagtttaattgactcacagttccccatggctggggaggcctcaggaaacttacaatcatggtggaaggcacctcttcacaaggcagcgggagagagaatgagtgctgagcaaaggggaagccccttataaaaccatcagatctcgtgagactcactatcacaagaacggcatgagggaaaccacccccatgattcaattatctccacctgtcctgcacttgacacgtggagattattacaaggtgagatttgtgtggggacacggagccaaaccgtatcacaaggctactgaccaatatggtgtgatgcaaataggagagcaggataacaggatctcattttgtgcccagatgtattctcattaagcaaatgttgctgtagttgccttttatatctacaagtacttataaactcaaatttaaaaagaattatttgttcaaagatgactacatttttcctccaaggtaatcaatggtgctctgactacctagagcctttaggtgggcaaatacataagggatgtgccattattttttattattatggtaagaattcttaacatgggtgctattctatgaaaatttttaatgtacaatacagtattgctaactatagttacaatgttgtacagtagttttcaagaacttttccctcttgcataactgaagctttacacctatcgacgagcaataccaacatcatttaaatgatattcatgaataggccaggaaagtaattttgataccatgattacatctttgtgtgttgcctaacacagtgctggaaatttctacaagtagttgcttctttggatcaagagattatttcccatgtgtatttcttaaacctgttacttggaaagcaaaatgagagaaggggaatgaaggtcataagtttgggaaatgctgagttaaacaaaatcatgccgttttcttttctgctggtcttctgagagtctttaataggctgacatctttgtaaattcccaagagtgtgtttctcagaattaataaccacaaggcccttttcttacagaggtcttgtaggtactggtttgctgtgaaatgcacttttggaaattctggaaatgcaaatggctttttctggaatggaagctggaataagggtgacatataacccattaatattcataatcattttagtaaattcaattaatcaaattaattactcttctagagcaacactctagacagatacatttcacaggaagcaaggagaaaaggtccaggttgtgggggaggtttcagaacagtctcagtcctggactgccagcacggggcaccagagctgaggctgtgggaacgtctgggagagatgacagggacctgagaccaaccctctaccagagccttaagggctggtctcactctagtttaactcagattaaacactgacccaacttccaatgcacaaaatcttcttccctttatcatgttgcttgttcttctagccatgtggatgacatgaaacaggtaaaaaggtcactacaactccattctctgaactcttaaattgtaagcagtctcaccccaaataatccaagaccttgggcaagagtacaaatataggttcacataccccaagtctaattatgtaaaaattatgcattaaactaaaacctgtttgatataatatattctatgttcttatctggacaaatataccttcatgacccctgggaggccaggtttaagtttctatgtgactagccaggaggtctgaactgacccaggagcacagggctctggggccctttctttccacctgcagctccaacttgcacgctgaagtgtctcctacgcaaggctgtatacacccgagctcactcatctgagctctgtccacactctacaaactccaccctatagagctatggtgcacccgtggctgtaagatcttctgccaggaggacaaccctgggaataggcctggcaggccctggaagagcactaagctgtttggccaggaaattccagggaacccagaggacgatgcacactctgtacaggcacacagccttggtctgatcttccttgccctgtgaaaaagggcatagctggaggagggccacatctaggctggcctcaggtagagcctaagaagcactgggaattgagaataattcctctatgaaaaacacactttaaaaagctgcagtgtgcagctaccctcagactctggggaggggaaaaagaagcagcagaagaaaaagaagagggtttttcctatttgaatttaactacttctgaaagcctctggtcaggttttcttcttgttttccaaggtaagattacttcccctttggcattaaaagggaaactagatcagttgtgcgaaaaaccaaaaaagatgtattttatcaacttgaaacttatcccaaggcttcctctcacactgtgttaaataataggtcttcttaattgaatttctttgtgtgtagcatatgctgggtgacattacgccagcatcttgctctaagcagcaaaacgttcttcataaaagcattaagatcctgagtatcattctggatgtaggaaagggacacagaactacaacaacttgaaagcatataaaaacagtgcctctgaattgtgattgtaaaaacacactgaagcaaaccaggaggaaaatatttagaattatagaatgaaaccagaagaagaagaataggaagaaaaggagagaggaagatgggagggtgggatgggtgaagagagagaggaaagcagtgtggtgcaatgctgtctgtagaatcaaagcaatgatgactttctgtttcctagcattccatctaaaacaagcagatctatatattcatttccctttgacagccaccatcctacagaggtgggattataaatggatgtgttgtgaaccagggcgataactatgtctgtaataacacatgcttatgttctttatcccaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggtacttgattgagagatttggctctaaattgaatcaacaagcaggctgtatttccagggaggaccatcccagggaggataatgggttgggggtggtccttgttttttcgtttcttgaagattaaaaataaagttgtgaaatataaaaattggtaagatcaatatcaatttccattttaggatatccccagatcagtgaagaggagactatagtgtttgaaagacttagaaattcatataccataatgggctttgaaattctctcaaatctcagaatagattttaattcagtgatttttaaaggccatgattcctttgaccagttcacagagatacttaccattttgtttcacttagttgtttaacttgtaagtaaattcctcgtatctctaagactagccccccaaaaatacaatactgtaataaaaatgatcagaattttctcttcaccactagtgactgcctccttctctactcatgtagacctatagaagctcttcgatggccccaagcttatcaaatccaaaatccacatcatgaaaacatccaaatttcaatgtttctcctttactgtggagtcagcttcacttcagggccatattaaattttatctcaatatctgaaagaataattacagaattacacatatctcttttatagtggcctgagcattgttttcatcaagaagtatgagacttataaattaaagaaaatctgaagctaaatcttgattaatttatcttatttccattggactaaaggggtgaaaatgttttaactgatgaagtcatattcactaaagcttcacaaattgaaacaaaaaccaatctgaatttgctaaacaattttatgtgatggatagcttcaaagaaacttttaaagtttctataactagaacttggctgactaactgatgcctgaggcaactcctgaaaggatctactttaatgcacaataaatacggcttctcatttgcatatgaattgttgcacattaatgtgtttttttcaaacagggtgatttcaaaagtagtgtaaggattccttcttatcaccttatatgcaaaattgatcagcagcatttataaggaaaagcttggctttagcaaagatgaattttagcttcctacctgtgtgaatgagcatacattctaaatatgtgaagaatgaattataaattaatcaagtcacattgtagtgttttctttgtggaataagcttctggtatctccgttgacattgattcaatgcaaaagaccacattaatgcaacattatagctgagactcatatttttaaaaatctggaaagtaaggactccccaagctccttatattttgaattactctatatgatattaaaattttgcattattatatctgttgatggatgactacattacagttgctgtgggaaccataaaattatatgtctcaatcctctaaagtctcagtgataatattgcattaatggatattttttattgaattttgaaataagaagggagaaggaaaaacagtgatgcacatcaaaatatttttcactgaggaacactataatagcacaatgaaaaaaatacatgctccattctaacttgtgacagctaatccagatcctatgaaaaaatattttctcctcttatgattaatagatatcttaaattctcataaatttaatttattgagtttggctgtaaataagactaataacaaggataattttatttccttccagttttatttctcaaatattgggcgttaatactcacttttagtgaaaaatataaggaacttatcaatgggtttcaattccaaaaatctgagattttacttatatttttgtttattaactgccttcttaccaagacgccattagcatagcttaaaacgtctttggttttgaggtcagttagcataaagctggccctaaactaaagctatcactcacgtgccctgacttgaaggggtccctaaatatctcactgacctcacagtattgactgattcaggtgctagataccttgagtgcataaatccctcaattagaaattattttgtgttgagtattgctctctctaaacaatcgcacatatccttggcttacaaggaataacactttaacagtcactaacacttcagtatgaaatagcttactatatcatttttttcaagaatggaaacttaagtttaggagtaagtggttgaaaggaacaaaaatttaacttggaatgagacgccctgaaaagggaggaagcatgtataaagaagaggtggggggtagagttgccaaaaccatactttctattgttacaattttgcctgggtctgtcttttatagaatggcaatcacccatcaactgcttacatatctttgtagttgcatgtggcatatgatcactttaaaacctttactgcaagaaaaatatttattgtagataatcttatctcagaattggaatcccccagaacttagcacagtgcctggctcatactaggtgctcaataaatatttgttaaatgaataaaccccaaagttcagttaattacatgtttgctgaactacttttttttttttaaccatcaaagctagtactgatgagaaccttattttctttttcttcatctccaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga

SEQ ID NO: 110 - DNA, 804919 bp, Homo sapiens
caacatttgcaaaacattcctttattattagaaataaattatttgtataaaaaattgcatgcatcaatcattgcatttatttttagcacaacccagggcttcaatctggtcagccattacaagaaacagactcattgtcttatacaagttaaacaatgtgggacaggaacgggagttctcacaatcacagaaaaatacaagaataacatcagacattatttatttcaacagcattttttttcacgagctaacattagttttccttttgtgatttgttttaactgctcatgaataagcaatactttagcttgacactcattggttttattgtataaaacgggtttcttcactccccgtttattgatacttttggctcatggctaatttttgttccttacaagactgactattgatttgattgattgtagtctacggagatctccaggagtgaatttttgcggtctcatgttcatcatttaagatcatataccacatctcttcagattgtgccatttccctgtttcagattgaatgattgctgtaactgatatatgttgtcttggtagaggaagctgttaagataaatgaggacaaattaaaatagtatataataatacatccttttgttaatatgattttaaaattcaagtcctgtaatgactttttaataatatccagcttttacagcatgttactcattatttttaaaccattcacagtcatgcacagcacaacgacatttgagctcgacagcagactgcattatataaaggtggtcccatgagattataatggagctgaaaaattcctatcacccagtgaacacataacacaacacaacacataacacaacacataattcacatgtttgtggtttgttgtgtaaacaaatttcctgtactaccagtcatgaaaaagcatagcacatacaattatatacagtacatagtacttgataatgataacaaatgactatgttgctggtttaaatatttactacactatactttttatcattattttaaagtagacttcttctacttatacattataaagttaactgtaaaatggcctcaggcaggtcctccaggggtattcccgaataaggcattgctattacaagagatgacagctccatgtgtgttattgccccttaagaccttccagtggaataagatatggagatggaagtgatattgataatcctgaccctgtggaggcctaggctagtgtgtgtgtgtgtgtgtgtgtgtgtgtgtgtcttagtttttaatacaagaagtttaaaaagtaaaatgaataaataaaaatagaaaaaagtctatccttgagtaagggtataaagaaaatattttttatagctggacaatgtgtttgtgttttaagtttttattacaaacaagtcaaaatttaaaaagaataaaaagttcataaagtaaaatttatagtaagctaaaatagtatatattgaaaaaggaaatgtttaaaataaatttagtgtagtctaagtgtagagtttttataatatctacagtggctgggtgcagagactcacgtctgtaatcccagcactttgggaggcctaggcaggtggatcacgaggtcaggagtttgagacaagcttgaccagcatggtgaaatcctgtgtctactaaaaatacaaaaattagccgagcatagtggcacatgcctgtaatcccaattactcaggaggctgaggcaggagaattgcttgaaccgagaggcagaggttccagtgagccgagatcgcgccactgcacaccagcctaggcaacagagcaagactccatctcaaaaaaaaaaaaaaaaaaaaaaaatttacagtactgccatgtcctaggacttcacattcaatcaccactcattcacttaaagatccagggcaacttctagtcctacaagctccattcatagtaagttccctatttacatgtataccattttttatcttgtatactctatttttactgtatctttactatgtttagatatgtttagatatacaaatatcattgcattacaactgtgtacacaattcaggacagtaacatgctgtacaggtttgtagcttagatagactaggctacaccatattgcctgggtgtgtcgtaggctataccatttggtttgtgtaagtacactgtatgatgtttgcgcaaagacaaaattgcctaacaacacatttcttagaacatgtcatcaagcaatccatgactgtagtaaaaattaaatgacagtagaaacaaaaatgctgcagcaattttaatctgtcaaaatcagtagcctcatttatagtatataaatatttactagaaaactaaaaatataaaagtgctaatctttaatattttggtaaaattttacatttgcacatatgtaaaatgaaagaacagatcaattatctgtcctacaaaatataaaaaatattttttactacctaagtcaaagacctcaattcttagaggctgatgtaatgaccaagaaaggtaagtaattataattagctgtcctatgagaatgaatacctcttccacttaaaaatacacaataatcttagactctagaggtaaacatgctaaaatatcaaatatatagaaaacatgtgaattgccaatgcatatttatggtttcttttggtttcatcaaaaggagacaaatgaagataaaatttaagaaaataaagactcaaataaagaaatgtttaattgttctgttgccaacatactgtaaagtaaaactcattattgtaaggccattacagagatattatgccaaatttatactcatgcctaagcttctggagaatataaatctaaatccaaataattcctttgtattgttgaaagatgtgatgcaatgaatctctgtcctaaaattcaaatgtgatgtcctattttttcatgtaattctggaatgaataatcgtaagataaaagatactttaaaaagcaaagaatgtatgtgtttcaatatatgaatccaattcaggatgaaacagatttttagaaaataatttatttattgaacattgaataagactagaaattgtaaagttcctcctcggaaataactgacaatcagactcattccatcttagtgacactattgatggattagacaagttcttaccagagaccaagttcatacaaagttcacaaccactaaaattaactcagatagccctaagaagtgctactatagatgtttttttcattgttgttattttttatttcattgaatattatgagcttcaggctaaaaatagttgacatatctgcttatcttatctacattgcttatccttctaggttattattgtggcaccctgcaaaggaagtagactttagacctggttttaaattacattctattccctgcaaaatgcgtgaaaaaaaaaaaatcattgggccaggttactgggcctcagttttatcactggttcaaaacctacaatactgtgttcctgtaaggtcaaaagcagaatagatcgggatggaacagctgtagtctggaagaaccaatatagaaccagcctccctccctcctttcctccctatctcccttcctttcttccttccttattttcttttctttccatgaaccatacatgagacctaatggagtcttactttctacttaacctttccaaaaggtaaaatatttgttacatttggtttggtgtgaagtgaaacacaatgattttctatgatcactcacttttactttctatttttaatttatataatactctcgtatgcctctaaatttcctctaagaaaataaaatctgtccttcagttctgcttttgaaggactttcatataatcttcacagacaaggtggagaaaaattgtcataagagtgataaaaatgactgttaaaagggtcatccaacttcctacactgttcaatattttcaacaataactaaaatgtatgaaatagttataaaatttgtatatagctagaaaaagaattatggttgaaatagagtagcaagagctgatagatcttgaacaataaagttttcagaagatgtccattcaacagatggcagtttggattagatcagttttaaggatctttctaactttggggctctgtagctaattaaaaattaacatattattttttgaactcttaaacatggtttctagaaagaaaatggtagaattctattgagaattgagaaaacaattcacaaaaggacagcaatgctaattttcctactggttagaaaaggaagtgtaaggttctggaatcagatgatttagtcaacatgaaagcaatgataagggacaaactttgtggatggcagatacctcgcaagaatctttatcccagaagtattatagagcaaaatgaatcagagatgtaccaatgagttcatagggagatgtttttcacggtgctgatgaatatgctcatatgaaaatcagtttttgagcacagcaacagtaaattaatttccttgtgtgcatcacactgtgttcataagctagaaaaaacaaatctacctccagcagcagctgttttcatgaattattcatgaacatagcttaaagaatactatgtacagcatttgttaattgggtacagttggcaaaattcatatatatcaactttgtttctaactcccctcgcactctgttgtgaaataacacttgaccttttttaaaaatgtaaactatagtctgcaaattcagcaactaacacaacactcattggtttcccatccagcttcgtattacttatatttactctgtgtagcttttgaaactttaaaatcttgaacacagatctaccctttcattgtaggatggccatggaagtgaacaaaggttaaaaatggtgatctggagtaggattgtggaaggatgtgtgaagatgtcacacatctttctctcctgaatgagtacactgtaatcactttacttcggcccaacttattcaaacctaaattatactcctgtaaaagatcaatgcactaaaatctccaaagtacaattaaacttttttttcaggcagtaactgatattatcttgatttactttttgactttacttcaccttctaaacgtgagcatctgactcctccagaatattataggcttaccctccaaataggccttgtttttgcaatctttcattcttattttagagaaaatagagaaatacatgcaggctatataatttccatttcaacattaatagaaaataaccaaaggaaaacagtatctgtatgagatttacttcaataatatgagattggttcttatcaatactgagaattttgtttttcagggcatgtatttattcttttaaagtggtgaaaaagtttattaaattttttctccaccactttccaaaggtgagtctgaatgactggtatttatatcactataagtttggttctttaatttggcaaccatattttataaagttttctggattgctgctaaaaaagaaaaaaaaaagagaaaaacaggtaaaacaatagactctggtgagtcatagtgagaagtgccagtgttcaaattacatcactggccaacagcagtttattggcatcctataatagctttcaacttcctacactaatgctgtcaaggtaggaaaaaaggtaaaattctgtcctcaaatcacaagcattctactttgatgcctttaatggcagttacagtataccttttgctaagagccgaaataggtttatcattagtaaattgcttacctatactcagagatgattgtaatgatttgttactaaagcccatccttaccttgcttcgcatatttcttacttcacaaggtttcatgtttgcagaaaggtgaatatgtggagggtgtttgtgaaattcttgtaaggttcatttctctacacgtgactaaatttggtattggtgacccgaagataatctttttagaaccaatctggctaatgattccaggtaagctgatagtaactgaaaccaatatgtctaattaagcaatgctaattaactatcacaggatagttctgtgtatggtaaattagagtagacaatgcttatctagaaatcttgatagaaaagaaggtttgtagatggaatgtagaccataagttgctataataattaaaccaaataaaattaatttttagttttttcttatatttagtgtcaaaagtatggagagtaggggatacagactgctggatgaatatgagaggaagagaatatttttgcataggattttgtccttaatgcctgaccgggtgtggtaactcacacctgcaatcctagcacttttggaggcttaggtgggaggatcacttgagcctaggagttagagaccagcctgggcaacagagtgagaccctgtctctacaaaacaaacaaacaaacaaacaaacaaacaaaattagctgggcatgacagcacatgcctgcagtcctagctatttggaaggctgaggtgggaggatcacttgaacccaggaggtagaggctgcagtgagcctagatcataccactgcactccagtctgggcaacagagcaagctcctgtttcaaacagaaaaaacaaatattgaatccctatgctatattccaaaagactggaagccactctaatacaagtacctttgcttttctttcttttttgattcatctgtagaacctagtaaggtaaaggttgtaatgtttaccatattcagcttcctggtattttaccatacaaatcttcaaattatttgccactctttcatagataccaagatgggcttcaatagatcagttaaattctactggttgagcacagatttctgtgtattgttatcatgtgctttttcctgggtggactgtagagacgaaaataggtaaagaaaagaaaaatggaaaggtggttgtagaaaagattctatttccaggatcatgaggcttttaaagaagaactttaattatcttaatatatccaagaagggaagtcaagggaagccctcaggaagcccaaggaaaggggaccacgtgggagaaacaagtattaactgtgacttaactaaacatattggctaactagagttctcatttccctaaaggcacaaataacatcatttatatgtgtaagatctgtagtgatattctgtaagtatcagcaaactactgatactataaaaagcacccagtatggaacaagaaaaattgtggaattgtttccaagtactaaaagataatttttataagaagatgacgctttcaaataccaagctttgtaatgcttcaaaagaaagatctgaatgtcatgctttgtaaaagagattttgtgagcaagtttgtactctgtagaacagccgctcatcttgagaccatttgcttcgaatggttttaaatgtgatggtgtcacggtatgtgagtaccatcatgcccctggaaacatgtagcacaatccccaagactaggagaagaatgttcaacgtacatctattaggaagtgctcccgctcttgaccatcggaaactctacagatgacttactgttggtttcaagactctcacagagttcacttttcacctcgccatttggtctgtcatttcctttttggatcagtttgctttgcatggtggcagctgtcaccacagccttgaagctcctcttgcgtttttgaacattctgttctggatgaaaaattataatataaaccttgggcatatagagcatgcccagagatactgaagcacttaaactcatggagacagtaagtgttgttgtctggatgtacatctgagggaagaaaaaaaaaagaatcactgttggtaagcctaacagtaggagataaagcaaataacatactattttctaaaattgttccagcttctctgctaaaggcacattaaaaggcacttattgaaattgtccttaattatagtcaaccattcctgtgtcctaacctgcaaatgtaaatgagtaaggttatttttttattgaacccaatttattaaaataaaaatacaaacaaccaagctggtggagtttattttcctttttagattataaataaacatacataaggaaggggaccaaaccagtctggcaaaacactaacacttaatgccacacagaacttctttagaaggtactagtgggccaagtgttattgtagcaataagtttaacccagaaggtaagtatacatagtgaaaatagagtgggagtgcaacattccagaacatcactattacacacctgtgcttgaataatgctagtggttgcatcttcacatcattacataattccaactaccaaaaatcacaagcatgtcataagggcttgattttttttaacagtccctctaaagaacacttccagaaggttctcagtgatagcatcatatcgaaataagtcaggtgcttttataaaatatgtaagatctcctccctccaagatatatgcactgggatatggtcccggtcactgcattctgaaattctccccctgtgctcattgcttgcccttatcccactgaaatcgactgctctgatacttacagagagagctctttctggaaggtttttctttctacaagctagaggttaagaatctgaaaaaaaaaccaaagctaaaatcactgctttggctttttcttttttggttatggtatagaaacagaaacagcagtatttcattctttaaaaacagaaacaaaaacctttgatctggttccacttttcatgtcctgagctcaaaatagaattttccccaaataacttgggatactgaggccacggagaaaccacatcttaagactgtaaagagattctccctttgtcatatctacgaccctcattaatagatctgttcactctatttacatctctgaatatgatcctgattagttggattttttaaatatgttttaatctgttagtcttgctaacatctatcatactagttagatctcatctggcaatcctcaagaccaaactaattgtgtccttttaaataaagaatcaaaaacaaaacaaaacaaaacaaaacaaaaaaaaccattcgccctcaagggtaaataactgaatcagcattagtgttgccttttcctagaggagaaggtttctcttaacagatggcaaaaccttgcggtaaagaactgtccaaaccatgagcaggatgtgaggcacaagttaagaaactgtctttggatataaaatcataccatgcacactgctgaatttactgcccagttcatctgccactaaggctgtccttgcatccttgcataagagctcattgtttaagtgtggaaaatgctttaacgagatttactacaaagtttacaagatttactacaattaagaccatcccaatgaaatagggatgtgtacgtttacggcttataaatctcctaagttttgccatctacttttaagcaacctattattttaaacattcctaagcttcctaagtattggttaatcttttttgaattcctgcttattttcaagctagcattgctgcaaaaacctacatagaaaattgactgcagagagaggacataaaggtaagaaaagaatgtggcaaagtacaaaccacacccatacatgttccaatgccagtcaaatagaaaaccaccagtcagactctttcaagtcaatttagcctaaaaacaaacaaacaaatccaacgacgaaacagccataaaatgatgggaacatctatactgattagttggattttttaaatgtgccttaatctgttagtcttgctaacatgtatagtactagtccaaatagtataaaaatatttttgtaataaacatcctatacattttctctgttaccaaaaatataaataatagtcttctcttatttggaataatttctgcgatatatagtaaatttaatcctgccaaatattagacatgaagaggactttggaatgctagcttcctcgttaaataaattaccgcagtctatccttttggcaagccaactcaatgaaagatgtaataaacacagatattagaattaaatagtaccatggttagtgtagcaagctcttcattggacgctatactttcaaattataccaaaatgctgatcttaattatgtactttcttaagacagcttctgaaaaattttaatgtgagtttaatacaggaaaggcatctaacaaaatccttagcaaactaacagaagaatagaaaaccaaatactgcttgttctcacttataagtgggagctaaatgataagaacacatggagacatagaggggaacaacacacactggggccttttggagggtggagggtgggaggaaggagaggatcaggaaaaataataacaggtactaggcttaatacatgggtgataaaaataatctgtacaacaaacccccatggcacaagtttacctatataacaaacctgcacttgtatccctgaacttaaaataaaagttaaagaaatccacaaaatcataccctaagtccacaaccttacagtggcctagcatttgttacagggccatggaaggaatatgttccagtagacctgggtatgaattctgaaccaccacttaaatacatttttttaaaagataaagtttacagagaaactctagagttattttctgggtgattaaagtccccaaaccaacctcccaggctacaatctaaaccaatcaatcttccctggttattggacaaatatggtatcttattttcttctctgaacagtaagttcttatctatgtcacagggtggggttgggggtaatacttttctcatagaggagttacagggtagcatgatatatttataaaatctcttacagatacaagatagctcaagaaacattctttaccctacaactttgcatctaaaaatatgctaacaaagtatcctcccaggagtataggacaaaagaaggacctattacacacttattcaaaccagttttgtttagagaagagctgatagccaggctctgactatacgatgttgaggaaaaggcctttgtaatctcactttaatgtagacagaataaaattttgtccaaatgtgaactcaagaccatatttactgcctgggccacatgcttagaataatataacagctctttatctcaaagttacagctcatcagaatgcaggaggggactgtattaactcccactaacccacaaaaattcaagagatgctagcaatgatattggatatgtcaataataatcttctctttcccagccttctcttacgtgctccctcctggccctgtcactccaaaatactaacacccagaggatggggactatcttttctatcacacgcactgatggcttgttacttactctgcctccatgccccatggacattttgaacctgaagcagtcagatgccctgaagcagatttaagcaatctctagataagccaggggtgagctgtgacaatggagcatactaatatgaaatcttttctgggacctattacagttccctcttcaaactctggataggtcatttgtacatatcaaggtctactcaacgtaggccatgatgtggtatcattaaagactccaggaagagtgaggagggaggagattttatttttccaggataaaggtcagtcttttgctttcaaccagctgccagtgcacagaccaccacagactctgacatccaacctggtatttttgcaaccccttagtaactaaggtaaactattatgaaacctaacactcaaagcaactttatgccacgtgataagaaacagactcagtatttattcctgactatttctgttttgccctcgatggtttaatcttaccactttgttttagtcaccaggttctgtttggctgctttgcataccgtttgaccagctagaaagctacactaacactgacagcctgtatttctctgcttctgtttctacttcctcatctgcgtgtctgccaaagtgaaacttgcatcaaaaaatgggttttcttttgctttttagcagccaatggacttcaaaataccatttactactagaagtgattttttttttttaaagatgaagaagtttatagagaaactggagttgtcctgtgggtggtaacaccccaaatcaatctatcatgcaaaagtccaaactcataaaattcccctagcaattgaaaattgcaaaaaccagaggcaaccattcagctttgctggctgagcctgaaaccactaccaagctcatatcaaacgtttttattttgttcctgtcttgtttacattaaatatcttcctagtttcattgcttagtctttttctctctgtctcttactcgcttgctgatcatattagaattacacccttaaaccaagacaagcttcatgggtgtgcacttgtacacaagaccctgtaatagaagggccccatgcttggtttaatgctctgccacgaatgttttgaagtctgtaataattgttaaagaaagactcctgcattttcatttcttactgggttccacaaattatatagctagtcctcttttaaaaatcacttatatactgacaaattccgggcttttcttaggaaaggcatttgtcttttgggtcactcccttcggtgcctgacagcatctgaaacttaacaagcctctgattcccaatcttcatccctaaacttgatctcccagtggtctaccctatctcattaataccgtgcttctagttcttgggagagcaggtggacagggaacttgaaattgtcttttactccttttttatactcccaccctatctatgaccatatcctattgattctaccttcaaaatttgctcagaactttcagaatgtctccactggtgttacattgctcagagccatcatcatctctcatttggatcagtactgtaactgtcctagtgttctctttcctgctgcccttgctctcttctgtttgagcatttgattgatcctaacacagaagctagaataatcccattattcataaactgaattaggtcactcctactctccaaagcctactctccaatgacttcccattgattgtatcttgacaatggtccacaagatcctctgagaactcctctggtttactctttttttactcattcccttccacccatactggctccctggctgatcttggaacataccaggcatgcttctacttccagacttttatatctggtggcttgcctcttcactgccttcaagtctttactgaaatgccccagctcagtgagacctttcctgaacacaccattgaaaattgtaacccccaaccttctaccagtattcctagctttatcacactccttagtatctaacacattatatcctaaaagtctatatattttactcatttaatgtatgtggtacctatttcccctagctagaataaaaattccatgaatattgggaattttacctgtgttgttcacggctgtaaactcagcacttagaaaactgtctggattaagaaaatgtggcacatatacactatggaatactatgcagccataaaaaatgatgagttcatgtcctttgtagggacatggatgaagctggaaaccatcattctcagcaaactatcacaaggacaaaaaaccaaacatggtatgttctcactcataggtgggaattgaacaatgagaacacttggacccaggaaggggaacatcacaccccagggcctgttgtggggtggggggaggggggagggatagcattaggagatatacctaatgtaaatgatgagttaatgggtgcagcacaccaatatggcacatgtatacatatgtaactaacctgcatgttgtgcacacgtaccgtaaaacttaaagtataataaaaaaaaaaaaggaaagaaaactgtttggataacagacattctctataatcttttgagttggtgtgagttcatactcccaaatttgggttttaaggaatataactcatgtatttccaagaaggaaaaaaaaaaacagatactgaaactacaaaatatcagaaaactggaggactggaggactccattctttttcatagcaatctctaggctgggagagaaatgtaatcttgggcagataaacataatgcccttttaaacagtaaacttggtaataatgggccattttgctctccatcagcaatgaacagtataattcaaagtcagtcgttttcactttgggaataggagagctctgggatctgccctcaaaacaagttaactgtataactgagggtcaggcactcacattacttctaagttttcatagacttaaatcaaaggatttagtgagacaacatatatacacagtggcacagagcctgggatatattaattaataagggatagctttattgtcattatttaaccttgacaacctgttctctattcatcttccttcattctccacgtcagaaacgcttaacactacttctctctcaaaatcagcttcaagacttttagcctttatagcagaaacacacacacacacacacacacacacacacacacacacacacatacaagcaaaatggtttattcataaggaaatatactttatgtttgtgggaaactttagagtcaccacagcaaagaattatagtccaatttaactctgggaaaaatcaccgtcctgagtgttgtgtttctcctgtcaggtagaaatcacagtgctgctgacccagcagcaggtcagatacattgcactgtgttttcattagtggaggtggagaccagttgtctgtaatccatttgcagtcacttatcacatcccctttcggctcaggacacatatttgcaacatgaagagtcaaatcaaaagctacgaataaagaattgtgaaggaagactacagatgcagagcagggcttgttctccctcctgtgaggtctttctgaacccttaaccttggaatgattgggagaggtggaaactagctaaagagaatgatacagcatcaaccaacaagcagaatatcagcttctctaatgataggaaagaaccacgtaaggaagctcaagatctgttaaagaaggagaaaatctatctgatttacaatgactataattaaacataagtgatctttaatatttggattagtaaataatttgtttttattaaagcctgatggaaaatttaaaaacagagtaaatttttaaaactatggcattattaaataaaatgtggtctttaattttcaattattatatatgagaattatttacagaaatatagtaaataagtaaactgatgttgcattttctactgggatatgtatatgaaaattaatacaaggtgtctactctctcagtgcttattaattcctcctttacaggtatttttgctcatgttttccttcgtggatttctgcttccatggtaacttttggccctttatcactgcagcagcatggacagaactgggaataacagcaatggggatgtctttaattattatcatttgaacggatatcaaaatataataatattttcaggtagagaacaaataaataaaagtataaattagtttagaaagaagcaaggaagaggaaacaattgtttcaggaacaaaatttatctctgaactatattttaaagtatctctatctctatctatctgtctatagttctagaagccaggaaaagagaaaatatgttgaatcctatatttatcactgcctagagacggaagccttgctagaatttaaattttaggctaaataataaattcaggttgtgttatctaaggaaagttggtaaaattatgaaaatggtttcaactgtagttttgcgaaaggcactaaatcttggtcagatagatattttctctataaccctttttaaagacaaaataattgattcagtaactcagtgcaggtgcttttgcggaggcacatgatgttttaaaagtgctatttttttttttctggtgatatcccttaatatagtaagaatcaagaaaaatggtgttatgggctgaattgtgtctcctccaacatttgtatttcgaaggcctaacccccagtacctcagaatgtgactgcatttgaagacggggtctttaaagaggtaattaagttacaatcaggtcattttggtggtccctaatcccatatgcctgatgggcttataaggagaagaaattaggacacaagacacacagaaggaaaatcacgtgataacacagggaaaagatggccatctacaagccataagccatggagagaggcctcagaggaaaataaccttgttgacaccttgatctcagacttctagtatccagcagtatgaggaaattgatttctattgtttaaaccaccctgtgtgtgatacagccctggaaaactaacaggaatggggagttgatatcactgaaaaagttctgaaagttctgtgatagtagttggttgtggttaaatataccaatagaatctcaaagatgtctgatattgattaaaacgatgagtttagatactgtacaataactacaaccataacatctatcaattattgaggatcaagtacagcattatgccaaaacttttatgcacttatttaacccctcacactaatcctgtaaggtaggaatgaataagtctatttttgagaattacacagtcacgaagaagtcatttttgagacacagtcacttttgaaaagtcatacaatacatgaaaataaagtgtagattcaaactgaggtttctctaatttgaaagcccatatccttaccacacaccatctggcccccataaatacaccgagaagtgaaagagcaggattaatgtgacttgagtcctctccaaatcagagaagcatcccttttctaatagatttgggccaaatttcttctaaataatagaggcacagttaaagcacttcaattaatatttagttgtgcattagagggtttctgctgttattaatcagctactttcttcataaataaaagcctcatgtggatcctagaacagctctggctttcttataattacatcttcttaaacttgacaaaataatctagctgagaatatgggcctgaagagctggataagttaatcttttaaatgatgtttagcattgagtttgcactgggttggagcagaaaagtctctgatgaaccactggccaccagaaagaacagggattccctacatgcagaagacattgctgcataggcaccattccacctctatagcaccagagacaggctattgacaatacagcaggcaggcgaaggtggattcaaatacagatgaactgacaaccaagaattagcaaatacttaaggagaatcaagacaccttacaaagagaataatataaacatacaaaaatagatccaatagagctaaagaaggaagactgtggaattaaaattattgttatcttagagaagttttgaaaaaaaaataacaaatccataaaaatatcaaataaattcatataagctaacattttaatcattaaaataaaatctcagtagatgaaggacttctgattctggctatggaggagtagctataatcaaaccaaaccaacttctgagaataactataaaacaatcataaagttaagggaaaaaagactatttggaggtgtcagaggagaaccaaggtagccaggactcaggggaccaagatcctagtaaggaaaaagaaagcacattgacatatgtccagcactctccactgcctcttattcccaggtaacgtactgattctacataggaaagacagaaatctttagacagacctgtcagcagtctcatgggactagggagataaaatctggaatttggggttatcattgcaatcaggacttaaggacccacaattctagggtactacagagaagtaaaccgggtattttataccttttttttcccttgagactttgctgaatcctaagtgtaagaaagcagcaagctaaaaaaaaaaaaaaaaaaaaaaaaaaatcaaacataatctagattcagagagaattcagttagaattcaggtccatggaggagaatgattactcataaaatatcagacatttagccaatatatctaaagggatattgctgaggaggaaaggtaaatcagaaatagacaaatccataaaaacctgaaacttatcctcgaattatcccaatcccagattatatcaaggtgaaatgtcttgatatatatatttcaattgccgactagtagaaaattgaagcttctctagaaggaaataacaatatatataacatctacatttttttaaaatgtacaatgtcagttattcaataaaagattaccagccaggcatgctaggacacaaaaacaaatgaccaaaaaccgtgggcaaacaacaacaaaaactaaacaggtgacagaaatggtgccacagatgatcagaaccaggcttctcagacaaaactttaacataaatgtattgaagaaaatacataatacgatattttcatcagaggactggaatgtgtctgtgtgtgtgcctgtgtgtgtgtgtattgaagtcaaaaattataggagtgaaaaatataataattgaattgaatagatgagtttaataactaattagctacatggcaggaaatgactgatgcattaaagataaatcagtaaaaaaaatatccacggtgaaggatggagactataaatatttttaaaattcagaaagaaattattggagatatataaaacatgatacaaaatttgaataaacatgaatcttaagtcctagaaagaaaggagagatataatagataaaaagaaacacttaaaagagacactggacaataattttccaaaacttatgaaaaataatctattaaattgtacagaaaaaaattaccagatggccacattctgggaaatcctaaaaaatttcaaggatttaaatacagggtatgctatctgactaatgtgaaatcagattagaaaatagaactaggttggaaataaataacaaaagaaaattgccaactgtttgaaaattaaacaatacatttctaaatcactcataagtcaaaagaaaaacaatggaaattagcaaatattttgaactgaataataagatacaacatatcaaaagtcatgggctaaagcagacacaaaagaagaaatcttgatatgattattcatctcaaaaaactaaagaaaagggagagaaaattaaatccaatcaatatagaaggaaggaaataataaagataaaagtcaataaaatagaacacaaatgtaacataaagaaaatcaacaaagctaaaaaaaaaaatctttggaaagactgtaaaattaaaccactcacaaggttgaccaagaaaacaagaaacaagacataaattaccaataatttggtaattattcctaaaaagggaagaagatgtgatataagattttaaaaatatgccagcaaattacttctaaatgttgttagccaaaaaaaaaaataaagtgtatgtttaaagtttaagagcaacttagaaaaaaatgaaaatagtatctaaaactcctgaactatcaaatgaaaaaaaatgagagaaaacttgatcagttaaaataatttcagagaagacaaaaaaagaaacatgagaacatagtaaaaagaaaacagaaaacattagcaaacataaatcattaattttcattataaacactaaattccctatttaaatacagatattatcaggtttgattttaaattgtattctcaaaagagaaaagcatatataaagattataataagccaagttgaaaatacattttctatgccaggaaaatgtaaacaaagaaatctggaaagtaatattaatataggacaaaatagaatgcaagatataatcattaaattatgcaaagaatatatatacacacatacaattaatccattatcacaatgtatgtaagcaacgcattatagaaatgcaaggatagacaaatccataaccatcatgagagattttaattcatcttttcaaagatagaaatttgattatacaatatataattaagaatagtttgaataagtcagtaataaaattatcattttcactgcattattttaaaacataaatgagcttcacagagatcaattatgaattaggttatccagcaacaaaaataaaattttcataacaggaaacatgagactatatcctttcacctaaaaaggtaatcaaattaaaattataatttataaataaatatgagtttttatttggaaaccaaatatcatccctgtaagtaactcctataaaaaggaaagtacaaactatttagaaattgaataatcatgaaaacagtatgtatgaaaacttgtggatacaacctaagtggtgcttgaaggaaaatttaaagtccaaaatggcaatcttaggatgcaggaaatctcaaaaattaatcatggaactaggtaaactttaatagaaaaaaaaaaagtaaactcaacagagaaagaagaaagtatttgatataaaagaagaaagcgataagacagaaaactatagtactcataaaccatatcatatttggtaatatgataagtccacatagaaatgaaaaataagatgtaagtaccagtacaaattagtttttttaattctaaaagcaaattttgcataactttacaccaataaatatatacatctagaaaaaatgcaagattgcccaggaaatagatattagaagtgagaaaacaaaacaaaactatatggaactaaaactatggtgagtaaatcagaaaggtagtacgtgactgacagaatgatgatgaccctgcctgagagagagccagccatggagtgagaacaaggaaaacaaggaaagtattcacccccagctcctatgctgttcccctacctctcatcctctgacacttacatcagcatttttattttgcttttcattgtgtattaggtagggtacagtccttttcagaattagtgatgcaagtgcatggcaaatatagtggcagagacaatttttctgatgtttaatctcctcttctaatattttatagtgtcttgctgctatttgaaaggaagaaaataatggtgggtatcttttcccaacgtgctgaaaaaactaattacggtggcaatgcagaggctccactcaccccttatccctgggctatctctggggagcctggatatttgctaagattggcccctttactaaggacagccctatgataaggagagttgaggaagatgtaaagggaactctatctgaaagggtggaaagcataagacaactaaccacttccaactcagcctcaaagactcagaaccctttctgtgttccacaccttgataaatggtatctttcacaactcaaggatcatgacctgccatgattcagcaatatttttacctgctctttttatgtctgcctagatcctgacagccctagacttactacatctctgagacaatatatagggagatgttcctgggtataagaaaatcttagtgctaggactggagcctccagaagattcccatgaaggtcaaagtagccaggtttcaagagaggaaaattctcagacatgacatttagaactttctataattggtcactatcatgtctgatgtagatatatgggtctgcttggatactagctatggctgaagcactccagaaaattaaaactttatccatacatatggtgacctctccaagtcactatacctagccaagatgaagcatgcactaatatgagaccagtaatctgctacagtgtgtactgattacacaaattggcactaagagccccatgttgaagattcaattatttgtggtaatgacagctttcaggaaaagacaaaatcatttcaaataggtcaaaaccttaaaacacccagtaatcacaacctcagaaactgtaggtctcaaataactaccagtgaaaggtggagaaggctttgaccagtactcataactctagaccacagacaaaaagtcctcttcttgcacattattccataagctctgtgatgtaaaagagagcttagttgttgcacaatcttatctacggctgaaaatcctcaccagctttagcagaggcattactctgaataaagcacctacagggctttaagattattaccgtgaccaggtacctgaaagagctaaatacaagagagtgaaggagaaaagccttatgtacaattttcaatgagaaactagcccgaagtccctcccacaacagtttgagacagcttctaggaccatttcatgacagtcattaccttgctggtagccctgcaactgacataagttctcagaacaagagagttgtgaagtatgagccagaaccaagaaacttgtaagtatattttagagccattagtcactcagaagccctaggcatctaaatctcctaggacagtgaactcagacatcatctgaaatatccctctttttgatgagcatagtgccttatgctactagtttcattaacttcattgatgtcctgggttcagatgacctattttgcccccacccagatcaactggacaaccttcttaggtcctgaatagtccttaggtcattagcagtctgactgagtcttctcttactgaagccctgtgttctgttgagaataaggacagcagattactcctctaatcaccagtctgctcccaaagtgatgcagctcagacacaatattccactgaaccaactagaatactctgaattttattgaaaatcactcaattctttatacatctctcacctgtaaatccattttagtgtgctttgtactcctaacccacaaccacaactcctctctatccccagcctcttctccctgcctctgcccttgtggtcttaactgaaactgctctttccaagagagttgtttccaccccagactttcaagtcatggttgtctttatttcttcaattcatattcctcagggaagatgataaggttggaccatcctttattcacctttgctgcttccaggtcattacagacttgtctttttctccaatatcctgcctttgaaactgtcttaacattcaactctacatcctctttctttcatccttgttcccgtatctgccatcagttgccttcattcattggaggttctggctctggtacctaggcttgctctcaatcccaaatgatgctgttatttcggatgaattctacatctcattctcatgatcacagctagaatcttcaatactgtgtttagtttcttgtaatacattctgtaaaatacttttggcttaatgtattgtttttagtaagagattgtttacattgcattgcattttcctttaagttatttcatttttcccttagaataaatataaagagttatgtcacatgcttcagtgatgtgagcattgttgtcgaggagtgacaagtaactaaaaatatgtagaagggatggatatttctcacttctcataatgcatgtttccttatggaagtggcttgccaggcagcctttcaaggtaccaaaattaatataaatgtgtacaggaatcttttgcaataaaactagttatgacttgttccaagtatattttaaaactgaggctgttaagttttaccacactttactgtgacagaatgtgaacttttccaagtgtgaaaatataggtattaaatagggtaacttgtattttcctcagtaataaaaaagcacatctagctattatcagacaaggtatgtgcagttataatagctgttttatatattatggtgttaaaaattttaattaaatattttatattcaaaatgaatctttatttctaggatttttatggtaattacccacatcacaataacaatatttactacagttttcattgcaaaggtcctgtatttcagttagacaattagttagatagacgtttgtggatggcataaagacaattatcacatgtaatattatatgtataaaattatatctcaaatgccaccagtcaatttaccagcataattttggaacataaaacatttttaagttggaaggccatctggatgctattattaaaactatgttcctaagagtaggagtaaagaattatgtggataaattattccattagtaaatctgataggctgagttccaaatatgtacaaactactgatgcttcagttttcagaataattgcactcaagtgaaaacttttattgtcgtggaggaaatattgagtattctttcttttgatgtgatacaaaaaatggtcctatactttctttttccttttattatttttaccaagcaactttataaatgtagcattttaccaagatgacactcaggagaaaaagacagacatttgtaatagggaaaagggatgtggcataggtagctaacaggacaccaaaatgtgtactccttcttccattgtattggattgtttctggggagtgcctggccagtcatcgactgttctgactagatgtagtgtggttatttgactggttttcaacctatataatgtgaacaagatgataaatgtcataaaagtgttttacagaattaatgtgtgtgcacttttccctagaaactcttacctcctgttgctgattctattatttatgatgaagagacatcaggggatgcaaagctataggatggaagacataggggttcctgaatcactccatggaagaaaattgccattcaaccaggaactacctcagactactatgtgagtgggaaataaaattgtatactcagtgcatatactttgaattattttcctacaagtggtggatacgtatcgtataactggttagtcagcccctctgactaaggaacaagtgaaaactgagaaggatgacagatgatttccatggctatggcagaaaaatgaaattacagtatcctcagatggattgtaacgattgaccttgtgcacattaatacgatgttctaacaaagtgtctagtctatcaaatataatcccaagccattaaatttattcctaggttcagtgacctcggtctttggttagggaaagaaagcaccaagctaggctttttattaaattttcaaggaagaatcatttcaggtacttcatatagccttcagtaccagagggagtttataggaaaggaagtctatataacagcatttccaaaaggaagttgggctgtcaagttaatagcctaaaattcctatgtcagcagctttgcacttgtgcctgatgtacaactttctcttttgacctctttccctcagctagttcaaatctgacactgcctgtaaccaacttctttgtctctggaaacaactattgccaatctctgaatatctaagaaaaaaaataactacaaatttgtcttcatttaaatatagtgtttatatatatacatttttatttttgccattatgctgtgtttctactacataaaatatagttacagttttaaattgcagttttctatgattaaagaagctgaattgcttttcctataattattgagcatttgagtatcttcttctgaaagtgatcaaattttttgcccattttctattgagtcatttatcttttttcttatcaactttagctcctccattacatattatggatacaagtttcttgtatgtataatgcaaatatcttccacttcttttactgtgtggcttgccatctttttatagtttttgtcttgaaatctattttgtctgataaacgtatagctacccttgttcctttttggttccaatttgcatggaatgtattttaccattcctttattttcagtctatgcatctttatggtgaagtgtgtttcttgtgggcaacagatcattgggtcttgtagttttttattattttttatgatttttgaatcgattctgtcactctgtcttttgattgaagattttagcctatttacattcaatgttactttattgataagtaaggacttactcttgccattttgttatttgttttctgattgttttgtggtcttctcttccttccttcctgacttcctttcagtggaggtgatttttctctgttggtatgttttaattttttgctaatttttcattgtttatctgttgtatgctttttgatttgaggttgccacgaggcttgcaaatatcatcttatttttttagactgatgacagctattattttaaactcatgacaatgtaatgcttattacataaacaaactaataagcaaagagaaaactattaaaaactctaaactttaacttcatccccccacttttgaggtttttgttgtttccatgtatatcttagtgtattgtctatgtcttgaaaagttgttgtagttgttatttttaatcttcatttcttagtctttttactcaagatgggtagtttacacatgacaattacagtattataatagtctgtgtttttctgtgtacttaataataccggtaagttttgcactttcagattattttttccttactctcctagcatattttttttgataatcaaattctctcagctacatatgttgaaaaagaatttccacaaccctccattgtgaccattatcatgaatcagatgaacatatatgacggggtctgtttctcaattctattccattccattgggctatttttccatccttgtatcaatacctgctgctttgttactgcataatttgatagcaaacctcaatacttggtagtatatgtcttccaacttaatttttttctccagactgtcttcgctcttcttggtcctgtataattccataaaaattttagagtcagcttgccagttttcgatacacacacacacacacacacacacacatccctactgggattttgattaggattgcattaatgtatagctcaatctcggtatttgatatctttataaaattgaatcttctgatccatgaatttttatatacttccatttacttaagtcctctttaattcgtttctctactattttgtagttttcgatgtagaggtcatttattttgttagatatatttttagttatttgatatttatgctgttgtaaattttatatttttatttttatgtattcattccttctatatagaaatgtaattttgtatattgatcttatattcagtgaacttcttaaacttattgattctaatagtttatctgtaatttcttttggaatatctttacacagaatttatgtcatctgcaaatattgaatcttaccttttctttctaaactttatgtcttttttctttttattgtcttgcactagataggaatatcagtacaatattgaataacagaaattattttcagtatgaaaaacaactaggcatctttgcttttttcccaaatccaggaagaaaacttttagcaattcactgttaagtgtatctgctgcattttataaagcacttattaccagattagataaattctcttatatgcttagtttgctaataatgcattttaagttataaatggatattaatttaagtgaagtttagttaatttaagaaaaatttgcctttttatactttttcagtcttcctgtcaataagtgtgtcttttattaaaatcttgttctcagtctttcagtggaatcctgtaattttcttaaaaaaggtactttttttttagttagaattgttctaaagaatgtaatggttccattataaagagggtattttttaacccatcacactttctaacaggttattaataggatataagagagatgttgatttttttcatttaaaatgcatctggtcattgtattccttattaatgtaagaagcatttacttgatgtctgttgatattctaggaatatgatagttgaaaaaagaaagattatttttcctcttccttttgaagaagtagaattcttgattctgtataatgtccatattagtcagggttctccaaataccaatttcctattgatatatgtatatattatggaaattggctcacacaattatagaggctgagaatttccatgatctgccacctgcaggctggggaatcagaaaagccaggggcataattcaaagtccaaagacctgagtaccaggggagccaatgatataagttctggtccgattccaaaggcctgatgtcccagagcagaaaaaaatcagacgccccagctcaagaagagagacggaattttcccttcctgtacctttttgttctattcaggccatcaatggattggatgatgcccacccacactggtggaggggtggtcttctttactcagtctacctattcaaatgctaatctcttctggaaacaaactcataaagatacccagaaataatgcttcattggctataaggcatccctttgcccagttaagttgacacaaaaaacttaatcctcaggacatactgcattggttttgaatttctgggtaaattctaaataaaattaaggaataaacattcttttattattattattatactttaagtttgggtatacatgtgcagaacatgcaggtttgttacacaggtatacacctgccatggtggtttgctgcacccatcaacccatcatctacattaagtatttcccctaatgctatccctctcctagccccccaccccccgacaggcttcagtgtgtgatgttcccctccctgtgcccatatgttctctttgttcaactcccacttatgagtgagaacatgcggtgtttggttttctgttcctgtgttagtttatttcgttgctgagtcttcaagaatgcctctagaatcttatcattatgaatggctttaattctttaagacaaattttcttcattagcaaatgagagcatttttctattactagttttcacagcaatttcttttcttttaaaaaagaacagatatcgaaggcttcatgcttttttcatattccatttatagtatcttaaggcttttatgattagacaaaataactagatttccttgtatatttaatatattctcattgtgacagtattttaattctattgaattgttgcttccactattttatttactcttttacatctgtatttataagtatagttagtctagttccttttaaacaaagtgtatactcttaataatgcattactacaataactaacatgttatgaattactatgtgtgcttaaaacaaaatacttagtgtttatctcagcaaagggcagaaaaaattaaaatgtattctgaaaacaaaatcaaatatgtttaagaattttttaaaattccattgcatacaaatattcaggcaaaggcaggggctttataaacatgtcaaagaatgaggtcaatatatttggttgtgatactcaataaacttccatttaccattctcagaacatatccatgtggaaattggtctcatggaaaaattttttaaatcattttccagccatagatatagtggcaaatgatttaatataatcaaacttcaatttcctcatctataaaccttttataacgatatcatctctaattgtctcactagataactataaaaataaataagataatgcatatgaaattgcctcataaaccatgaagcccataaagcactgtaggacactttgaatatctggtgttgaccataaaatttcaatatctgcccttattgcttgcctacaatcccagagagacaactggtgcaaaaagaattgaaatgctgaataacaagaaaaagacagtgtaccattgacataatatttgaaggttttgtatccagctaaatctctgtctctctcccctactattctttttgatatcaacatgtacattgatagtccacccaattccttggcctttcaatccttttcatttctcacttgcaataatcattttctctcatttgtcttaagaataattgcacacttgccaatgtcttaacttcaaacatcctgagctctgaccactaccctactttttcaagcctatttcttctcttacccacatcaacaattcttcaatcctacaatttcctgtgatactccaggatataagccctctcatattcatctattccttcattatctgtcttgcatttcattgccattaaaagcattgctttgaaaaattcttcacttctttgttcctttctcctgccattgtctgtgtccaaaaaagaaagttccaacctgctaaaatctaactcactgatacttctattgcaaaagtgctaaaagctaccagaatgctgaaagttagcttattgtcaattagactcattttaaatggttaacgataagcctcaagtgaatctcaggcagcatgctatactattagattgtcctcttcaatcctacctttcaagaacatgactaattcatgtatctttcctaaaaactgcaataccccctcttctcttaacttttatttgataaaatagttcttatctcacaaagaaaatagaaaagacaattggagaacttcacaaacttctatacaacttccaacaatctactgactcctttaatctttgtttcagcatttattgttgttagtatataagaccaacacccacttgtgcataagttcccatctccttcacctaataaaggacacacttggaacttgttttcctcacatacctacattttcaattttaccagagaataatccagtagatggctatcacattctatcttatgaaaagtcttctgagattctctaacaaatattttaaaaatcaactttcaccattctacagtaaaattcagtgaaactattatctgtatttgctgaatccacttgccttcctttcattcttttctgaacctactccaattaggctttcccctcactcttttatgaaaactgcttttgtcaagttaacccccatgttgtcaaatcaaaatgaccatttctccatctgatatggtttggctatgtccccacccaaatatcattttgaactgtagctcccacaatccccacatctcatgggagggactcagtgggagggaattgaatcatgagggtggttacctccaggccattcttgtgatagtgagttctcatgagacctgatggtttaataaggggcttcccctcactcctttgctctgcacttcttcgtcctactgccatgtgaagaaggatgtgtttatttctccttctgccatgattctaagtttcccgaggccctcccagccatactgaactgtgtgtcaattaaacctcttccatttataaattacctagtctcgagtatgtcttcattagcagtgtaagaaaggactaatacagtaaattggtactggtagagtgtggtactgctaataagataccagaaaatgtggaaacaactgtggaactgtggaactgggaacaggcagaggttggaagagtttggaagtctcggaagaagacaggacgatgtgggaaactttggagcttcctagagactttttgaatggttttgaccaaaatgctgacagtaatatcaacaatgaatccaggctgaggtagtctcagatggaaataagaaacttattatgaactggagcaaaggtgattcttgccacactctagtaaatagactggtggcattttgcccctgccttagagatctgtggaacttttgaccttgagagagatgatttatctggcagaagaatttcttttttttattttattttattattattatactttaagttttagggtacatgtgcacaatgtgcaggttagttacatacgtatacatgtgccatgctggggtgctgcacccattaactcatcatttagcattaggtatatctcccaatgctatccctcccccctccccccaccccacaacagtccccagagtgtgaggttccccttcctgtgtccatgtgttctcattgttcaattcctacctatgagtgaaaacatgcagtgtttggttttttgtccttgcgacagtttactgagaatgatgatttccaatttcatccatttccctacaaaggacatgaactcatcattttttatggctgcatggtattccatggtgtatatatgccacattttcttaatccagtctatcattgttggacatctgagttgcttccaagtctttgctattgtgaacagtgctgcaataaacacacgtgtgcatgtgtctttatagcaacatgatttatagtcctttgggtatatacccagtaatgggattactaggtcaaatggcatttctagttctagatccctgaggaatggccacactgatttccacaatggttgaactagtttacagtcccaccaacagtgtaaaagtgttcctatttctccacatcctctccagcacctgctgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgctcatgtccttcgcccactttttgatggggttgtttgttttttcttgtaaatttgtttgagttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggctttggttgccattgcttttagtgttttagacatgaagtccttgcccatgcctatgtcctgaatggtaatgcctaggttttcttctagggtttttatggttttaggtctaacgtttaagtctttaatccatcttgaattaatttgtgtataaggtgtaaggaagggatccagtttcagctttctatgtatggctagccagttttcccagcaccatttattaaatagggaatcctttccccattgcttgtttttctcaggtttgtcaaagatcagatagttgtagatatgcggcgttatttctgagggctctgttctcttccattgatctatatctctgttttggtaccagtaccatgcttctttggttactgtagccttgtagtatagtttgaagtcaggtagtgtgatgcctccagctttgttcttttggcttaggattgacttggcgatgcgggctcttttttggttccatatgaactttaaagtagtttcttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgaacagtggtttgtagttctccttgaagaggtccttcacgtcccttgtgagttggattcctaggtattttattctctttgaagcaattgtgaatgggagttcactcatgatttggctctctgtctgttattggtgtataagaatgcttgtgatttttgcacattgattttgtatcctgagactttgctgaagttgcttatcagcttaaggagattttgggctgagacaatggggttttctagatatacaatcatgtcatctgcaagcagggacaatttgacttcctcttttcctaattgaatacactgtatttccttctcctgcctaattgctctggccagaacttccaacactatgttgaataggagtggtgagagagggcatccctgtcttgtccagttttcaaagggaatgcttccagtttttgcccattcagtatgatattggctgtgggtttgtcatagatagctcttattattttgaaatacctcccatcaatacctaatttattgagagttattagcatgaagggttgttgaattttgtcaaaggccttttctgcatctaagaaatttctaagcagcaaggcattcaagatgtgacttgggtgcccttaaaagcattcagtttcattcattcacaaagatatggtttggaattgaaacttatacttaaaatggaagcagagcataaaagtttgaaaaatttgcagctgacaatgcaatagaaagtgaaaacccattttctgaggagaaattcaagccagctgcagaagtttgcgtgagtaatgagaagccaaatgttcactgccacgacaatggggaaaatgtctcccgagcatgtcagaggtctttatggcacctcctcccatcacaggcctggaggcctgggtggaaaaatggtttcctgggcagagcccagggccctactgcttcgtgcagtctcgggacttggtgccctgagtcccagccatggctaatagggtccaatgtacagctcaggccattgcttcagagggtacaagccacaagctttggcagtttataaatggtgttcagcctgtgggtgcataaaagtcaagaattgtgatttggtaacctctgcctagatttcagaggatgtttggaaatgtctgatgtccaggcagaggtgtgctgcagggatggagccctcctagagaacctctgctaaggcagtatggaaggaaaatgtgggatgagagcctccacacagagtccccactggggcactgcctagtggagctgtgagaagagggccactgtcctccagaccccagaatggtagatccacctagagcttgcaccttgtatttggaaaagctgcagacactcaatgccagcccatgaaagcagccggaactggggtggtattctgcaaagccatagggacaaaactacccaagaccatgggaacccacctcttgcatcagcatgacctggatgtgaaacatgtagtcaaaggagatcattttggagctttaagatttgacagtcctactggatttcaaacttgcatggggcctctagccccttcattttggcgaatttctcccatttggaacaggtgtatttacccaatgccggtacccaatgtatctaggaagtaactaacttgcttttgattatgtaggcttataggcacaagggatttgccttgtctcacatgagactttggaccgtggacttttgaattaatgctgaaatgagttaagacattagtggactgttgggaaggcatagttagttttgaaatatgaggatatgagatttgtgaggggccagcttggaataatatgcttaggctttgtgtccccacccaaatcttatcttgaattatagctcccacagtccccatgtgtcttgggagggacccatttggaggtaatttaatcatgggggcaggtttttcccatctgttctcatggtagtgaatatgtctcatgagatctgatggttttataaaggacagttaccctgaacacactctcttgcctgtcacaaggtaagatgtgcctttgctcctccttcaccttccaccatgattgtgatgcctcccaagccatgtggaactatgaatccattaaacctgtttttctttataaattacccagtctcagatatttcttcatagcactatgaaaatggactaatgtatcatttttatattcgttttatattcattgttctctcagcaatatctcatacatttaattatctcagtttcagttgatgtcctaaaacaatttggaatgatttattttccacattccaaaatgaagtgctagatttccaactaaaaagtatttgcaaaggaggtatttgaaatacacacacacgtacacacattcatatatgtttgtgcatgtgtgtgtgtgtgtgtgtatatatatatatatttggagacagggtctcactctgtcacccagcctagagtgcagtggcaggatcttggctcactgcaacctctacctcccacgcttaagcaatcctctcacctcagcctcctgagtagctgggactacaagcataggccaccatgcctgcctaattgtttaattttttgtagagatgaggtttcaccatgttgcccaggctggtcttgaattcttgggctcaaataatctgcctgggatcccaaagagctgggattatgggcaagagccaccatgcccaacctacatgcatttttaatccttagctgaaaacctatgttcatcctgaaaagactttaaagagtcctagagataggccgtgagttgaatagggaattttcttgaaggaagctactgtgctgctatagctttttccttcctaggcttgcaggggagggttttcctgcctcatataagactggtatgtaagaaataacagcacatgaaatgtatcattcattcagcaaaatcaagtgggttttatccctgggatgtaaagatggtttcatgtacacaaatcaattaatgtgatacaccacacttatagaacaaaggataaaaattatatgatcacctcaatagatgcagaaaagacatttgacaaaattcaacatcctttcatgataaaaataattctcaacaaattaggtggaaagatcctcaacataacaaatgccatatataacaaaatcacagctaatgtcatacttcacagtgaaaagctgatagcttttcctctaagatgaggaacaagacaagggtgcctacttttgccatttctattcaacatagtattgggagttgtaaccaaagcaattatgcaagaataaaaagataaacgtcatcctaatcagaatgaaagaagtgaaatgactaatgtttacaaatgacatgattttacatacaggaaaatctaaaaactatgaaaaaaactgttagcataaacaaattcagtatagttgtaggatacaaaatcaatatataaaaatcggttgaatttctatacactaaataacaaactatccaattaagaaaaaaattctatgtgccatcacattaaaaaaataaaatacatagacaaaagtttaaggaggtggaagatctgtgtactgacaaccataagacattgatgaaaaaattgaagaaagacacaaaaaagttgaaagagagtccatgttcatgaattggaataattaatattgttaaaattctcatactatccaacatgatctacaaattcaatgtaatgcctatgaaaattaaaatgacttttaaaaaatagaaataggaaaaaataatcctaaaattgtacggaaccacagttaactccaaatagacaaagtaatcttgagaaagaagaacaaagttgaagacatcagactgcctgattagaaactacattacaaagctatagtaatcaaaacagcatggtgcaaataaaaacagacttatagaccaatggaacacaataaagagcttagaaataaagctacacatatgcagtcacctaatcttttacaagggttccaaaaatatgcaatggggaaaacatcatccaacaaatggtggtgggaaaactggatattcacatgaaaaataatgaaattgaagttttatcttatatcatacataaaaaataactcaaagtgaatgcattaaatgtatgacctgaaaccttaaaactctttgcataaaacacagggaaaagctcctttatgttggtcttggcaaagtttttttatacaacaccaaaaacaccagcaacaaaaataaaaataaacaaacgggactacatcaaattaaaaagcttctgcatcctgtaatcccagcaactcaggaggctgaggtgggaggacagcttaaggacaggagtctgagacaaaccaagttatgttgttttgaggctgggcaacatagcaatactcatctctaaaaatatgaaaataaaaagattagccaggcatagtggcatatgcctgtagttccagctaagaggctgaggtaggcgggttacttgagcccaggggttcgaggctatgcagtgagctatgattgtgccactgcactctagcctgggtaacagaaagagccatctctaaaaagtgcttctgtgcaggaaaggaaacagcaaataaaaatacaagttgtgaaaatagagaaagtatttgcaaaccatacatctaataatggattatgtccaaaatatgtaagaaagtcatataactcaatagcaaaagaaacccctgattttaaaatgggcaaaggacctgaatagacattttttcaaagaggatatacaaatgaccaataggtgtatgaaaagacactcaacaataataatcaccaaggaaatgcaaatcaaaacaacaatgacacattacctcacaactgttagattggctattatccaaaagaaaaaaataagaaatgttgacaaggatggggagaaaaggaaaacattgcacactgttcatagggatgtaaattgttatagccattatgaaaaacattatgaagattcctcaaaaaaataaaaaaaaaactgccatacaatctagcactttgggtatatatctaaaatgaatgaaatcagtatctcaaggagatatctgcacttccatattcattgcagcattattcacaatagcagagatatggaaataacctaagtatctgtcagcaggaaatgaattttaaaagtgagatatattcaattctttaatagattattattcagccttaaaaagaaaagaaattctaacatatggtacaacatggatgaacttggagaacattacgctaagtgaagtaaggcagacatagaaaaacaaatattgcattatcccacttatatgtggaatctaaaaaagttgaacttatagaagcagagactgaaatcttgcttgccaggagctggtgggtgggggaaatggggtaatgttggtcaaagcatacaaagtttcagttatataataaataagttctggagatttaatgtggcagcatggtgactgttttgtatactaaaaatttgttaagagagtagatcttaagtgttctcacctgacacacagacacaaagataactatgtgaggtgatgaatatgttaattatctttattgtggtaattatttccacagtgtatacatgtatgaaatcatcatgtcagatatcttcaatatatatactttttatttgtcaattatgtctcaataaagagactgagaaaaggagaagtaagagaaagaaagaaagaaagagagaaagaaagaaagaaagaaagaaagaaagaaagaaagaaagaaagaaagaaagaaaaaacgaaagagaaagaaagaaaagaggaaggaaagaagggaggaagggagggagtgatgaagggagggagaaaggaaggaaagaaggaaaggagggaaaaaaggaaagaaattttaaaaacttttctaccaagacaatttatttagagtattgtgttactttcctgtggctgttctaacaaattcacacaaactgggtggatagaagaaacaacagaagcttcttttgtttgttttcaagtctggagaccaaaagttcaaaatcaaggtgttggccatgcagttctctttccctcttctagcttctgatggctccaagcattccttggttggtggctgcataacttcaatctctgcttccatgtccacatggccttctcttctactctaaggacacctgtcattggattcaagtcccatttggctaattcaggatgatcacagagcaaaatcattaactttagatctgctaaggccccttttccatataagatcacatttacaagttccagaggttaggaagtaggactatctttttaggagacaccatttaacacacaacaattattaatctcatcccttgctttatcctttcttgcctaaattaattttcttttctttgttctgaatgccacatttactttttactttaatattctgattttaagtatgtatgcatattgtcttaaatccatcttgagcaaggtaaaacataaatatgagattattctttaaatatccaaagctggatcagagacattactggcgtgagataaggaaatcaacgatcacttctctggtcagtttccatttttttcctgtttatctatgattatttttctcataattagaataattaatacctaacagtaaataatctatttaattttcatggtttttgtatattacttagactcaaaattcagaataaaagcaatattttgcatactgtttattacattaaaaaatgatttctcttagaagctataaaattgtcttcaaagtagccaaatgatatgagcatgctaattgagaaatctagttatcattctcaaaattcatgctggtaatcactagaaagtatcagggctttgggataagttagacctagatttgaaaactaggtcgaacactaaatggctgtgctaatttttagtaagcttcttgccctctctactattggggttcctagttttcaccttatgaactaacaccaaaatatatttatgataaagaatatgaagaatcaatactgccctagatcaaagcagaaatgtatgatataatagccatttttataattaaatatgggtaaatctgttttcaaaagaggggtaggtggtaatgggctagatattttcacatatttctcagaagatgatctttagtctctacatcaatcatgatattaactttcttttgcttgaaattttgacaagcctcaactaccttagccttttatgctaaaaatctacactagtaaatatatgataatattctgttcttcacaagcaaatgaaatgatcctaatcttgtgttggtaaactgaattacttttaatgtaatggaagagagttgtgcattaagacatttttaaataaaattattgatacagaattcatgtatccacttaaagtacacaattcagaagtttttagtatattcacagagctttgcaaccataaatgtaatctaattttagaatattttattctccctgtacccattagcaatactctccatgagccttcccctagccctaggtaatcactaacctactatatgtctctgtgtatctgcctaaatctggacattttataaaaatagcctcatactatatgcaatcttgtgattgccttctttcatgtagcataatgttttcaaggtttatccatttcatagcatgtatcagtacttaatttcttttggttgccaaataatatttcatcatatagataaaccaccttgtgtttatccaccagtcagctgatgtttatttgggttgtttccagtttttgactattttaaataatggtactatgaacattaatgtacggatttttatgtggactttcaaactttatcgtggagatgacagagagatagacagacagacagacagacagacagacagatagatagatagaaccactgtgttatatagaaactatacttaacattttgaggaactgccaaattgtcttccaaagtagctctatcatattataatctcagcaatatacaaggttccaatttctccacacttttaaacacttgttgtctatctattttcatttatgacatgacccagagggaaaaaaatcaaccagaatgtgatggcaacccaaggtggaatgcagactgtgacgaatcaatctaaccgtattacaaataaattatataactagactgaagtgggtgaagaagaaaggaaatgacctgagtaactgaacaatggtgttttgggccaggctcagtggtgcacacctgtaattccagcactttgggaggcagaggcagacagatcacatgaggccatgagtttgagacctgcctggccaacatggtgaaactctctctctactaaaaatacagaaattagccgggtgtgggggcgcacgcctgtagtcccagctacctgggaggtgaagcacaagaattgtgctaacctgagaggcagaggttgaggtgaactgaaattgtgccactgcactccagtctggttgacagagtgagattctgtctcaataaataaataaataaataagtaagtaaataaaatggtgttttgactagctactgtaaggttaaagacaaaatcagttgtacacaaaaactataattggtaaatttgtttctcacagagctatgggttagatttgtaagctactgtatacatataccagggcttaacaaataaagatatatattgtatataaagggagccaaatttctcactgtgtgagaaagaaggtacaatcaagaaaacaggaaaagttagaatgacccttgtaatgttggttcaaagtcagaggtatcagtaaaacgcaagggctttcaacatatatttatgtgtacgtgtgtatatatataaaaatagatgcaaaaataaataaataggtgactgtgcccatggtttagtgcatatacatgttttctagctttgagagagcctagagacagtgacaccccagtagtaatgggcacacttagcatccagattttgatttctaaataccattctccagcatccttgtagaagacatcgatcccagggttgtagccgggaaaatacaagatgaacctggaacatcttggggtacaaaattaaaggaaataatttttacgaaaatgatggggcatgccaaaggtaaacaggagccatctcaaagagctctcaaaggtcaaagctaaaaaatttgagtgcaaaatatatgatgattagattggattataaaccaataaataaaataaatacttatgtgtccaaactgacataaatatttgaataaataaattgaagagaaaggaaagcttttcccttaaaggataattccaattagtgaacgaaaaaggaataagggaagtagaaaatcatcactagaacatcacagtaataattgctatagacaagatccagttatggatgacaaatttagtggatatgttttaagaagaaacacctatttgtacagttacaaaaatctcctccaaataaatatttatcaattaccaatgaaaaaatcataacttcataatggagaaatctggaaaaagctaccttaagcaaataagcaaggttcattcacatgtaataaaacatattactgcatattagtacataagacataagacatcatatccttgatatgatacaaagataagagtgtattatttgtgtgacaatcttcccaacagtatatacattcaatctaatcaagagaaaagtgaggggtacttcatgaagttaactgaccagtactattcaaattctcaagtttattaaatttgaagaaagcctgaggaactgtcacagattgaaaaaaaccaaggaagcatgacaacttaagataacgtgggatccagggttagatcttacgactcaaagaggatattaatggaaaaattgttgaaatctgaataaagttggtagttttcttagtatgttagtttatttgttttgatcattttacttaccatagttatatgcaatgttcatattagggaaagctgggagaaggacgaaggagagctttctgtgtcacttttataatgcttttgtaagtctaaaagtatctcaaatttaaaaattaggggaaaaacaaataatcaaacaactatattaagaaatgggcaaaggacttgaatagacaattcttcaaagaagattatgaatggctaataagcatataaaatgatgcacagcatcactgataagtaggaaaatgcaaatcataagtatgagacaccacctgatacccattaggatggctactactataaaaacggaaagcacatgttggtgagaatatggagatattggaatctctgtgccctgtttgtagtaatgtaaaatggtaacgttgctttggaaaacaatatggcagttcctcataaaattaaaaatagaattactatataacccagcaattccacttctggatatatgccacaaagtattgaaagcagggtcttgaggatatatttgtatgcccatgttgacagtagcattattcataagagataaaacctggaaacaacttaagtgtccactgacagatgaatggaaaaacaaaatgtggtataaacatactatggaatattattcagcctcaaaaaggaaactctgacatacacttcaacatgaatgaatctggaagacattatgctaagtgaaacaagcaagtcacaaaaaagacaaacatgattctgcttatataaggtacctagagtactcaaaatcacagacacaaagcagaatggtagatccagggtctggggggaagaggaattgagaagatattgtttaatgggtatagaatttcagttttgtaagatgcaaagagttatagagacaaatggtggtgctgattgcacaacaatatgaatatacttagtatcactgcactgtatacttaaaaatggttgagagtaaattttatcttctgtgtaactttactacagtttaaaaaatagaaaaaaattttaaaggggaaaaacatgaccatgggcaaatatctgtgagattacaagtgtgttcaggagtttaatctggtaaattctataaaggtttatgtgacagtctcatgattttggtttttaaacttttttgacagggtacccacactaagaaaaacatttatatcttatccaagatgtttatgtgtatacttattttagttacatatatatatgtatatgtataatttattttagttacatatataactatatttatttgttatataaatatataactaaatatatataatatatataattataaaataaaatccttccttcctttccttcaacttccttccttccttccttcatcatgatgcattaaagagattttatggtctattgaagggctgacaaaaaccacttatgcgtccctaaccaaaattgaaaaacaacatttatctggtctagagtatatataaacgtgttatctgttactcaagttttcatatttcctcaacacttataactagacttgagcatcagtcactacaatgtttatcacaggtactttatgtataactaaaataaaatttaataaaacatacccttagtattcactattctctccctccctccctccctccctcccttccttccttccttccttcatcatgatgcattgaagagattttatgatctattgaagggctgacaaaaaccactaatgcgtccctaaccaaaatttgaaaaacaacatttatctggtctagagtatatataaacttgttatctgttactcaaattttcatatttccaaaacacttataactagacttgagcagcagtcactacaatgtttatcacaggtattttatatataactaaaattaaatttcataaaacttacccttagtatttccctccctccctccctccctccctccctcccttcctcccctcctcccttccttcctttgctggtcatgatacattaaagagattttatgatctactgaagggctgacaaaaaccactaatgcatccctatccaaaatttgaaaaacaaaatttatctggtctagagtgtaaataaacatgttatctgttaatcaaatttctgtatttccaaaacccttataaccagacttgagcatcagtcactacaatgtttatcacaggtacttttggaaaagtgctttgcttcataataattaccctatcagaaggcctcaatttataaagcatttagttacttagtgcttatgacgtaaatgtcacagttcaagtacttgatggagaaaaatattaaatgaagtgcacttgttttgaagataatttcatttagcatctccaaagcaggggataattaagttactctgtcatacaaaatgatggaggctttaaataagtaacagctggttaccccaatgatggagcaactgcagggcagcctttggcaaggacagctgtgcaaactcagcccacgtggtacgcaaatagacctacattatgactaaggaaatagctgaaatggaatgacatctagaaaagcaaaaaaacaacaagactgggatcccttagcatgcatttcaatagcattaagatatagaaatattaataagaagtgctcatctatcatttctgtagtcaaatgtgtttctcacgtctagacgaatttaaagttagtcattgcagggcaatgagcacattcataagaaagtaccctcatttttaaatgtaactactacttaaattactttacttactactacttttacttactactactttactccaagcaagaaattaaattcaatttattcatattttaacattagtacagtgattttttttaaagttatgctaaatctttattccaaaagtttttgtttctttaaaacctcttccacggaaatcaaatttgtaacagtgaccttaaaatgtgagagctggccttcgtaaaacaaacgtgctattaaaaatattaaataactgaccccatttttggaaagctgggtaaggctgtgctagcatggatctatcgttaaacgttttttgtttttttttttgaaaactttttattgtcactcgatctgcatgtaaacaaggaggaaaaagtgagtctgacttatgtacttgattttgtttaccagaattttgcttaagtcatactatggacctttctgacttgaaatcattttcgagttggttatcagactaactctcctaactagtatttgtattaattatttttaagcaagcatttattatcattgattatgcaagcattattgagcaagcaaatgcaaatgcaataagcatttttaagcattaactatgtgttaagcacaaggtctctgtcctgaagaagcttactagccactagacaaaatggacacagaatcaagaaatgtcataataatatggggtaacacatgacccagatttggagttcagctaacagtttcccaagggaaatgagtgcaatcaaggtcttaatagacaaatcatacataggcagcaacaacaacaacaaaaaaaaagggggtggggggcatgaaaggctttccaggggaggaaaatagcacaagctaaggcatgagggcactaaatagcacagtggggtgtgtcctcgatccccataagtaattgcaatatgtgaaatgatgagtggtgtctggggatgaaagctagaggatcttcataggggcctttatggaagtgttaaggaatgctaaagagcttggcctttgaagggatttaaagaagaattaaaatcagacctctctattatagtatagacactgggtacaagggagacaaaactgaagactaaaaaatcttcagtggttgcccctctgccaaattagcagttgttaaccttttcggcctgagaactaaaactacagtcctaagctcctggaccctcccttggccaaagggaccccagagaaaccttaaagaactgagttcctggccaagacagaatggggacatgcctcattatactccctcctttttgcagtttaaacacaattgaccagcattaatgataaactagagatgataaccaacagagcgaactcttttcatggcaataagataacaaattataaacatgacctaaggccatgcaaggcaagcattaagtcacgtacctctacacttgaagaataaactctattataactgccacaaggttttcctttttctagtaggtaaacaagccctggcctctagataagcaatataattgcagctcattcatcagacactgaccagttgaaccccccgtccaacaaaccatagctacatagctctgattgactaagagactaatttcagtaactttctcgtggtaagagaccaccaaccactgggctcagtctggcctgctctcagaggctgcacatttgaatgccttcatgctcctgcctcaccttttgacatataagacctaattgtaatgcatttaaatgtcgtttccactccaaaatgaacatgggacacatgtaacatacatgtttgttcagtatgcatgtgtcaggactccctttgtgaatatccataagacctcctcaaacctgttgaatatgtttacttggccaaccttgtcagcatatatccctgttccactctcccctccctcaaagtgccttctggtttcgcctgaaggttacacttcccagcctgtcagaatcaccatcttgaaggctggaaccattcgtaagctacatatatagatctcacaatttttaaaaatcttgatagggctcatgacccctttaaaatcttacaaaatatcgaggatacctcagtgctttgttttttgtggattacgtctgttgatatttaccatatttgaaattaaaactgagaaatatttaaacaattatgtatttatttataataacaaaggtaagcccattatatgtttaacaaggaatacattttatgaaaattacaactcaatgctggttatgactcaataaagagatcttgtgatttactgaagggcttacaaagattactaatgtgtccctatgcaaaactggaaaaacaaaatttgactagtccagagtacagataaccacaatgtgttagctgttaatcaaatgttcatatttccaaaacacttataaccagacttgagcatcagtcaccacaaattttatcagaggtactacagactagtgctctgtttcaacagtaattaccatatcaatttatcaacctcaaattataaagcattttaagttacttagtgtgcatacttagtgttcttttcaaagcaaagtgttattgaggagtggcttctttttttacatttttgcaaatatctttagttagtggcttaatagaagacaactaaattctcatattttcttctagatttaatctataagttgttttggtaaaggtttataatgaaaaccccgcttcagacacgcaatatggttgaaaaattgagacgtattttaatttttctaagagatggggtctgcaatgttgtctaggctagattcaaactcctgggctcaagcggtccctgttctcaacctcccaagtagcagggactacaggcatgtgccaccacacgagacggaagtaatattttaataactttttctgataattatagatttatttattttgatactaccctattacttgactggggtagtttctggaaggttaatggcagtgtagaagccaaaacaatgtcaatgacctttccctatactattatattaaaatccattggtcaattttgcactttaaatggatctttcatctatgcatctacttttttcatgatgatttcctaatatcatacatttctcatttggtaaacattcgtacactgagctgacagattttactatagaatataaaaaatacacttgttaatatcgtcaccaatctcaccaaaaaaagtatttaagaacggaaatgctatcaagctcatggtgatggaatacattttccaaaattctactttttgcttgaaagctcacattttatcattggcaacaaatactgtcagtttgtttctttgaagtgacaagcttactccactcattttcaaggaaatatccaccatatgtccaagtttgaataaacataattatctgtcagtcattccttcaactaaaaatggcattccatgaaaaaagcaactagatcagctttcaacctaacctcataagagcttttccttgaagcaaccatcatactttaaggattagaagttcttctttctcatcatgtagaaacctggtaaactgagatttaataaacttcataattttccttgctttatcaatagcattcagctgtaactggacagaaaaaaaaacaaaaaacaggaagttcatggtagcgaagaacagaatgactaataactgttttggtggtagtgccaacattcatattaacacactagcaattctgcccaccagtacttttgtgccagcagtgtagatgtcaactcagtgaaaaagacaaatgatggtttagtattatgatgaaaatagggttcatcgttcttcacagtccctgaaaatgtctttgggtatcctggatgtgttcaggtcacactcaggaaaatgttatgctaaaagcctcaagtctaaattcttatacctaacatccatccacaatcttgttccactctattgataaccttgagtaaaacagattttttcacttttgtaaaacacacctttttcccctctcatcttctaatttcacattcttcccaatatttacaatatataaatcattcaatcttccaggagccagtccaattcatcgccattccagatctctgaactattttctatactattggatatgtactcacttatatactatttatgatttttctttgggaattagaattatcttccaaactagattgtcagacttccagaggtgaagatttttagttcttctgactttgctatagtattctgcacagttatgcatatgataatgatgataatatcttgaattttataaatcttaattttttagtgtaggtcacaaatacacatgtgcccctattgtatttgtagggaaaacatttaatattataaattatgttatcatgtcttctactttgggtaactaatatatatcaaatatatacttaatatattatagaatatcaatttataaagcagtgtataatttcaagcatacaaatatgacaatgcagccgtatatagtggaaaaaacctaggctaggaaatagaagatctaaatttaactgtccacatagtatagacttaaagaagcacatggatttagagaagccacaaaacatatttgagtcccaatgtctgcaacagtgaaatgcttatccccgttctgatatttaaatgacgtattttatgagaaagtttttttttgaaacaatgtagtaatcaaatgcaatcttttggcatagctattaccctgagtcctgcacattaactgcaaatcaatatcagctattaacataactacatgcacagcatgacaattaaaagaactaaagacacacaatggagacatctttgagaattaaatccaagtaccttgaggtatgcagtacttgtcatagaggatgatttgaatattggcaaagtactatgtgtgcacagatttcatatataatccacataaagcaaagacgccttattacccggtattagtagtctaaatctgaaaggtgtaaagaaaaacaagactttgaagacgtattacagatttatacaggataccacaaagaaagatcttgtaaaaaatctttagacttttctttttccctttaaggttttaccctcatccacagcaaccttaatttctctgaaagttatgtgtcataattacttttatgtgttaacttaactagacttaagggatgcccagatagctggtaaaacattatttcttggtgtgtgagtgagtgtgtttcctgaagagatgagcatgcaaagcagtagacagaataaagaagatctgtcttcaccaacttaggtggacagcatccaatccagtgagggcccaaatagaaccaagacgcaaaggaagaacaaattcctccccctcccccaccagagccaagacatcagagtttctggttcttgggcctttgaactctgagaccagttactcccaacccccctgtagttttcaggccttcagcctccaactgggagtgacaccattgcccactggctttcctggttctcaagcttgcagagagcagatggtgagacttctcagtttccataactgcatatgcaaattcccatactaaatctcctcttacatatctatatctgcggcctactggttctgtttctgtggagaattctggctaatacattacccttaccaacatttgggtcttgtttatttcatctttctcctcttatccaagttctctaatatgaccacctcttcatttcagacaagcccttggtaagggcacattccctgcatgctgacaactgctgttctcttaaaaatggtagcatattctgctgaataaagccttccatcttgtttataaaatcttgaagccttaacagtggaaagactagccttagagagctttggcaatcaataatcacagcatcttgacaaaaaagggtattaataagcatgtgtcatttcttttaaaattaggttagaagaaatagatccttagagaacaagaactatgccaatggacaaacgttctagcctcctattattcagatggatatatagaggaggtggtctccatgtttcagaggtcttaggagagtggaggccccatggactctagacacacccttacacacctctgctgcctcccctgtttcagtcacaatgtttcctcacagattcttcctcccaaataaactgcctgcatgcatgtctatgtctcagacttctgctttcaggaaaactcagacaatcaccgtcttttatgcagcttacactacattgtagacttttcatataggtgatctctaattctagaataatcctagtagcctcccattttaaaaattggaaaaggtaatttaaagaggttaagtaatatgtccaaggcatagtaaattctttacagaatcctgaatgtgagtattattttcgaaccattcaactccaaacttatactctttctccttttatggtaattttgtcaataatagccaaaatgaattgaaaaccttctatatgatgtaccattggaaagaatgtttcaagtgatcagtgaagtttgttgaatctataattaccctatccaccatgatgtctgaggttgaatgtttccaaccaaactggcttatcttgaaatttcaaaaataagcactgttctacaaccgttactagcatcttatggctttcatgaagttatatactatttcacagaaacatgattttcctctccatagaccctagacaattttctcaatgtagcccatcttcttttattttaatgaaacttaatccaggactattacaaatgttcaaaaacaaaagcgttttaaaatagtgtgtctattatcttcattttacagggaactacaatgaaatggatattgtttttgtcatttacattttcataaaaactttatgtgctttttcaaagaacttcagtttaagaaaaagattattcacaaatttacagtgcttgcattttataagtatgcaaatgtaaatgtacagaacttaacaaattttacaaattttcataccgttagaagtaatggggcctcatacaaacaacaatgaatgggaaacaaagaccatgtgaattctcctgattcttttcttatagcttctgtgaacctttagccaatttattttatctttcttagccacaggtgtcatgtttgtaaaaccatgttaacaataggaaaggctgttgaaagaataaatgagataatatttggaaataactttagcaatataagaaaataatgaatctgtggatgtggaaaggatctcactgtttcctgtctagccttcaataaatttcagaatattttaatcattcatacagatcatatatatttccacaagacctgtttcctcatttatttgtttgaatcagtatctaaataggaaagtggacttcagagaagaataataaaaaagccatcccttctttcattgcatagtatcaattatgctcaattcccacaagccttaaaaattcaatgattacataattaacatttctgaataacttttatttttctttgaggcagggtctcagtctgtcacctaggctggagtacggtggtgcgatctcagcttactgcaacctcctgggctcaaatgatcctcctgctttagcctcccaagtagctgggactataggcatgcaccaccatgcctggataatttttgtatcttttttagagacggggtttcgccacgttgcccaggctggtctcaaactcctggactcaagtgattcacctgcctcagcctcacaaattgctgggattacaggtgtgagccactgcacctggcctataaggaactgtttatgtgctaggaactgtactaagatttttacattatcttaatttaatcccaacacaatcaatgagtacagtgttattattcacactatatacatgaagaactttaagatagaaaggaaattactgacttacacaagggcatggtcacagggtgattgttaaagctggcctccatctcaggttttctgtctctgaaactttgttcctactaattcacctcaagccagttctttattaatatagttgggtcacagtaactatctggtaacatttaactaaatagaattgttttcataagaattaagattcaacccatattttgaacttaggtatttttattattttggaatcactgagttaacagataaagatgtaaatagctttatagataggtattccttatatatagatttcaaaattaagtaattctgtcagatggacctcttttccttggcagaggtgatagacaatcaaaatggtaacataagcagaaatcacaagtcgacacatgatatatgcatttgaatattgcctggaaagcctctccaagtccattaaattatttttcctagggtgaatgtaaaacatatcagtatgggcaccagcacatgtgcgaagggaagaaagcattgggaaagtttgtttgtgtattgattttgttggataaagttgagaatttttgtttgttgagctttgttttgttgagctttgtttgtttttattagagaacagagtggataaaacattttcatctagtaaaactgctccactatggaatcccctttccctttttatggttaataatcttaattgatcttaatctattcaaagtggaaaatagagggtagaaagcatccagctttaagaaagcagggctatgttacaaaatgcaacagcaggactaacagcaggagagactggggtcactgtccagatacagagcacagagtatctcacatgtggtgagagagggcagagttagagcgaagaagcagagcagaggacagtgaccatgaggcttaggcggttctggctcgaagaaattgagtgaagtttctctcagacagagaagagagtagcatgtaccaaaagattaatagggatgtgctaatggagcaatgatcatctttcccggaagaacagattttaacacaagatgggactgagctgttgaaaattctatggcaaccactatgtgagaagaaaatgagtagctgtatgcaatagcacaggtctacagctgcgctacctttgactaacgcagcctccctaagtagaacatgtgaagctttgctccatcagtgactagctctgtgaccttgacagagtccctgacctctatcagggtgctttttcattttctaagttggaataataatggctaccctagagttttcaactaccaactctatatgcagttctccctaatctgtcttttacccagacatctatatggttccctctggaagggggagtaatttatctgatcagtaagattagacaaaggcactaggaatgcgtaactcagccctgccaagtttatgtttttgggatcagctggctgtagaaggctgtcatgaggagcagcttccctggcatgactggcaggggaagtcacagctctgcggagctgcttcctctctctgataatgagtctcaagaatcacactcatggccactggggaagcatggggtattaggaagccagagttcagctctctaatccaagctctactttccatcacatatttaccagtaatgaagatgaccattttctcattcatttatacctccatattaattgtgcaattggtttagagtctgtagggagacagcagcatgactgtaattctcacacactaacaactcttctgatgcaagtagtgtaaattgtcaccattttttaaagttgcaatatcaccattagctcaaatagatgcacacactacttactattatgtaaacaaaacatcatttcaaacaatcttagagaatgtctgcaaaccacacgcaggttgtcagtcatacacttaattctaatgattttcaggtagctttaggagccctatcatctatgacatgataaagacatccaaaaattcaagtcttgatgttaatcatttatatttttatctctttaaataaacaaaaacagtaaaatatgagcccagagaagaagcatagtaactgattgcaagcacttagaaaatgcttgaggaagacaggtaaatctttgacactctacttattttctttttatttcaaagagctcctagtacatttctgcatacattacacacacacacaaagacagaaagtaacaaaacacttcaagtcttcaaaaatagaattgtacatttgaatgccatagccactgccactgttaaaaatgcagaatttcaaattgcacttttcttgaaaatacattgatactctgctggcttagtttactaaaatcacaaaatacaacgcctaagagtgtacaaaatacattccctttgaagaaaactgaacattggaaaatactatatacttggttaaaatagatgactgctcgtgaatatgttcaattaagttcaaagcaaaataatttcctaagatctcttattaatggactttataataccaaaaacattaaattaaaaatcaattaaacaaataaaatgcaacccttacatattaaataactgtttaatctttcaagtggatatgacctattaataatagaagcatttgcaaactgtgcaacagttctggtacagagccaggtccaaggctaagaggtcaggaaaaaaataagaatatgacagtcccatggcatgaagttaggcatctgaaaacgtgtgtgctccaaaacagaggtcagttaatggaaaattttagaagagaaagttgggttagagccagcacagcaagctgaaatctgctcttacctaactggcaaagtcagaccagaaatacaagcaagaataagaaagacacaaatattttagaactaaatgaggtaagtagactaaaatccattaattgggggatgctactgagaagactgcaatgatgacagtacagcaatcagaaaagatgtgacacatccagaaggatctcaaggccttttatcatttttattctaattttgatattgagctgaacttggagtagaaaccaactacccaggaacttaaatgtagaattctaattgggatttccagtttgggtaagggagtatatgaatacacagtgcctgctgagtaacaagttttaaattattatttttcatctggtcctcatcattaggggtatcaaaagttttgtttgtaaagacagcaactatctggttaaattcttatactgagaacgaatgtgtaaagatcagctcagcctactcatgtgacaattgttaatgaatccattaactcatatctttctgcttcttaagcacatatttaaatatgcataaatgtgtgtgtgtttgggtaatgagaaaaatttgttggcaaggtggctaacgaaaatatccaatctcactaggcatacgtgcatgctgataaaattgtttgcacagtaactgttggtagattcaaacaactacttcagagtagaagctcaaagccaaatacttcaaaactgaagggactgaattcagtggtcttctaactggattccacagggctccagagtcctgagctacttgatgaatgttagggtgggggtagtaaataggactctgactctctgagctctgtttcttctattttacacttagagtttcagagagattttattttggaaataatttttgctactaaaaacaaaaggaatgcagaaaggaaaggacagagagaaagggaggaaggaaggaagaaagggagacagtgtggaaggaaggatggatatacggaagaaaggaaggaggtaggagggaaggaaagaaggaaagggaagaaacgaaagagaatctgcagattttatagattagataaatgaggtctacataccttaagtgacatttcacacattcctgacacaggtagaactaaaactcagtcttccttattcttctatgacaagaagtattgatggctccatttgtgcttttagaagagaagttctcagatttttttgagccaaaggtttcaatagttccactactgtgaaaccaagacacatctgtcacttgcacttagatgctaacagacttttctgaacgaggaaatgttcactggaaccatgttttttgccatcgttttttactagaatatctaatttgtcaacctctccctttgaaggtaaaatcatccagaggtcagttgcacttaaactatgattatcactcaataactcggtggctttggacaagttcttccctgtctaatcagttgcagaactagtaggatggttgtaggagaaattggggtgatgtagttaaatcacttgagtgtttctcaattgatttctcacattgttcctcacaaaaaagcctttttagacattattttcctaatctcccccccacaggtgaaatttaaacagcatacatgcactgtatacctctttatgtactgaatgcatatctgtgctttattcataataagagaatgagttttggattttttttttttttttgctgctgctgtgcaaataaccaattttaatccctttgggggcaataatgttatcattgagaaggtatgaaataggctaatatttaataccatacacaaatagcaagggttgggcatagtgattatgagccaatttcagcgtgtggatagaatgcagagtaccagagagccaacatccctccaaaataaaagatgcagcagattacagaaagatgatgggggcacacatgagaaatactactaattattacagtaatgtgtactgtactatgctttcaactttacatttgccaattcattaattttcttaaaagccttaaaaactatttaaatatgaggaaacttgggagcaacaacagtggatggagggccatccttcaaacctgggtatgtctgtctccaaaattcagggtattttcattagcactctgacatctaacttggcattttaagctgcaactgcctgaagttactaatttctaaagagggattcactggctattcttgtcaaatgactggctgtgtatgtagatatattcgaaataatattagatggtcccagttggaactgccctgcctggacattctccttggcctgttgatgtccttgccccatttctgtcattataacaacccaataattggtttaacctcttaaaattattctagatggaatggtttttatcccctatgaatacattacaatctttctgtaaatggtaaatgtaaaacttaagggctgcattgcaacgttgggttaaacccgtatgtactgatgtataaatgtgagtcttaaatgataggcagtagtaacctatgatgctgagagtgccctattataaaacggagggagaaatgggcatcagtagatcagccatgaaagacaagcattaaagggcatttgtcagtagagtgtaggtggggacctcttgcttcttgaatggaacataaagtgcaagggaataattggagtgcaacagaaatacatttttagatgagggctagaaaatcaagcctaagacaaagaaatcccttgaccctgaaatatctcctagagaagaaaaggatggattctggaaacttaaggaactcagacacaagtctccaagggttagataatttcatgatgagaggtggggtctgaagccataaaaattcttggaaattaccaaaagacataggagagctgtgtatacggagggacagctttgcatattgaagctgcaagtactttaagaaactcaattgttctgatgtatatttgtacctagaaaactgtttcttataaagaaaggaaaaaagaaacatcttgactgctcatgcatgataaactgtgtgggatcaagtaaaggaagatagtattaagggccaaagagaggcataagctctttctcaggaccataaaagcaagggtattagcctttgacccatgaccattagtgggggcctcagaagattctgctttctgcaagagtacctggtttccagggtaccattttaatagaccatagcatgggaagccccttgctggcataccatcatagacaactgaaaacggctctacagaaaacactcactcacacaggaggcagtaagtctccagaaaagtggggggacatgtactgttggctgtctctattgcttttgtctgattaatgagctggcagttgatggtaaatattttatagcataatttacttcttcactttttccaccttacttctgccctgtgctttaccaatatattcaagcttcattggcagtacctgtaaaagacaagctctaatggacataatgtagctaatgtgtcaaattaggactttcattatgtgaaatttgattatgggtcataaattacgtatttatcttgcattaactgatgaaggtaacttgttaattagatgaaatcaaagttattgacctatagtgaatctcttctacatttattgttggcataaaataaaatatcatgacaagaatacaaatgcatatttattttgttactagatatgtaacattttttaaaaattcctgggagaacagatgtgaaatttgggagaatctatgagagatttactcagaattcatatttattatcttttccgtttatgaagttgttgtctctcaacaaacctctccaaatttgaatctctccaaatccactcttctatatactctgtttgtggtgctgggggaagagtgtctgcaaactacatttttttttttattttcttaaggttctattttatttttaattaacaaaccacaatgagatgtcaccttctacctgttagattagctattatcaaaagatgaaagagcttaaatgttggcaaggatgtgtagaaaaggaaacccttctatactcactgttggtgatattgtaaattagtaaaaccattttggaaaatagtatagaggttcctccaaaaaaaaaaaaactagaattatcgtatgatccaacaatcttactactaggtatagacccaaagaaaatgacatcggtatgatgaagggatgtctgcactcccgtgttcattaaagcattattcacaatagtcaacctaagtgttgtttccatttgagtatttctacacagtgaaatactattcggcctttaaaaaaaagggaatgtctgttatttgtgacaacatggatgagctgggagatatgttaagttaaatgagccaggcacagagagaaaaatatcatctgatctcacttatgcgtggaatttaaaaacgtcatagaagacaatctaaagaactcatagaagtagagagtagaatggtggttaccagaggctggggggaggtgggtggatggggaaaaaggaaatgttggtcaattagattggagacataagttctagtgatttactgcacagcaaggtaattatagttaataacactgtattctatatatacaattactttgttaattaaaaataaaactaaaaacaacaattgtatatatttatggggcgtgatgttttgatatgtgcgtatatacatatatacgtagaaagatcaaatcaggctaattaacatatttatcacctcaagtacttatgatttctttatgatgaagacatttaaagtccactctttcagccattttgaaatgtacaatacattcttattaactatagtcaccttgctgtacaatagaacaccagaacctagtcctcctgtcttactgaaattttgtgccctttcatcaacatttccccttttcctgtcctctctcccctgccccctcaacctctggtaaccaccattctactctctatataaattccacttttgtaagttccatctgcaggtttcttcttgttagttggatttctgctttgttcttcgaatagaaggtgctagagggagatggaagacaggaggagagaagggatttttcccttccagagtcccagcaacaacccttaacccaacagcaacttttgcttctggtcttcaattcctgtcatcctcctaaagggtttcatgtacctccccataagaactggcacagttggcagcattcttcctcagaggactaagctctacctctggtacttagaggaaagatcagagatcagaacaatatgtttggaaaagaacagtaggaaggaaaacaatgcatgaaaaatattcagttaaaatattcagtaagtttaatatgtaaaaaatactcagcacggtgtttggcatgtagtaataaatgtgaataagtgtgaccaattattatacagcagaggctcagcttctgttagtcatctatagaggttttccttacatagcttttaatgcattatgatatacattaggaggtaatgtatcaaccaaaagggggtttgactttttaattgaataatgtcaaattaacatagtatgaatgtttgcttattttgtagaccattaagctatttgctatttgttatgctctcccttagtctttgtttatcaaatcacatgtttattttttctgaccctttataaactattttagaacagtcctttattcttataattttttagtgctttctaaaatgctgcttacatacaataataaatgtacttatttgaattatggtaagacttcatactcatatcatgtattttatgagtgtatttccaaaacttctgcatgaattacttacgttttacagcagaactagttacaaaagtaaatgctaatacttccattctacagatttttaaaaattaagtacagaagtggaaaatgattttttaaaaggcaaaggatagtcaaaggagcagggcttcattatggaggcacattgaacattggctacccaaaaatcaacttttcagttgattttttcaaccatcacattttctgaattttcaaacaaaaaatagttggaaggggaaacaaatgtgttcatcacatatcagactactcatatgatcccagctgagaagaaccaagactccaaaagatacctgcactgagactggttaaccatgtgaagccttagaagcactggcaaagtggcagtcagtgaagaagaaagaggaaaagacaatagaagaaaagggagaaggctgacaggtcagcaacagtggcagagataatatttcttagaaacaacagtgagtaaacaacattaaataagagcaaatacttgtcattggggatttgggaaaactttgaatcaggccggacaagttctagagacttagctaactcttcaagagatccaaatctcaagtcagagagcaggttcaggcagggtggcagttggtgtctgacagtataactatcaatgaaggctgctacaagaagggagaatgagtgtcaatggggtccaggaagagtcggggcaggtctgggcaggccaactgtcagcagtacagattttaatcagccagaaggacctgggtgtagtggcagggtgcctattacagaaatgatcaatgcctggtagatacaggtgctcatagaatgtttgcagggcttgataacttgatatgatttacttttttagagcaaaaaccagcagcaaggttggattgattacagttaccatatgacctgttgggattagatataaacttttggtcctaatggagaagaacctgtcattataaggctaagtgaggttgtctttaaatgtttgggatgcaaaggctagaaatgttcattctaagaatgaaacataaaaaagaaaaaaagacttgtaatttagtgatcacttgagaatggaagaaaatgacaaacagctacctgtcctttaatgttacaccatctctacagtgacaagctaagtacccacatatatggtggcatgtttgagaggtatgcaagggcagcacaatcaaaacaaatgtagtttagaagcctccctctaagatctgtttacaggaggaggggagaaagaagtttccaaatctacctgcttaaagtgttacagatagatccgattgcttagttctccctctaatccacaaaagtgtctgctatatacaaaaatatactaattttagagaaaaatatgaatatttgcatttgacttcaaaagaaagtttgctaaaatatttacagaagaggaaaacattggtttatgtactgagattgtttcagtaaaactctgcagatacctggtgttttaaaacaattatatagtacaaactagagcttctggttcttattccttatgatttattcttggtaaatgacttgagaatgcttttaattccaccttaatggttatttaaaacattttaaaaattagaggcataaaaatgctgctgactggatgtgtactttataatacataatttggggtgtccaatatggactcagagttaaaagagtagacataattattaaacatgatccacagacataggttgaagggacctttctgtttctatgggaacagtcctgtgctccatattccagctggttccagtggtgctgttaagcaaagactcttcctggatgtcagcacaggaatgatcatgagtctcaagcctttcatgaggacctcattcctatggcaagtgggattggttcactgctagggaatgagactcaaacaagatcaaccaaagtgatttccaggaatggagacagtatttatcttcctactagagtcactgaaacaggaggaaatgatctgggattgctagccttcatcttctcctgtcatcaagcagcagcatatctggatctgggggaatgaggctcacatgattaaaataaaataaaataaaaagcaaaagtacagcaaagagagggacaagatggagaaggcagtcatgccagagtacacaaatataagatgaatatgagttgtatctctggaaaagcctgatcagacatgagactgtttctgtaactaattagactagtatttctttcataaaccaaactttcgaaagcagaagatccaaattacttatattttatgaggattagtttgggattatcaaatattgacatgagcacaggactagaaggctaggaaaatctggcaagcctttttttcattgttgttagcaattgtttcattgttgttagcaaatctgttgttagcagatattgtggtactttattcataaatctggcatatttacaaaaaaaggtttaaaatcttttagcttaatgtgtacttcagaaatatgcattatatagtaaaattttaaaatagtctgtacattaaaaaattcttataaagttaacatccatgacagagatagttgccactcaccaaatagcagtgtgtattaggccctccttccccaggtctcatgtagacaggggagttgtgtagctaggtcacaccagtgacatctgagcagaagtggcatctatcacttacgggctgaggcattcaagagccactgtttgattctctagctctctgctttcaccttccagatggaagcatttctcattgcccattgatcacatgaaggatgtggctctggaaggtctcctaattcaccgcagtctttgcatgaattaaaacaaacaaaaaataacttctgttcttacgagccactgagaattaggggttgttctgttaccccttcactaacagtctatcttcactaatattttcctttttattgcccatctcatttttctcatggagtttggtttgataatatctgggtgagacactttcaaaagccattttggaaatgtacacgtgatttacagacactctattttcacagaatcatatgtctttataattatcaaatgttttataatgactgactagtcaagatgtgcatattacattttaacaagatacagccccttattaaatgtaaaagaaaacattttaaaattcactattagtttcctattctcatattaattcagtgtttcatctgttattataagtcaaaatgtccttccttgaaaacatggactttttctactgatttatttatttcctattttctacatttatggtgataatgtgtatgtatggtgccagtgtactgatgactttgctgatgacttttaattttttatgtatcaatagacatataaaatgagaacttaaaacctatctactgggtactatgcctattacctgagtggtgaaataatctgtctaccaaacccccatgacacacaatttacctatataacaaacctgcacatgtgcccctgaacccaaaataaaagtttttaaaaattacatctttaatcaatcaatgcaccagttatttttcaatttttctgctaaaatcacatatgctggtgataaaaataaatgaatatatgacattaattgattgcccctgaatattttttccagtaacatatttaccagtgtttacacaggataatcatgattgggtgccccaaattttacaacagtgctctggaaaagagcttcttgcccactaatttccaaataactaaatttttattactaactataatacaaaatatcaaaatcacaagttaacaagcatgaataactggtagtggagccaagttatagaggtttttcattccaagaaggaaaaatggagggcttcaattgcacagttggagtcattcttcagtttcaagtgttcaaagtggaatagtgaacagaagaagcaattcttgtcaccaattaggctacatattgacggatgcaagcaaaccttcactaggactaaaatggatttggtgtataagcagacttatagacatataaaaaccacaacagttctgcgttccttcttgcaacacccaaatttactttagtgtcttaattctgtaggcttataataaatctaaccactaattaacatgaacactaattagaatggccccaagttaataccttaagtatcttctcgaatagacagactttagctctttccatggatttcttacagaatgtataaattcataagtgttttgcccccatttacacatccccaatctaaaaatggtccttactcaatgaaggctaattcagacaagtggtggccagagaactcctcagaatctaggacaagaactgaggttccccaaactaaatggagcaagaaaggagcaattgctctgcaaactacttttacctgtacatagttgaaggtaaataaagtcctaacaaggaaaattgaggtaaacaaaccttaggtccagtctgccctttctagatgtctcctgccccgctttatataatttttagaagttttaatctgctttttaagaacagcttgttgaagtataattgtcaaataaaaactgcatatattcaaggtgtaaaacttgacatcttgatatagatatacgttttgaaatgatcaccgcaatttagctaattaacatatccatcacctaacatatttaatattttctcttttttattcctgtggtgagaacacttaagatctacgctcttagaaaatttcaagtatataataggtgttgctaactatattcaccatgctgtacattaggggtcaagaacttatcttgcataactgaaacttcgcatcttttgccctgtctccccattcctctcctcctcctagcccctgtcaaccaccatgctactctctgcttctttcagtctgactattttctattccacatataagtgagatcatacagtatttgtctttctgtgtctggcttatttcacttagcatagtatcctccaggttcatctaacattgttgcaaatggcaggcttttcttcttttttaaggctggataaaattccactgcgtatatgtgtatacacacgtatgattgtgtgtgtgtgtgtagacatacgtgtatctacacacacacacatatatatgtcacattttgtttatccactcatccatcagtgagcatttaggttttccctacatgactttatgatgcttctttcaaatgtactccctacaaaactcttaccttcacgatgtggacattagatctactgcctattctgactgcaaacttccagaagggactattctttcccagaaaaccccttcccacctctgaaaattatactcatcatttaagcctcaataatttattcaataaacatttcctccccagcaccttgagaggcccaggcgggcagatcacttgaggtcaggagtttgagaccagtctggccaacatggtaaaaccctttccccactaaaaatacaataatagccaggcatggtggtgcgcacctgtaaccccagctacttgagaggctgaagcacgagaatcacttgagcccaggaaacaaaggttgccgagagctgagatcacaccagtgcactctagcctgggcaacagagtaagactctgtctcaaaagaaaaaaaaaagaaaaagaaaaaaagaaacatttcttcaacctctctctgtgcttcctctgctaggcaacaggatatgtatgtaactgaaaggcaactcttcccttcaaggaaataacaatctaggggtgaagacacagatgcaaactgatatgtaaaataaaatgcagtaaattacataggcagggcatacaaaatatgtcacagatatgcaaggagagggcatatctaaagaggctctcaatgaagccttccaaatcacctacagccaaataagtggtcctcctacttttactttccgcaagtaattttctcgtggcaatatgctttcttgtggcaatctaaagaggctctcaatgaagccttccaaatcacctacagccaaataagtggtcctcctacttttactttccgcaagtaattttcttgtggcaatatgctttctgataaagaaatgatgtcagaagccagacagcatgtcttcaaatcccagctctgtcactcacctatctttgtgacctcaggcaaatcacctcctttctggagatgtcaatttatctatctcatttataaaattgaataaaaatagcacgtcttatggtgtcagtgtgaggatgaacttgtgtcatgaacagcagtgtctggcacttagtaattacttaacaaatattggctacaaatatatcatttttctcatctacaatcaattagagtttgttattagcataactatgacctgtaataaattataatttctttgggtgaatttatccatattgccaaattgcaaaaagtagagctttaataattgattctttactggtacttttttctgtctaaactcctgaagtcttctctttctctgaaatctaatttgtatttgcctttcactattggcaacattaaagtatcaacttccctttgatgaaggtccgcagcccagggcctgaatggaacatctgctcttattaacaattccttctttttcgagcttgtctattcttttagagcaacttggccctaaataccccctaacacctcatcttcaaccctaattccctgtatggccctcccccaagttttccatgacttcagtctgttcaacaacaactccatttctattagtccaatcatctctggggtctgggttctctctctccccatcccctctgttcatttcgaaaccctctatgtttccactgttttactcaaagtaatgagtaagtacctgcactggcaggacaagtatagaacgtcaacaagtgaagatgttcaataaaccctcatcatagagtattcattaattatgattgaagaagtaatctacacctccaacttcagcttctggcctaaattacatttttatacctttgtatattatatttttgtatattattatctcagtttgttttgtgttgctataatagaataccacagactgggtaatttatcaaaacacacacacactggcacacacacacacacacacgcaaacacacattgatttctcacagttctggggggctgaaaaatccaagatcaaagagctgttatcttgtaaaggccctcttgctgtgtcatcacatggtagaaagtagaatgacaaaagagagagcccattcctaaaagcccatttaaaaatgatattcctccattcatgaggatggaacctcatgacctaaacacctcccatgaggccccacatcccaatactgttactttggcaattaaatctcaacatgagttttggaggtgacaaacattccaaccatggcaacaataaatgaatgagatttgttttagtgcagtaaaattatttgttgtatttttcagtaatatttagagaaaagcttatttcagcagaagcaataaatgtgttataaatgatccttccaaacatttatacttataattgtcaagcacagccatctaataagagttgaaaggtaaattagttaggaaaactgggttgcctctcaaataaataatctagcatgtgttttgaagaatgaatgacgtatataaggaagagtttagaggaacttttcaatcctagaatggcataaaatatatgaagctctgtcacacttcataaatcagtactgttagtagatccatgtcagacagcaactgtgtttgcaagtaccaacgtaattataaatggagggcatcaccaggagtggttctacacagatctgacccaggtgatttacaaaaaggttgtctctccataacatatacttggatgcagtcacttacatttgctaattgctactgtttcctaattattcctgggagcaagagggacaaatgatgcccagaataaatttgaaaagcatattggaactctgaagacaggggcagaaaagtgaatattttaggataaacatttttaacacctttttcttccaaaaagtgttaaattttcaatatggttaaaatatcgaaataggtaggttattgctgcaagagaatggttggcttcatagctaatatcacatagtggaattttgacttctgggatgtggcttatgacaccagaaagacagacacttgaggcaataaaggtcattatttttgagattcagaaactatatatttgtccaggtaatggctgatacgcacataaataaattgaacgtggagaggagtgatgaataaaagcccacattcagttgtgaaataaattacaaattgagcacattatgaagacaaatacactgtagaaagcacattaaaacaaagtaataataaaagtattattacaaatcagtgaatgattactatatcccaggcacttgaaggtatctgattcaatgccccagtatccctttgaggtaggtaattatcacctccaattacacagattttttaaaatgaggcttaattgatttaaatcttgctaaaattctcagagctagcaaatgatagagataaaatttgaaatcaggaccatctgattgcacagttcatcatgatacctagacatttaggagaaaatattggagaaatgggcaggaaaagtcctaaatgacctcagacacctctacacataggacataggtaataaataaaataaaattgtgatgataacaggtgagaaatagaacttcatagatgcaaataagatctgaaaaataggacaattattcccattgttgtcattccggcaataccagaagaggaagctttaagcacatacacacacatgcacacatgatgtctattagaaagaaaggtaaaattgtctgcaagtccagatgacatgcacctgtagcaatactgagttccctctgggaaggatatgaatgaggtattcccaacatgatcacaaagttgcggcatgcttttaatctatagctgcacatttcttttggcagaaagaagactcttctaagttcttccctaaataatacagcaatattttatgagctttaaaaaagtatacaaatgacactggacactatccatggctcagcagaagtacactttaaagacacataggttttagcaaaaaaaaaaaaaaaatgaactcaatatgatttaagagttgatatggcttccaaataaaagatgatgtgatgtgatcgtagtattcattaagagatctatctaatctagttccctgagagaactgacctgtgctagtccaatatctcttggcatactctgcttcattcttgtcaaagatttcaagagggatttattgaacatttaaaatggaaaaaaccagaatatctgaaggacttttgaaggaaataagcatgtttaaagtgaaaataaatttcaaagaaccatggtggctaccctcaaatatgtaaagaattgattgattgccacgtggaagagggttagaattttttatggccaactatgttatacattagcttggaagataaagagcttctagttactggaggcatttaggcatcatctgaactgatgcattggttagcatcactttttagtgagtaattggactcagtgtcttttaagagctctctcagtgctgacactgtactctgcacatattccttcactgccctccatgtgacattggcacatatttgtgaaatattttgaccaaaattagaagtaagtctttagagataactagcttgagggcttgcaatagagctacatggagatttaatcagtggccttggactcattagcgccacatcctccaaacctggctcttacatagtcatggtcaaagtgtgttggtgaagcagacaggtaagaagccatctgaagatattcttacaattcatactcatctacatattgagaagtctgccttttctttttctctatggagatatctataagcaggtagtgggttgtagggagatcagtactgccagtagcagctatcccatggtcttcacgtagttgggagactcactaagacgaagctcagtgaaaatttcagggctgtgctgtttattatggtctgctatggtatgatcacccaccacttctggtttacacctatatcaaattccaacagctgctgagcctgagtaagtcataaatataatgaactttgacatgactgaaggaaagttaatttgaattatatcatctcagcaatacatctccttgagaattttagaataaaaacatcctcaacaaatctatagacaacatggcaattttatatacctcttgtggttttcaaatcattcttccctccaaggccaattgtgatgagggtgactctatgggttatgtcttttattccattgaaggcaagttatcataaggctagttaccagaggaaagttaccaccaaggagatgaagagcatgtgcttcaatgaatgactgtgttaacagtgtgttaatcagaacaagtactaggaaaagtgggaatttaaatgtggcacaaaggccaaggcatgcaccaatgtaaatttagaaaactgtcgagaaaatatgtatggttactgctggaaataattcttcagccaatttggtaaaactctaagtgttaaagtgatgagagatccaatgggaaatctctagagtttggctgtgagttataaagttcataagaatgccaaaaaggccaaagaaaaaataaaagtaaaataaattagttgcaaaatcatatgtggggttggatctaaaggaaagttgaacacatagaaaactgagttaaaacaaacttttaagtcctgaaaaggcagagaattagccggtgtaggaagctgagtctcaaaattaaggatcttgataactctatggaaacaaaaagttaagaaaggcattttctgcttatagattaataaccagtattggaggagagaaacatagcaattcagatctgtttcccttctcccccagcagagaggatgaaaattggccattgtgtatacctccccagactcactgtatacctccccagaggaagttagagaataagattgacctgatcaactggtatattcagctatggctggaaagagagagttcccaggcaatcccattattaactgtgctggtggctactttgtgcagattccctataggctcagaacagacctccatattattccctgatagtctgattcaaatgagatcccatatttcctggtaggagaacatggttaacaaggtgccgtatgccagtctgagccacactctcgacacctgacctctcaacaaatggtgctgcagcctcttgtggcctccccgttattgctcacaccatcaatccctctgtggtataaaacggaaccatccagtatgtgctccaaatcctaggctgtgactctgcctgatgcccccagcttgggatacaaactccacagacatcataatctacagctgaaacacaggtataagaggctttggacatttccaggctgcctcagcactccttcaaaagcaaaatcaaagaataagaaaatgtttatcctgaccatccaaaccatgcatataaggttgaatggaaagatttgggaatagtgctgagatgaatgacttggaattgctacacctgctggagtttattccactccaaaatgtctttattccatcaggaagggaactgccctggaaataggtgctgttactggggccatctcttaggcaggaaaaaattcagacaccaacaaaagccagattatagctcattgtctgtgacttgatagattgaagacagaccattattttcatggaccacaacaccaaaagctacaaatggcagagccaatatatccttttgtttcaaaatgtcaactataaaaagcctagagttttcctatcattaccacttttctggatacctgtatgtttcagacaatggaattattttctctgtaggcttttaaaaataagtctttaaaaattggtctaatatgttgtaccaaagtctgtcaattaagaaataaagctcttgtttttaaaaaaaaagagtcatggaaacaatttctaaaatccatatgctttaaaacctgcagtaagatcatattgtttagaatgaatgtgtgtggtcttcttacctgacccttcgggtattttttttttaagaatcccaggacaagcatgtgtagtgataaaaacagcaaacactacacggatatttcaccaaaggctggtgaaactcaggatagttaaactagatagctttcatttccatcactggctctacctaatgttagtatatttcttaaaccaggacttcttaggaagttcagtgggcactagcaaatctgcactatgcaactggaagaaacttgtatacatagccactttccagtcttggctaacaccatcagcacaatgtcagcttattttccacttccggttgctctactgtctgttatcatcatgttgacacagcatacatttcccttcattatcacctctctccttacttttatacttaggtaagtaggactgaagtcaagtgaaacctgttttttaggttatgaaataaagagagattagaaatactgagaacatgggtagtaagagaaggaggacttagagacctgtttgtctatattaattctccatcagcctaaatagattaaatactgattccaaattgattataatcagaggtgtatactaccaaacactgaattactctctcttcataaatgaaaactgcctacatgtagctttttatcggagttctttttaggtgtttcaagaacaaaattttaatcatcaggttctaaaaagaaacaaagtagagagaacagagtcagcctcatttgtgcaatcatgcatttgttcatttcttcaaataaaatgtcctgcttacctattatattgtcaagcacagtgctgggtacaggaaacacagagatgaggaaaataagtatcccagtgcctatggagatgagcatttagtgacttaaatagccccagcaagtccgcagatgctggagttgtggtccatctgtttttgtttctctcattgacttgcaattgggataccaacaagaaatctgatattactccatgtgaaggacgatgcatccaatttctatgtggttttataggagcctagttcaataaagctgtagtgaatgcttaaaatgaagcagtgggtatggcttaaacaatttggactttggagacattaggcttcaaaaccaaacttgcatttaaatccctgttttacaactcacaaattccatgaaactgttttactatcagaaaaatgggtgaatatttatgaaatgatctttgtataactgtggtcaaagtatgcattagcatgtgtattcttctctttctctaagcttttactcaacaccttgaggacagagaatgcaaaactatataagatcaggaatacaggaagataacacacggcaagaggaactttgaatatgactttaaaacattttacacccaagaaaatatcaatgcttataaaattaaataaaaactgtatatagagatgaataagaatatatatttagataatacattttagataaaaatgtatatctctaggcattgttcattaccattctcattgtactaattaaaattctaaatattatttggaggggttaatatttctgtatcaaccaaattctaagaattttttagtattacattgaatgtttgataggaatttatttctagagtttaaaaatgagctagcaaactcaacttgtattgtactagcaatagtacacttactaaattattataattacatattgcaatccttataatctatttgtttctttaaaattattatatgaaggtctcccatatttatcacacgagtatctgatataaatgtgtgtgttggggggtatgtaaaatatacaactttcatttgacttgtattttggattttgttcttttgtttttgcaatggctatatcttaatttcatcatatatcataattgaaattggtttgcaaattttcttcaaagttatatatcttcatttactatacacatgatcaaatgtgaattaggatgcttaatgcatagtatatcagcttaatatgccatgtttcaaattgtacattcatatcctttgaaaaatgtttaagattaaacacatttttaaaatcatcattattattataagataatcttaagggattgtatgtcatgtctaaaaacagtagaaaattatacaaaaagtcatctaaatcaataatgtacacagtatttacttactgtataagtttcctattgctgttataacaaaattaccagaaactcagcagcctaaaacaacacaaagtcactgccctgcagttttggagtcaaaacttggctccaaatgggtctcacttggctaaaatcaaattagcagcaagattgcattgcttttggaggccttagagcggaacctgtgttctcacctttttcatcttttagaggctgttttctgcattccttggctcatggccccttccatcttcaaagccagcaatgacaagttgagtctttctcaggtcgcactactgactcttctgcctccctcttccatatctgagacacaaccggataatttaggataacctccttattttaaggtcagttgattagcagccttgattccatctattactttaattcctttttgacatttaatatattatattcacaggttctggtgattagaatgttcacatctttgggaggcccttattctgcttaacacaactatttactgttgaattttatgccatctattcaaggaacactggtctactttatatattttattctaatttaagcaatatttgtatgattaatgtttttatgccttaaatgtatttgtagaattttattaaattcttatagcaagtatttcagtattccaactttttgtttgttgtttatgattcatcttatcaatctactctcatcaacctagaatacagttgctggataaaatacaggacatccagttacattttaatttcagataattatattttaggatgccactttgtatgacacatttacacaaaataattatccattgtttatctgaaattaaaatttaacataacatctgcatttctatttaataagtctagcaaccctatcctaggaaaccctgaacattgttcctctgtagaactgaaaaagaatttgtgggatcatctgttaagacctcttatggagaactgagacccaaatacaactgcagttgatgttggaatggtttcaaatagaagcagaaggtattttttttcagaattttaaatgactcaaaataaatatttggccaacagaaatcagaaagaagcatgctgctattgcatgaaattaaactaagcaagcatctatgatttcctgacagaaagtatgcttccagtaggatagcagcaagaaagagagccctttggtataatacctgattacatggcaccactttaaattagtgtaatattctaagaaagagaacatgggaggcaatttgagaaataagccatgatttaggaattcatagtataagtggaccaaatagaaaatactgttacttgtatatatcttactttatctaagatatttaagatatctcaaagttaatttcaactatggttgttttgctccagaaaataaattgtttatgctttttaatcaaatactgcaaatatatgaattcttttaaaaaaacacatatttaaagatttcttgacagactatgttattagagtgtggagaatagaaaaaaaagtcttataaacaaatcatgttataacatatctctttctacttagtcatattacggtcataaaaataattttactttaaatacaaaacaatttagtaattgatattaaataattgggctcaattccattaaatcacatgaaaatatgaaacattttgtgtctgtttagggccagttttacaccagaagagtacaatgcttataggtactatagttactgcagatttacataacaagaatataaacttaacatttctcaagtgaccaaatgcatcagcaaaaaagtagggacagcagagtttagagaatgccaaagggatttaggttggtcagtatggcaaatgaagactcgtcatctcacttaccaacaaacgagtaagaagaagcaggagtcttagtcaatactcaaaccaatcctgtgtgctgagcattgtttttatccccattttacagacacgagctgaggcttagagtgggaatatatgccacgtcacttagtacatgcccaaaccacaatttgtgtcaagcatccagtctctacatccatgcttataaacactataccatgctgcctccatgcaattaaactgaatgtgatttaattgctcaagttgttatgttaaacagtgtaaagtttgtaactatcacacattgtgatcagttaaaattgattatataaaatattatgtgtgttgtgaatatggcctttatttttcaaaataatcaaaacttatttcaacttgcactaatatcttcatagagctcctggataatggcataagagtttggggaattaagattctggagaaaagcacctgcttttgaaggtttcaagtctaagggaaataattattttagatagattgccccataggattttcaaccaaaggaagagaactcgtcacctatatggtttccatatttgaattaagtcttaaactatcatgaatttatttttaagaaaattacagcttttcttgttcccaattacaaaagtactttaaagtgttggctttttcttaggttccataggaagagtcaagagaaaaagacataaaagggaacttaactggttcttgtcaccaacactttacaatttgtcatgacaggactgcttagtagacacaatgtccttccctcttttttagccattgaggcagagcaatttatgatactacattaactggcagtatgaggaaaacgtggtagaagaggataaggaactcgctaatgtgaagcgaaataaaaaatgagtttctaataagagattactttacacaataacttttctggggtcacatcagtcttccagcttgtggcttatgtatttccataagaggaaaaacattttgaatgacaaacaagaagtaatgatgagtagaatgtgccacagaaaagttaggtaatgttcaactagcaaaatctgatatactgagaggtatctgctgtgggctatacttttatttttgcaaatagagagcaagaaatttataaattaatgtaaagtactgagtactgggcatcctttttctctttctgcctaagatagctcataaaacataaacatatggttatcaatagataccccatagggctcttgggaaaagtaattcggattctggatcatacgtttgtatcatgctatgttgatgtgaatgcaattgattaaggtttatgagaccaataatccaccttaagtatatttatcttctaaaatgcttcctgcattaatttgcatctctcactgaatatgcataataatcttcatgtgcatttgcttaaaaattaggtcatgcctctgagtagttgaccatttcttatgtagctggcatttttttttctaaaataagagcatcttagaattaaacagacccttagagactacctagtcaagttctcatcttacttgaggtaagaggacaagattcagagaagataacttccttaatcaagtccacagatatgttaatgagaaaagaatctcaatttcttgtctaccaggccaatcatttcctttacttttaactttaactcactttttagaacacattaactcagaattggcttaaaaatgtttatccctttttcttttctttttatcaatttcaacaaaaaccttgtacttgaaaactagttgcaaagcacttggattgtggggctggcaagaagtgagagttgggaagaatgcacaagaattatgatgatctcttcctgaggaatcgctgaatggaaatacaaccatagttgcataaataactgaagaacaacacagaacacaaatctggaaatgtaaaataatggacatccagatagagcacatatgtgtttagaacttgtattaatagggaagatttcatggattagttgatttcataagaaaattggtttcactgaaatgaagagtggtataacaaaatgaaagtggtattaataaagtttggaaagtttggatttgagctaatagtcaataggaattaattttactttaagaacccttaatagcaccactgagagtacacatagcaatttttactgagtaactaaattatccctttaaaaaagtctcttctacagaattcaagctccacgatggcaggccacttctggctcaaacagtgctgttagtattcagcagaatgacggtgttaaaacaaaaatggactgattgagtaactataaaagaagtggcagtctacggccataccaccctgaacgtgcctgatctcatctaaaagaagtgacaaagaagaagtgttgtgcaagaactttatggcaaaaatctggaagtcactttcgagtacagtgatcagtgcttatgtagctagcaatttttttctaaaataagcatcttaaaattaaacagattccacccagatgtggactagagatttgaccttggaagtgagaaggaaaaaaatagatctaggagaaatttcaaacaaacactataatttgttgacagagtctaaacagggtaaaaagaagagaagtcggtgtcaacttccaagtctggatctctgaaagacaaagataatgttgacatagaaaggaggaaataaaatagacactgagcataacagagaaacataaggtaggttttaagcctgagacctatggacaaaaggagatttgaccttggaaatgagaaggaaaaacatagatctaggagaaatttcaaacaaacactgtaatttgttgacagagtctaaacaggggaaaaaagaagagaagtctaaaaagaagtttaacttcttttctctaaacttctaaaaagaaggttttattattctaaaaagaagtttagagaaaagaaaatggtttaaatataaataacatgatttggcatgataggaaacattcaatgaatagtgaccattttaaacatgatacatttggggttttagatagcttaatttcacaatttgggttttggattgctttctgatcccagttttggattgttttagttcacatttttgaacacgtaaaagggcagagattaagaaagcagtgaggaaagcacgaatgcagcttttctagcaggagatatgtgaatgatgagaatgtcaagggaatagtgcctgggagaaagtccaaaatggggcaacttgaacagaaggaagatgagataaagaagacaaagaaacaaaaagattcaaagcaatgtggtttcccagagtgcaggggaggggaagatataaaatgaggacatatcattagcaatcaccaatctatgcctgcgctatacataaaaaatatataaaataataagagaggtggaaacaggtaatttgacggccttctttggagacatgtacgttataatcctatggtagtgactccctctactcattgccagtcttcttgccatcttctatacatattcttcttttgtatttcgaatgtaattatttcgtgctttttattgtcagttcttaacaataaataggcagtgtaaccaagtgttcgataaattgccatttgattggacattttagcatggggaaaatgttttgttgaagaaaggacagcactacagtgataagctgcctgctgatgtaaacactttaagggtttatgacaggctcactatctaccaatactattttcaattcaattcaatttgagtagatgaggattttagagaaagcagctgccaggagaaacatatgacatttaatcttatctgagaacatgaaatcttctgcagaagctataagtacatacgtgtgtgtaatttgagtcttagtgtatattcaaaaaggttatagaggaagctgtattctataggatttaagccaacagacaaaagaaaatacatttcttggtatttttcccaagatacacttgactgaacaaataacatagagagtctaaaattccaagtgaaaacattcaactgattgcaatttttgaactattttttttttcaaaatggtaaccttaattcctcttctaaaatcccacaaaaacctacaattagtgtggatgctatttgattggttgaaaactagtccctgttaacaggattcaaaacactgccaaaatacagaaccctgcggattaccttatggactcaatatattactttaaaaaatgattttaaagaaaaacaacagaataattgaaaattgactaattctgattttatatgcaaggcactcaaaattacacaaaactgagttgtggtaaagaaaaaaatatttagtgaatttggtcatgaccatgacaaatagtaaaaataaagattactctaaaatttgcccaagcacattgtaatataaaatccatttaactttcaaatttatataataaactgattatatatttaaattggatgcatcatttacaaataatttggcttttatttctaatgaatgtgccttttatttcaactatcaaaattcatttccacattatttagcagatttgtttactcaaaatcataatctaccagatactcatgctgtgtatctttacttttgcttttatccacacaaattgatttttacccaattttcactattttgagcccaaatattcttctccatacttgtctagatgcagtcattagccatttaaaaactggtttgctcttttagtccagaccagagagaaagctatgactcttccttgaagtccaattgggtagaaaccttgtagcagccccaaagaaggttgcacattacaagcacaatcacatgccataaactgcaaacatctcattttccattgtcttctgttcccaattcaacttgaaatgagtcctctcctttccacttccaccgccacatgtcaaacccccaatatttcttgcctggatttcctcaacaaacttgttattttattttttcttatccacatcccctgcaactcttcagactctccactggcagagaaatttcccaaaatataatggtactgagaacatattcatgctcaaaaaggttaaatatactcgaatccctagcaaatgaagtacaaacatggcataaatcccttcataaaatgactcccaattatctgactatccttgttttatagtaatcatataatttttcgcccacactggaaaatactttttcagtggaaaaggtgtgttattaacaaggaaaaaaggaatatgtggcctcccagttctccttgtggctatcttaaacttaaaacaggtttttggtcacaggttttacaaacaatgcccaactttcccttctctgaaagtgtaaacccactatttctattgtctaggaggctgtttgcatctgttcctttccctcttttaggcctttttaaattcccacttccttcatggacagtttcttcatccgttcaccatccctggtcccaagacgtcatactgtgaacttcacctccattatcttactctgccttgaccagtcacttctgtgcttggtattatccccctgacttgacccttaaaaatctgatgacttcttattcatttttgcatttttctgaataccaaacaaaggtttttgcataaagcaaacatttaataaatacttttgatgaaatgccatcatcagctataagctgacacttaaattgtggccattgaaaagtatttatttagcaattgtattaaacctaaagaagaggacgttcaaaaaggatttttgtcaaccaaagattttgagtcattttacaaattcaaaatcattcatccattcctgcatcaaagattttctttaaaaatttattatatatcaaaagcccctaatatgaaaatgtacctttatgttgtcttagaaaagtttttcttgagactttcatttaaattcttctgtatgcgatgatttatacttgaataatcttacatctcctgatcccattgtatagaattaatgagtttgaatgtttttttgttttgtttttcctgttgtgtaaagaatgtactcatatctcttgagttaccaattttagatagtatctattggctactcacagaaaaagatgagtgatttagtgtttgcacaagtcccctctctattgtcccttttcacagacctctcaattttttttttttttttgaaacagagtctcactctgtcacccaggctggagtgcagtgcgcataatctcagctcgctgcagcctccatctcccaggttcaagttattctcctgcctcaggcttcagagtaggtgggattacaggcacctgcaatcatgccaggctaatttttgtatttttagtggagatgcggtatcgccaggttggccaggctggtctagaactcttggcctcagcgatctgcccacctcgacctcccgaagtgctggcattacaggcatgagccaccatgcccggccagacccctcaatttttaaaatttatattactatttttgatttacagggtttgtataatatttacattactcacattagtagataatatttgtttgtataatatttacattacttacattagtagataaattaatacttctctattttgtttctagattccttctaacaacgtaatatcaattcaaaaagcaattactatattatggctactaaatattattcccttcagattcattcaggtagcataactggacttgcagaaaaggagtaagcataattattaaaatcctggtttttaaaggattatggatatatatgaatatattgtgaatatattaaccaccagggtctaatatatcctttctcgagttaaacaaaaagttaaaaaaaatccttctggatcatatgtgattgccactgccttactgtctcatatctgacatgcctttttttggataattcatatgtagatatgtaggcatcagattttctgggccatttacatttttagcctaacattgattgatagtttggttggctatagaattttaagtttaaaacacggttccttcaagaaagactttgctcaattctgtttagaattcaaggaggcacatgagatctgatgttcattctttgtaggtatctttttttcccttctaaaagttcctagaattttctgtcaattagtgaaaatttactaagatgtttggccctttccattttttcaattttaagaattttctttcttcagttgtgaaatcttccttctgttttgtttttgtatttaggttatttccattctttgtctctgtttcctcttctaggatgtttattagatatatattgggatcttgcatttatgctcaacatgtcttaatttttcctcatattttcctttttttcacttttctttctggttctgacttttattttgccctctagatctctgctctggttctatgtttcagcacatctgttcagctttttattttcacattcataattttagtttctgggatcatatgcttattccctgactgatattttccatagccacttgcatgtgtgtgtatgggtctgtgttcaatattttcttgattcactcttaaaatgctagttaaaattgttttttaagaacattttcttatatttcctgaattacctgtgggattttttttttgagtcagttaatgctgttttgtttcttttttagtgttttaaaattctgctctgggttttctgcagttaatcctgccatccttagctgttgatgtagaattataatgggaggaccaggttgcatgacaaagattactggtggggtctgttttctttgtttgagagggctgactatgaacttgtgagtttagtgattgttttacctggctcgcttctcttaaagatgcatggatattggcaagcaagcagcctggaacttaccccaggagaaacctgttctaagagttgagaaacttatattcttatcctaggtagagctgtatttcctattccccctggccatatctgaaataaaatcacttccaatcctgccctttctctttcagtgccttataggtacagaagtcctctgtcctcacataattcccatttttcagagttctttcttttaactggaactctttctacattaaggttggagcagaaaggggaagtgaggagcccagctggcccatatctcctgaaatgcagttctttaaatatttccctaatggtcactctgatgcctgcttcaggactttatgttgactttaggtttggaaattatttgggacttttatagtaagaaccacttatgcatcttgggttgtgcttcccttctttgaatttctccataaatcagacccaactggcttttactttctgagagtttctcagttttaccaaatgtttgttctaacaatataatggcttcctctcattctctctccctctctttctcctttccttctagtcttctttcttttttaaaatctcattatttttgtcatttacttgttaccttagatggaggacatacatgtgtctttgtgccagccattatcttgaaccagaaaccagattaaatttctttttacatatttcttttaattattcaaataaatctgtttcgaatttattttagatagcccggaatatatattaatacttggttaaatattttttccacactttaaggtaggtggtactaacccatatgataccacatttagatttttcttttacatttctcaacataaaaaatatatatatatgtggttacagccaaaaggaactgtttgcttgcaatctgttcttcctggcaccctgtatgttccatgagagataagcatctactgaagcataaaaagtgtcttacaaaatcatagtaagtaaatcagtcactacattctgtattatcaatagtcctgggtgtcattaaggttctgtctgtatagaaaagattaggtttgtgtatatgatattctcctaaagcattttaacataaagtcatggtcactgaaatctgaaaatattcacatttcagtcttaatcaaatctagtacctcaggatttttcaatcatattcagaaagttcaaccatttcgatgtgttagctctagctctaagttcccaggctgaatatccagtggtctagttgcataaattattgtaatttgggcagagaattcaaactgtttgtaaactcaatttcaattgaaaaataccacaatgtcactaataatcaacacttaaattaagtaatcttcagccccacagcttcctcagaacccccaaaagtaggatgtgtaatctaaaaagattcattgagcaaatatttatttgtgctatcaaagaagatggcttcccccaaaagaattcctccaaatgttaaagttggtaattttctgcaggattaatatgtagcacaatcagaaaaaacaaaaacaaaaacttatataaggcagcattccctaggagagccacttggcagtcctgcctgcatgtgccctacatgagaattccatgcttcctctgaatcttcacaagcatatcatttaaattaagagcataaatgaggccacataaatgctttcttttccagtttttttaaaatttacttcccccttccagagcagattgcaacagtctggtataattgatcttgtccacaaaaaatcgaccgtaatacattaaatagttctgtaatgtggcaccgttaaaaaggatctgcttcaaatgactgtgaactgacaaggaaagaaaatgttatatagttggctgggcgcggtggctcacgcctgtaatcccagcactttgggaggccgaggcgggtggatcatttgaggtcaggagtttgagaccagcctggccaatatggtgaaaccccatctctactaaaaatacaaaattagctgggcatagtggtgcacatctgtaatcctagctacttgagaggctgaggcaagagaatcgcttgaacctgggaggcagatgttgcagtgagccaagatggcgccactgcactccagcctgggcaacagagcgagacttcatctcaaaaagaaaagaaaagaaaagaaaatggtatatagtttaccaacaggtagcctaagatagttatatgcagtgattaacgattacaaacatacaatgtggatactgataatcatttttactgccctcctttaaggaaatggagaaatgtcaggagacaaggtacagctgaaaattttcctccagtttgatctattctgcaaatctcttccatccttgtccaggttattgacactatttccgcaggattttcaggctgttcttttctcatctggactattccttagagcaggaattttattactaatctccaaactacctctcgaatattagaattattcacattccaaattataatacaaagatttcagcaactgctctctgatgatattttttttcttccagtattgtctgttaaatatttgaaggcaggtacacactgcctcaggaacaactctgtcctctctccaaatgctccagattcttctctccctcacagccctctttaactgctgtaatctgtaagatctactcttcgggcaagcctctatgtttaagaaaacactttcaggccgggtgcagtggctcatgcctgtaatccagcattttgggaggctaaggcgggcggatcatgaggtcaagagattgagaccatcctggccaacatggtgaaaccccgtctctattaaaaatacaaaaattagctgggagtggtggcgtgtgcctgtagtcccagttacttgggaggctgaggcagaagaatcacttgaaccctgaaggcagaggttgcagtgagccgaggtagtgccactgtactccagcctggtgacagagcagagcaagactccatctcaaaaaacaacgacaacaacaacaacaacaaaataagaaaacactttcagttgggggtctgctcagatatggtctaaatggcaggtgaaattgagacaattacttggataaatcaaatcacatcctcctacgcaattcattcgaatatattcagtcattaaacaaatattttttaaagaacctattacagactcaatattatgctgagtgctgaagagaaaatggtgagcaaaatcaaataaagtccttgccctcatgggtaacagcctaatggtgatgatagccaacatttattcactgcctattatgtgcatgaaacacttttcatgactcctgtcatctaactttcagcaaaataaatatgagttattagtacaaaaaaacacaccatacagagacaaaagaagttgtgtgtgtgtgtgtgtgtgtgtgtgtgtgtgtttgtatttattttaaataatcaacccttttcctgcttttccccagaatatatgaactcaagtcttctctagttcgagaacagggctgggggtgatggcagggggttgctttacattgctttgtattggaatttgtattgtccagggggaactcattaccacctatagatacatagccacttgcccatgttttctcagctatttagcagacacaggatttgaacccaagatttcacattcaggagcttatgctctttcttactccactggcacacctgtgtacccctacactcttctgcccctaaggtagataaatagagaaaaagaacaagaggggtgatatggcaaaagtatctcaatagttgcatcaattctcctttgctttgtgaattctggatgaaacaaaggacaactataataattcttgcttgctcttctctttaaacatgtagtagtcctatttgagaataagtgataatgacaactttttagaaaaaaatctacatgacccatcattaaatgggaaaccatttttttcagaaaaaaaaaattgttataatggagattacaataagatgcctacagaagattcccattgtgctatagtctaacttaaatcacaaatacgcatttatattattatatcattaatattagctcattgaataggcatttattgagaatggactataagaagagctatatgttaagagacatattcattcagacagacattgcttattgtccacaacaacgatgacttttaaaagtaagaagaggaagtaaagtaaaggggcaggagtgagtagagggaggagtctaaggtgacaaccagctttctgacttaagctgctatgcatcctgaggccactggaagaaaatctggtttgagatttattggaggttttttcttttcttttctttttttgcctttttgagttttattttcttttccactttgagggtgttttgttttgtttccatcggatgctctagaagaggcagagtgctcattggaggttgacagtgtcataacccttgtctgattatctcgattttatgagcccaattaaggatgataaaatatgtgttttagagatttctgccatccttacagccccttaccatccctaaggatacttctcctgactattaatcacattttaatttttttctcttttcagtacaattatgtgagtttgtgttattgcatggccatgcctcagtggtctacccttccttcacaccacttttctatagggaaaccaaaggtgcatttataccataatttagttgaattcagcagtagttacaaatgatgttattaaaatctattgggaaaaatgattcatcttgattcattcaaaatgattcattcaaaaacagaggacaaaggaatgtggggaagttaaatgatatatcattgaataaaggcacttcagaaagctctctgtcttcataactgctacaagtgtcctttataacttcattttacccaaatgttttccaaaacatctgtctaaacttttcaactaagtttagttgttattcttgcttcttgtaatttcagagagacctgtgtggttcgatgcattctctgacgttattctgagaagaaacaattaaatgcatactggaagacattttgctcttctacatgttggaaattcggtgtcaccaatgcacagctgcagaatgcacagttctattgttttctttctcatcacagatctgacccctcaccatcttcccccgcccttgagcctgatccttttctgactttgagcctggcaccttgctggtgccggcaggcatcatgaaggcatgggctgggagccagactcagccttgcaaaggaggctcagggaagccgactgacatgggctcaataattagttcaatgccggacacaatgctcaataaggagctgctgggttaatggatgtgtgtgctagctagctgtagtaaacaattcaagttgataacatggggctgattgtctgaacagtacaaaagaaaatggaggactgaccagctctttggtcctccaaggtcaatacaacatttaaagccttcttatagagatatacaagttttgttcatttttaatattcatgtcaataatttaagcaatgtgaaaacttaaacattctcaagcatttatttattttttttggtagagaccaggtctcactctgcttcccagcctgtagggcagtggcatgatcctagctcactataaccttgaactcctgggctcaaacaatccctgctgtctcagcctcctgaacagcttggactataggtgcacgacaccatgcccggctaatttttttatttttattattgtagagatagggtcttgttatgtttcccaggcttgtcattttatgtattgtcttgaataataaaagaaacttggacagagaatagcaggtagcaaattttcagatgtagatttaggataatacaaaattttataatgtgaagtacctcagtaccaaaatcttagctatttataatatgatagcccttgatgtagagctaacttaaattcaacatttccatgactaaataatttgtgggctctaaaatattctcaaaattcctagagttagcatttcttaattgatttctttagcctttttcacattcaactatattataaatacaaaatgaatccattaacatattttataatgtgtctttcagtgtgcttcttagatttagtttgatttcagaaagctaagaaagaaaaaggaattttgcaagccacactcaatcatatctgcataggcatagctatatagacacccataaaattatgcataacccccaggttttcaaatgaacacctcccacagtctcagcaacacagggcaacctccaccctctggcatattcatgtgtccatttcactgtgaaattcttatcttcatcactgctcctcagggggcctctacaactctgcaatgttattgttctgagagaaaatggttattttgtaaaattttccttcaaaaaacctatttaatagaatcacaagtttattctcttcagcagcaagtttgctgaagtacattatttgtccaaaaatagttgaaggccacattgattgaggaagggatgaatactcatactaatgagctttctgtcccgttgttgtggaaattttctgtgaatttgctgggattttctgctgggtcatgcagaacctccttggaatgttatagcctgggaaatgtaattaccccatgacgtttcatttttctcacaatttctggtgtcagaggatggaacaatcaagtcctcactctgaaaggactctctcacatgcccatcagggcagaagggctatcattacagaaatacagcattctcctctgtttttcaagctggtttatctccatcccactacccgaaaagtggaattcagagttcccttagttctctgcttttctgtacatagaactacaacatccaacccagcaaacactcccttcctatacagatattctttaccagcagtattttatgtggaaaacattaacaagagattagtgacaaaagaaattactttgggggagtccattgatctttgccttctaaaatttataagctgctttatataattgtccatgattgccttctttaccctcatcatcaacttccacatatgaaaaagtaacaagaatggggactgagaagaaatagtaagatggttcagactgaacgaagccattcagtttttatacgtgtgtgtgattatttcactataaactctgcttccatgactaaaatcatcacaattaccaagcaatggctttatcccagagttactttagaacaaaaaagaaggcatttgtcatgcagtggcatatctcggggacagctcacccctgtgaaccatgtctgccctttcttcctccttcttttaattaacatttggaaaagaacagtgatgttagcagatagcagagctgggaagggagactcagaaagtgatgtgagctttgtcaatcttcaaccttgccaaggaggacacattaaagtgtttttcatggaaaatcaggctttgtcaacacaaattcaaagcaatgtgaccttgacggatggagatatatatatatatatatatatatatatatatatatatatatatatatatatgcatgctaagtaagaatagcacagactgaagcatctttagagaatataagtgaaccaaataaaaggaggaaaagcatcctaaaagaagatgttaaatccaggaaaaagttgtcaagtgtatttccttctacttaccttttctgctgactgggctgtaccaaaaaagatggggatgaaagctaaccaaatgatgcaggtggtatacatggtaaatccaataggtttggcttcattgaaagtctctgggacacctctcgttttaatggcataaacagtacaagtgaccatcaagaggatactgtatccaagtgaacaaatgagtgagagatcagaaatgtcacacttgagcactcccctggccttctctggatctagtgtccgctgctctccatagtcaatgatgatgtgggggggatccacaacaaaccagacaaacactccaaggagctggacggagatgaggctgaaggtgatcaccagctgagatgctggactaatgaacttgggcgctgtgacagatttcttcccctgctcaaatattcggtggatacggtttgttttggtcagaagggctgcatagctgaaacacatgccaagtcctaggaagacccgtcggaaggagcatatgattgtatctggtgctgcaatcattaaaaacgtgattgaataacagagaaaaatccccgttaggagcacgtaactaagttcgcgtcctgaagccctcacgataggtgtgtcattatagcggacaaaggtcacgatcacaaaggtggtggcgatgattcccaatattgcaacaaacacaggcaccacagcccagggagaatgccactccaatttgatgatggggataagctggcagcctgtgcggttcatgttgggtctctgatccagagggcaaagttcacaggacagctcatccacctggtagttgtaaccttcacagcgttcacagtgccagcagcaagggacccctttcaccgttttcttcctctcccctggcttacacggcaggctgcagacagacgccgggtgagtatgttctctatgagcccactgcatgtcttccacctgtgggtataaaaaattaatgagccttccatttttcccccatttataatatcctaatcctagccacgggtttgtaatgaatcacagaatgctgacagtacaaatacagtttaccataataagagtctcgttttttttcccctgatattgactttatgaaagtgttaagtgactggatccaatatatcattcacctcatcaacttgatgagtgtcattagtttccatttacctcctcattgctgaccaatgtgacatctggagagagatttattggtcaaaacagttttaaaactaaaaaaaataaaatacaaaaaaataagaagaagccccgtagaaagatgctttagagttaatcacaaatataaatgccagaatccctgaaacactgggctaggatataaacatatataaaagatgatccatgtctttctaccatacttagggaaattcaaatcacactgcatcaattttgaaaggaaatggcaaaatgagttaatctctgactttcctcatgtgttcatggagataactatattaatgtgttttgcccctgtttaggcttgaaatatcctttttttcttcagtcttgcatttccatgttgtgcaaaacaccatgctgaatgagataacttgatggtaatgttttttttactgaacgaaagtggccctatggtgatttaaagcagggaaattagtacaaatgagattttccccactttgcttagtatcgcttcagggccttaaaatccaaccttatgctttcaggttaaatcatagaataactctatcgagatacaagcagttcgtgaaagagacagcaccaatcattgatctcttacctttaatttgcttttcttattagacacagtaattttagcagaatgctaataggacaaaactgaaaattacagatgacgggagaccacttactatgaaaagcagctactataaaaggtaagctctatgaagtgagtaattttttcactggtgtgaacaaacagtgactggcatacaatttgccctcgatacatatttgttgaattcatgagggagaaaggatgggaaaggcactagagcagagccctgaggaataaggagacagcttggaagtactgggatatggaaatagagggtactcaagaggcacagcaaagggagatgaaggaatgtttcagaaaaaaagaacaacttattttcataagttcgcctttactaataatccaaaagaattactatactgtgtggtagtcagtctccaccgtggcccccaataacctcacttctgaaaattgatgtactcctgtggcccgctgccactttgaatagggctagtctgtgtaaacaatagtatattccagaaatgatgatacgtctcttctgaggccaggtcataaaaggcattttggtttcggccttgctctctgctggataattcactcgagtggaagcactccagtgtcactgatgcaggacagacgagccccaaagtgggaccaagcctgccagaattcttggctccacccaggaaagaattcaagggcaagctgatggtggttagaagaaaacagctttattgaagcagcaattatagctccatgactgttcctgcagagcaggagcagcaggcagagagcagcagctcagggcagttctgcaattgtgtttatacctactttcaattgcatgcagagtaaggggtggattatgcagaaatttctaggaaaaaggtaataactactaggttgcaggtcgctgccatggaaagaggctgtaactgccatggcaatggtgggcatgtcttacgggaagctgcttctgtcctgtccctgttttagctagtcctcagtttggtccagtgtccaagtcccacctccagagccaagtccctcctacctcatcatgaaaactctcagcagccctgtggaaagaatggaggcctcctgtccacaacaagcaccaacttcccatgcgtgtgaaggagccacctagaaagtcatcatctggctccagtcaagccttcaggtgacatctgaatgacatcttgaatacaaactcatgagagaccctgagccaggaaaacacagctaacctgttcctgaatttctgatttacggaaatgttgtgagatgatgtttattgttttaaactgctacattttggagttatttgttctgcaacaacagaaaatgaatgcagctcaaattaaacttagctacttggtggccactttcattttaatatcagtgtagttatctatccagaaggcacacccagggacagcgactgtatacttccaaagcagcccgaagtatgtagctttagcaatattccttcatcattcttatggtggcttactctttgacaatcaggtgactgaaatcgttctcatgaacaattacttaagaatgctttcctttcttgaatctagggtgaatggttgaggccagagaactgtagtcttcaagctctatccttttagagggctgtcgaatctcctcagagtagagactttgtgtctttaatttcagatatcctcccttgagaaagtagatgctacttcatctgtcatatgtcatcagggcatttgagactattagatctatcctgtcagctcactacaaaggaaatgtaatctattataaccctctagtttcttattgggttttaatgacttaaaaatattatattttatttacttataagattacaggaagaaagaaataaaggtaaatggaagcacacagtgatttctttcaaaaatactgagaaaaaaaatgaaatgctccactgggtgcttcaggaattaactttacaacctaagggactcataagataagaaaatacatttttgaaggttatatttaaaagctaattactatagaaacaaaattgcattttgttgggaacttccatagatttacagtgttcctgctcaaaaaacacaaaacaaaacaaaacaaaacaaaaaatgaaaaacagcaaaaaaaaattggaaacattaaacttcaagaaaccttaaaggtcagtttctctaaccacatgtcggaagctttaattctcaatatgctttacttctcagaacaacataagatgtgttaaaaaagaaatgtacctatactcggtaggtttcattacataggataactatttatcattataagctaaatgtgaaattttccttgacaattttttaatgttttgaaccaatgaaaaaacgtttttcataaattaaaaataaagttgtaagaatatgaaaaataccagttttttaacagctatgaattttctttaagtaaaaaaataagcaatatgtgtaacatttttattataaaggagactgtaatgttatagtttacagattatgttttaataaatatgttaaatatgcatgctaaatatgcatgacttaattttcatcaaggaatctttgttaaactatgctgtgaattgatttcatagctaaagtctgaaaaccaactagtatccacttcaagaaaggacaaataacaaatgcttgaacaaggatcttacaaatacagtaatatttgagactaacaacttattttacatagttgctaaatgatgattaaaaccaacactatttggaccggacgtggtggctcaagcttgtaatcctagcactttgggaggccaaggcaggcggatcacaaggtcaggagatcgagaccatcctggccaacacggtaaaaccctgtctcttctaaaaatacaaaaaaattagccgggcatggtggcaggtgcctgtagtcctagctacttgggaggctgaggcaggagaatgctgtgaacccgggaggcggagcttgcagtaagccgagatcacgccaccgcactccagcctgggtgacagagcgagactccgtcaaaaaaaacaaacaaacaaacaaacaaaaaaaacactatttgaaagtgaaaactgcctaatttccacaactgttacaaagcataaacaaagattattcaaccctgtttattgctatattaacaaattataccatctttcattataagtataaagagatgccttaaccatatatttttaaaatttgccttcctcacctttggtattattctgttattaagacgttttcagtctgaaatacatggtataacaaatggaggatagttatatagatagatcttccagggacaaaaaaatggcccattcttatcttgacaatgtttaccaatagtgatttattcaataggtttcaatccagtgcatttcagaaaatgtaagtcatcagctggtttctgctgtcaaatcctgttattattgcagacaagtacacaaagaatcgtgaaaccaaagtttccgggtgagtgtgcttacatttttaaattttcaatcttttcagaaaagtcaactaggagtactgttttataaactctttaaaaagaatataatttttagagaataattttcttctgtatagttttaataactcctgaagaaaggattacaagaatgattacaagaatgttgaacaagtaaaatccccattataattaataattttcagtcttcattacagaactctcaatctaatatctctaatacaatgtttttcctaaatatcaagtggtatttttttaatgtgcttaccatatacaggatgtgggaaaattttaaatacattgtttacagataactgatacttagtcataccattcttaacacatttcctcttgctctacatgtaataattttgttaattattattaattaataattattttgttgactagtttgacacctcgatattcaaaactcaatatttctgacttaagtaatggaagactgcatgtgcaattacttccagagacactaatgattatttttaaaccattactcattaaatttcatataaatgcatacaatctgcatgggtacttaaaattttaaactttagtgccatattttgcatatcacatgattcacacatgaatgagtacatgttgcacagttaatctgataacagaatataaaattatgtaattatatgcattatatgtgtctctctatatatatatttcttaatattctgcatttcctttgagtcatgtacagctttaagtgaccacaaagaaaacaatatttatctcttcttcaaagtggcccgtgtcctttgaaaaatctaatatgcttgagatgattcccaagctgaaatcctgtttttttgtgatgttccagatctatataacctttaaaagtgcgaagacttctcctattttaaagacaatttaaaataaaattaaggaaaaaatttcatttacattaacaccaaaaataaaatacttagtgataaacttagtaaaagaagcacatgacttatccaggaaaaactacaaaacatcattgaaaaaaagtgaaaaaaaaagtataaatagttgaaaagaaatcctgtgtttatgaatcagatgatttactattgctaagatagcaatatttcccacattgatctgcatacatattcaacacaatcccagtcaaaatctcagctggctccttcactgaaattgatcatctgatcctaaaatttatatggaaatataagggacccagaatagccaaaattttgaaagcaaagaataaagatggagtattcacatttcctcattttaaaacttattacaaagaatgtcataatcaagacaacatagtacaggcataataataaacaaattagtggcatagactagagagtccagaaataaacctcatacacatttataatataaacgtgtatgttcacgttatttttgacaagatacaaagaaaattcaataaagaattttttttttcaaaaaatgatgccaaaataactggatatccatatgcaaaataatgaagttatacacctacctcacactgtatataaaaattaactcaaaaaggatccaagacacaatgcaacaactaaaacttaaaaactcatagaagaaaacaggagtaaatctctgtgaccttgtgttaggcagtgttttttagacatgacaccaaaagcagaagcaacaacaacaaaaaaaataaattgcacttcatctatgttaaataattgtgtgggtcaagagacaccaccaagattgttagaagacaacccacaggataggcaaaaatatgttcaagtcattattatctctaataagggatttgtatccagaatatattttttaaaaactgttaaaattcaacagttaaaagaccaataatccaattacaaatgagccaataaattgaatagacatgtcccaaagaagatatacaaattgtcaatagtgcatgaaaatatacctaacattattagctatcagggaaatctaaatcaaaaccagtgcaccaactaggactattataataaaaaataaagacaatagcaagtgttgataaagatgtggatgaagacatttggaattctttgcattgctgtggcaatgtaaaatggtactgtagctttggaaaatttgacaattccttagaaagctaaacatagggttttgatatgacctagcaattccacttctaggtatataccaaagatagttaaaaacatatgttcccacaaaaatttgtgtataaatgttcataacaggattattcataataccccccaaaaccagaaacaacccaaatgaccagtaactgatgaaaggataaaaaatgtggtatatctatattacttagcaatcaaaaggaatagtgtattgacacctactacaaaatggatggaccttgaaaacattacactaagaaatgaaagcagctaatcacaaaatactaatattgcatgtttttattttatatataacatccagaataggcaaatccattgaattccaggagctagggggaaggaaatagagaatgaccactaaagggtatgggatttcttggatgatgatgaaaatgaactaaacttagatattggtgatggatgtgcaacactgtgaatatacgaagaaccactgaattgcatactttgaaagagatcatttttggcgtgtaagttatctctataaagctgttatttaaaaaatgtggagactatttaagtagatattttcaagtggttttaagactcagtcctataatgctgtacaaaaacatagtccatgcccattttgtttaaggcacaaagttcaatgtgagaattcaacaagaccaagacatggttcttgccctccagacacaacgtagatggggagagaaaaaaacaaaggccaatcacagctcacagtgagtctcccttacagaaggatgaggaaatggaactgctagaggagcacacagcaggaccacgaagcccagggttcatggatgtgcagacagcagtctggaggttgcacaggagacaaggcacagaagaggagctcaacagcacatcaggcaaaaaacaaaattactaatatatagtttcaaaaagccttgacaaactggaggaactaaaagtattaagaatagcaggaaggtagataaaagcagtggatggagtagcaagaaacaggccaggaaagagggtacatgtgagatcatgaagggccttgtgagccattgagaggagtttggatgccatcctgaaggtagttgggatcttccatagggatatagccaggataaagatgatgagtcacgttttagaatctctggactgtagcgtagaaagaagactgcaggagtccaagactagagagaagtcaatcacgctgaggctgttgcggaattccagatgaaagatgatgacaggaatctgaggaatggcaatggccatgggaaaaatgtgagtattctatcagctgcttcttcaaggaccatctaaatttgttagatacagattatcaggtacaaaggtacatacaagaaagattcctggagctaagagctacttgagatcgtagcattctaatcactaaatacttcgttagtgctaaggaattctgttatgggttgaattgtgtacctcccaaaattcatatgttgaagtcttatccctcaatatctcagaatgtgactgtatttggagacagaatctttaaagaggtaattaaagtaaaataagattactagggtgggacattatccaatataactgatgtttttacaagaagacagaattaggacacaggcatgaatagagggaaggccatggaatggcacaaggagaaaaccatctaaaagtcaaggagagaggcctcagagaaaaacaactatgccaacatcttggacttctggcctccagaactatgagaaaataaatttctgttatttaagccacccagtctgtggtactttgttatggcaaccctagaaaactaatttaggctctaaagggtcggcatttgtattactaaagcatagtcaaaagatacctcatttgtcagctaataaacgtggatttttactagggactgtacatacagaaaggaataaaacagtttcttctttcatagaatcacagtccagggaacagaaagtcaattaatcagtaatgattataaaaattacaagtgatgttaaagagtcatgcaaaggatactaggggaacatagagctggggcacttcagcatcagcacaggggtaaaaagtttctcaggggaggtgagactgccttgaaagataaaatggaactggagaagacaaagaaaggcatttcaggttggatgaatcctataagcaaatgtacactgtaatcactgtaagcaatatggcatgattagaacatggtgtgtatcaatacaagacagtcagtgaccatataacgaagggctttgtaagcagcatctagtttccagactttattctttaaagctgtggtgagtaattaaaggacttttaggcaaatatatgacatgatagtattattttttaattttagagaaatcactgtggtgacagatcagagggaggatggcagagaagcaagaatatgaattagagaaatattgccataatgtcaggcaaagcaagactttgtgaattatgtctaagtggtggtgatgaagaagataggatagatttgagatacagtaaagacaacagagatcatggtagagtaagggcaaaagatgaatgaaaagatgggatctagttttctgatttgacatccatccttagtgtttcacttctttccactgcatacataaatccaataaaccagcctacatggacatctatgcatgatcttgtccctgtctaactcccaggcaatgcgcaaccatcatttagcaatcctccttagtccttttagtgttcttccatggacttttacagtacatgattatgtatttgtttgattttatttttattttaaaaagtgggctttaaattttaggttatattcctaagaatcacttaagggtttacttaaaatgcatatttctcgttcttagagattacaactcataggtttgagaaagaaccctatgttggcatgtttaaaagaatccctccttcctctagtgattctgacacatgcaagtaatgaactgtactttgctaagccactaattaaaagtttattttcctaagaagagtagaagtcaggtctgattttccaccactgtgttccagatcctaacatcatgactaagacctaataggcatcaataactatttttgaatgaatgaagaaagactaaaatgccatgtgaataggtagtggtatccttcactgaaaaggggcgtacaagggaatgactggttttgaaaggccgatcatgacttagttcatgggtttgtgagccaagtgtgcctagaggtaaagatttcaaaggcacaggtatatgcaaggcaattgaggtcatgaatatttatgagagagctctctcccacagacatgatgaaaaatacaaagagaagatggcacaaatggatcactggaaagagtcaatttaagaagcacactcaggaagaccagtggaaaacgatgtaaaaacatgatcaaatggtaactagggaagaatctagtccacagtgcaagaggccaatcaaatagttaatttcaggaatgatgaagtagttggcaatgtatgaagacagtaatatttcataaccataggatttgaaaatttaggggccttggttaccttcatgagataagttttctgtgaagtctctcttatctactttgctccagacaggtagatatgttcctcctctgtatttcatcctcctccaagacatatttttattgtaacactttggcattatatggtgattatctgttgatgtgtttatttccccaccagactgacagcacattaatctcaaggaccacccaacccctatataagacttaggacttagtaggagttccatgtttgataaatatataacttgattaataaatagaacatgtgataaactagtctatgactagaaatgtataacttctctctatttagtgttttgagtaggcctggctttaggcagtaggcagatgggagtactaaacttatcgtttcctaaatctgtgtggtctctagattatgtcatccgcagcttcagagaagctaattttgaggagactaagtaccctgaccgcatacctcacaaggatgtttggaagacctaacaaattaatattttgaaagtttatttattattattattattattttgagacagagtctcactctgttgcccaggctggaatgaggtgacacgatctcagctcactgcaacctccgcctcccgggttcagacgattctcctgcctcagcctcccgagtagctgggactaaggtgcacgccaccacgccctgctaatttttgtatttttagtagagacggggtttcaccatattggtcaggctggtctcaaactcctgacctcatgatccgcccgcctcggcctcccaaagtgctgggattacagacatgagccaccgcacctggccttcaaagtattttatgaacagatgatgtggaagacagaaactctgcaggttcctttattaggactgagaggagcactggagaaaagatatccacgctctacccatcattaaatacagctggtctgtctaaaaattatatcagaagcaaaaagtcaaaagccaccatctctggatttcatccagatctgctattacttgtttttatcgtccgacaatctcagctcttaataatggtttctgatatttgttacatgaagtgccccatctttcactcaagttctatgcagaaaaagccacgtaaaagagtgccttctccccttaactctgagtccacggatggtggcatcttgagtgtgcatgttggcgtatgtattgtggatgcggtggtttaagggaagggtgcaggaagtcagacctgtaatattttgggtaaatgggatgtaataaccttattataaggcttcaccccaacacagtgcatatgcaaatatgcagggcacatatggtatttgttgcaagactattgaagtagaataatcttttcccttaaattttaacttatgataattctaatttggatatcacagagtgaccatttttaattgaagccattgagttatgtttttgttactatgttcatgtttatattatagatggccaaatttagagtttcaaataatttccttcaaaaaaatattttcaggtaggattacttcatctgaatgtttaccataaaaattactattttagctattttaatgtgatatttttgtgaatagtatttaaaagtactatagtattcatgtttttaaacttaaaagtcagctaaattttaaaatatgacttaaatgttatacataaataattacattgaatctatatggtcagtactttataataactaaatctaattaaattgatccttcattgctaataagtagaagttaataatactaaaatgagctcagaactagtactccctaatggcaattctgcaaattttcagaatatttcatttaattatgtacatttcttttttccatgtactaatttgattcctgcatgcagaaactaagataattcattttaaattattctgtgatattttgaacaacataggagatgttctgttcagtgcaaaacacttacccatttcagtgttagcccatatgactcaacgttcatttaatgcaatctatagagggttacaggaacacgtgtcttcagaatgttaaagatagccaaagaggtttggaatgaatattttcagtggcaagctattttatattagtaaacaaacaaaacataaagatgataataatagtaataataataacatttattgaggacatactatgtgtcagattgttctaatcacttaacatttagtgcttataacaaccccgtgagttaagtattttcctcatattttgtttaaagaaatacagaacagtagttgatatgcatcacatcacacagctattaaatgatgtccaatagattcgagtccagggtgactactgaatcacattttactgtctctcctcaatgctcccggggcagtgcatgaccaataataggtagccaaaatgttttgaaaaccaactctattaggaacatcccatccagaaaagggagcagaggagataggagacagtgaagtcagcataaggcatttaaaataatcgtccaagtgaagggaatatggccctagtcaggggaggccttagacaggagcaggggatgaatgagtcaggccaggcaatcagttcactgagaatagaaaagaaagggtaagtttaaaacagatttagaaagaagcagcaaaataatttggtagtaatttatttaaaggattggttctcacaggacacttagaataaggtaaatgtttgtttcatggtttgagaatgctacatcctagtgattccttttccctcataatcattacagtaagatactctctccagctaggattattctagtcattacattccatatgaggcatcataatcattttggtatgaatttagcatgttttagtcaaagtaaccctaaatggaactcttgctacaaagtaaatcaaggggttttttggatgcaaggcacctggcacagttggtactgggataccatcgtgaaattagttttaccaagtaaaaatctgaatcctgagttttgagttttccagttcttttttcccacctaggtcatggaatactattagccagccttacacaattaacaagggatctgaagattcatctttgggaatttttagatttagcaacataaaagatcaaaatgttatgatattaggtgatttttcaatgaagttctctgtcaacagactcatccaagtgcaaagagttttaaatcagcgttatagtgcacccttacatataaatggaagtccaaagatcactgggcatttaaagaaattttctgccatgcaaaatcaacattaaacaaatagagagaaaagtaatttggggaaaatagtctttttccccaatgcatggagagggaggcatctaaagttattataactccagagatttttttaaaaatagatgcatgaaataggaaatttctattaaaaaattcagaaagcataaaagaataaattaactataattattatgtttaataatatatctgatacattatcattcattattattcataataaattataattctggataataattataattgattataatctcagaaatgaagactcaatagaataatttgaaggtaaagctgagataatctcccagaaatttaagcaaaaagacatacagaaataaatgaagcaaaaaagttaattaaagataatttcagcatgcccaataattataagaagaattcatggaaaagcaaatagggagttggaatcattaaacaaaaatatcaaaatttttccagaatgaaagtatatgaaattctagattaaaacattctactgagattccagcacaacatataaaaatatacaaacattagtttatatcttgcagaaatgtcagaatcccgagaacaaatagatcataaaagattctggagaacgaaagaaacaaaatgaaaaaaaaaacctagttgatgtgctgaacctaaataagaaaataagtgaaggaagagggggagttggctacaggaaataggagatacgccacaaaaaagatgtgaatccaccacaaaaagatgcgaagaatatcctcagaacggcagtcaagggagatcctaggatgcaagctgtgctgtccacctagacaggtaccagtctaaattggagaagccggagagactctctaagaacatgaactttaacatcacacactggggcctgtcgtggggtggagggatgaggagggatagcattaggagaaatgcctaatgtagatggcgagttgatgggtgaagcaaaccaacatggcacatgtatacatatgtaacaaacctgcacattgtgcacatgtaacctagaacttaaagtataataataaaaaaaaaaaggacataaactggttaactatccaaatatcctctggtagaaagtttgggagaaatcgtccttaagtatataaaaaacaaactttaattatataaaaaccaaaacagaaacactaagtatttaaacagataactttaaaaattacggttactagctataaggacaacaaaaaaaatttccaagaaaataaaagtaatcaaagcataacaggtgacacagttatgagcagcatctatatgcccatgataatgtaaggtatggtgtagctacattgggaagatgataggagaggaagtgtaaataacagggttaaaatagatataaaggagataattcctcatttcctatggtgagaagtcaatataaacaaacatagcagaaaagtaagaagtagaaagtgtgagcaagttattcaggagagaagagtaaaacacatcaaggacccattaatttaaaaatttgactgtagttgactttgggcatctgaaactaggggcagaagtactaggggctgccatcttcgaaacgagcttagtgggaccaatggactttcaaaatcataagtataaataaatttaataagcattttaaagaagagcaagttgaaatgaaaagttaagaaacctaactgaaaaggaagacagataagaaacaaagtagggagagctaaaagtgaaatgtcaaatttaaatccacatagaaaacaatgaagtacagggtagagtttgtataaaatcaaatcattaatgtagaaaccacataaagcttcttcctcaaaccactgaagaaaacaatacagacatggaaaatataatggaaaatatggaagaaaagagaagacagaggctattgagagaattatagatgattaacatttctgatggggaaatccaaacagctgttatagaaaaataaaatcaaagatatgaggaaagattttttttttctgaagaaacatctgtgcaaatagattgaaagtcaaaatcaatggaaagaactgacaaaacataagattattttggtggggaattacaagttaaagaaaagcccaataaaattcaagcaaggacccccacccctgacaaaatcatctagtaaaaatcttttaaaaagatagtctcaagttttgatgcagccttctcattatcttttacttctaaatggtcctgattgcacttttgacgtgacttactgaaaagttattatttaatttctaaatggttgtagtttatgtttatacatatatttctagttattctgccacaatacaaatgcagaataaaaagaagcgtaatactttttaggagaaactcttatgatcacataattaataatatgacaaggtttattttacatttgaggactagagagaaactctcagatatacaatcattcagaaaatataacatttaaagacactttactgggaaaaattacctgaatatgtaatgcaataaactacaaattcaaacttgagaagtccaataaaggagccataatgtaaaagaaatgactgtgattgctgaaacatgtgagaaacctacaaaaatgtgagtaaagttcattataaaacaggattacattatcaacaatagttatgaaggatatataatgtaaatgtaagaatataataagaataatctagatccaagcacccaggtctcaatgaaaatataacttgcatgttgttttatgggcaacaaagcaaacagcaataaaaaaaaaactgttagaaaaatgacaaattgacaagttccagagtagagtgaaaatgttttttgtttttttgtttttttgtttttttttccgagacggtctccctctgtccccaggctggagtgcagtggagtgatctcggttcactgcaacctctgcctcccgggttcaagcaattctcctgcctcagtcccccgagcaactgggactacaggcacacgccaccacgcctggctaatttttgtatttttagtagagatgggtctcaccatgttggccaggatggtctcaatctcttgacctcatgatccacccgcctcagcctcccaaagtgctgggattacaggcataagccaccgcacccggccgaaaaagtatttttaaaaatgaatcataaatttcttaatagattaaaagtttttttaaagaaaactttgtttaggccacattttctgataactttgtagaaaaactagaaataaataaaattataaacatataatgcaaccacttagaaattaaacaataactctttccaattagtcaggtcaaaagtgcaattaagaccatttagaaataaaagataatgagaaagctgcatcaaaactcaagtgttacacacaaatctgtacttataacaaaaatttgtattattcaatgttttattttaaaatagaaaataataaaaataaatgaacttagtattaattatagagggtaggcacaaatgatacataatactataagaagtagagggaataattaataataaaagacttagaaacagaataatggtgaattaattaaaaagaaaatccaagaacagtttctatggaatagccagttgaaattacagatacctggcaagtctaattgagggagaaaaaaaagagaggaaaaaactcaaatacacagcctggactctgacatacagatgtaattataaatacaaaaaaggaaaataataaaataccatatttattaaataaaataataatataacataatataatattgctgtattgctttttaaacatccctggtctcccatgccttgaaaataccatctgtgacatagttgtattctttaactgctgcattctttttctttcttcaccatacctttagaagcaatgttttatgtcccctgtaccatcttccccatgcaaaatagcttttacaatctattcattttaaaggctcacgagaaaggtatcagcattcaaatctaatggcctcttttctatctacctcttttttgaagccctccttacttgagatctgaacactatcactattatttctctcttgtcatgaatgctggttcactattcttgttgatagttcccctatgactgcccatggttttatccttaatattttttgacttgtctttgtcagaggtcccaactattccttggccttaaacatcattgctgtacttcaatcctgatcttgttacttatgaactagaacatttccaatgtcctgctgaccaagcgctgtgagatagaactaaagtatgagacataaagctcatcatgtctacaaatggattcaccatttggcctaaacattttcttcttgattctccaatttttttcagctcagttttatgccctgtattggcaaccatacgtaatttttttttttatccatccatggttttttctggccctgctggaaccatttatcataatgccattccttgactaccacaaagggaacgtagctagctttctttctcttctaatccatcttgcacatagaaatcggggacagataaaaatactcttaacattctctttgtttacttgtttacttctctaatgaaaatttacaacttctcacaggttacaaagcaaaataaacattagtaacctgactttatgccctcaaacactctttcccaatctaccttttgagcatcacataaaatgcccatatgaaaattatatgcttcactcaatttttgtattcatcttcttttacatgtctctatttactcttgttttgcctctgctttgaagaccattcttccattcctagctgtcaacacactactatttcttcaagaattatttcaaatgcctcgtccgttaatttgtccccgatcacttgaatcataagtggtccatccctcctctcacatcatgcaattttgttggtatcatttgtatgataatttcattatgctcctatattataatgaactcctctattagttttaactattctttaagtcaggaaccatgcctaatatgtaccttaaaaatgccttatactttggctccatattattttacttaagctagcatttgcacaaaaaaggtgctaataatatttttaatgtatgtacaatcttgagataatataatccaactttcaatttttgtaagtattaggaaataatagcataaacataataaagcaaatatgtgctatcattctttgggcacttttgagaattatacaatacaagctaatactccaaaatccatttctatatactttctcttcattgtacaaactttccaggattgaatatccagttaacctaactctgaaatataaaatagaatgtataatggcaaaattcctaagtatttactatgtgttatttgttggccaaagcattttagctaattacatttatttaaaatggttatacatgttattggtctggtttatctttaaataggaaaatctatcttttgtcattataaatttccagtttccaatgataaaatcattctacataacttgaaagccatattgacaaggcactttgaaaattttcatctttaaataaacattaggttttcaaattaggtcaggatttaagtctcttatttataacttactaaatgtatttccctgagcctcaatttccccatctgagaaaataaatcagtaaaaccttacttcaaatgatttttcagtattgaatggatgaatccatataaagaacctagaacagggtaggcataatagtcatagttagcaataatcatcatcatcaacaaccaccaccaatccctcctcctgttcactcacctacttattctgcctaacaccatagctgctgctattcttcttcctaaaataaatgtgatgtatcccctacttcctgcttaaattggatagagattctattttctatttcccattttaacatctctataataaacaacagataaattatttttaaaaaatcccaaatgtactcttctttgtataaaatttattccagaaaatgtacagctctggtgtaccattgctataatttcattaccatgtaactgatacatttcatgtgacatattctgttgggttattttaattaaataagcacaatgttgaagctctaatttttttcacttttaaaatggaatgaaatattaaaatgccagctttgtgaccttgtcttctccaaaacaatattttgtttgaccaaaagtagttctgaaaggtgaattcgtcacatgaatgaataaaactcaatgtaatactctgcttggggtggattataacctgtctccgtctcccaatgcataacatgaaccctctagtacatctaatacatctagttttgaatatattaagaatatcacatggtagtaatctgaacttagactcagatattgaatgcttagaggctaacctaatacccaattgtattgattacaatacaaaatatggtttcactgcactcatctcaagagatttgttaggtgatgatgtttgtaaaaatggatatacagctggaaagcaattcaatgatagcttatcaatcaaaatataagcgtacacttaaacataagaggaaagctgaaggcattttggatttccagtggcagggcagttagtttcattactcaccaaattgcaaaagatacaaaatgggatttgctcccaatgttcatggtactcttttgtactttattttatttttcattttcaatgcctatcttctgcaagtacatatttaataatgtatcattgtttcatatttggaaaaatatattccaatcttttctcaaagaaatgaaatttaaaatgaattaagtgcttcctaaaattgtttaagctattagtttcagtgtaaaggaacagaaaatggcacatctttaattactaaatgtgtaaatacagacataagatttttttaaattgtagataaaaataaaaacaaaaagataagttttagagaaaccaactcaataataaatcaagcaaaagggtaataagggaggccaggtgcagtggctcatgcctgtaatcccagcactttgggaggctgaggtgggcagacagcttgagctaagaagtttgagaccagccaagataacatagcaagacccaatttctacaaataataataataataataataataattagcctgatgtggtagcacatgcctgtagttccagctactcaggaagctgaggtggaaggattgcttgagcccaggaggttgaggctgcagtgagttatgatcgtgccactgcactccagcctgagtgacagaatgaaaccctatttcaaaaaaactaaaattaaaaagagtcacaaggaagaaaagaacaaaaggcaaagcacatggtatataacaaaaactagaaatagtctgcttagaggaagaaatgagatagaaagtatagttaaacaaaattatttttataaaagttttcagaaatagtttttcttaaattttctgtttttgtttccagtctttctttttattgtcatatatgttatttttagggcactaaattacataactttgtttctaatatattactaacatcatatggttaagatttatcattcttaaagaacttcctgttttgtttggcaaataataggataaatgtaagaagaaaagagtaagttggaatttgagattccaatttgtggcacagaaattcctctttttagaatggaaatgatggatgtgttgcctataactcaaaatgaaaatgtgagagcagtaagaataaattatgatgttaaaactcaaagaaacacttaaaaacaaaacaaagaacataaataaaattatttagaacagaaacaccaatagaacaaaacagacgcaatttatctttttgatagattcatagaaagcttaatctggtgcatgtgaataggggagagtaaggtacaatttatagtcgatcccatgacacggtactaagttaggttgcagagtgctcatagctggatgtgaagaagcaaactacgtaaatgatgaaaggagattcctattaattgctcaggccaagagactatcttcatagcctgggctaaggggtaggcagaataaccaacagtgtatggttaaatttatcttgcgtcactaccagacaatgctaagaacagctataaactagaatccctgtcttgtcacacagaaatatgatccaaacataaatcagatccattaattattggaaatgaacaattaccacaaatacctgcatttactatatttgttatatttcatattcttattaatttgtccagttattgtttataattgttcttatatcaaattatttttaaagcaaaacaatttattacgagggtttctgctatttgacacttcagatcagtaaatgaagcacctactagcagtttgttactgttgttcaaactttatagctctgtttagctcagttttctattcagtgtttgtttacttgtacagatgcaaatgctcactttattcttcctaaaatatgtgtggaatacaaatgctctcagattgaatccctctttgaaccacacatttgaatattttctgcttaatatttgctaatgcccatgaaaagaaatttgattgactgtaaaaggacatatcaaggaaaactcatatctcagaatactaaaatgaagtacaatgactatctctacaaagcaccaaaaacatccagttgaaatgtgaacatattcccaactctgaaaaaccaaaagcagcttgagcactttcttacccttacttccccaaataataaattatcttggggttggatacatatagttgaagaattatccccttgtttaaagttacttgaatgagagacaaaatacttcgtatccatgaaatgaaataactcatgaaagcagctgcatgtttgaataatttcagttctcaaagtcagtcaagcctttaaaactagttattgttttgtgtttttcatattagtacctactattgtaaatcctcaaaccaaggctcagggatgacactactagagtgacaatggagaagcagttctcctctttaaaaaaaaaaaaaaaaaaaaaaaagtgggccaggtgtggtagctcatgtctgcaatctcagcactttgggaggccgaggtgggtggatcacctgaggtcaggagttcaagaccagcctggccaacatggtgaaaccccgtctctactaaaaatacaaaaattagccaggtgtggtggcagacgcctgtaatcacagctactcgggaggctgaggcaggagaattgcttgaacgcaggaggcagaggttgcagtgagctgagattgcaccactgcacttcagcctgggtgacagagcaagactccgtcttgaaaaaaagaaaaaaatgtgtccacaattttgattagaaaactttcctctttttcacgagagaacctccagtcttgtaaatgtcagtcatggttcagattatttattttaaaaagatgtaatcaaaagactccaaatgtatgtatttttgttccaaaaatgcattttgcctctaaagagaatgtcagttctattccattgtctttagtttctttccctaatcagatataaatgaaagacttattcattggtgtccattggtgtctttagttttatttgtaattcataaaactacttgaaagaaatatggatatactattaagtattgttttcaagtaaagggccaaggaacagcacaaagaagaaacagaaagaaaaagataagatagagccctattcttgctctgaaaaatgagctgcctgtggggaagctgctcccctaaagaagggatcagggatatcttcctgtgatattcactggaatactgtctcccaacagacactggcaagtgcagaagacctcacactgccttgctggcgattttctcctcaatagagtatatttaagaagaaaactttgaaatcttaaaagagagcaaaggcagcggtattagggtaagactggataatgctctggatccattaccataaggatagcaaataacaaagaaaagtaaaatgtatctgacagagacgggctcaggtgctcagttaccaccttggaatcactcttggtccatccttactgtctctgtacatttttctcgcacaccagcacagggcacttctttgctgcttctgtttccatcttgccaggatccatcttcacttttgtgacaatcttcctttcagttttagtaaaacaaccacaagtggcgatcgtaagaaatttctggaaattccccattgttgctgtacaacacttcctattataaaattcactgtgagtaaagaattaaaatatgaaattctagctaataccaatgtaatgagtagctctaaaaaagttttaatgttttcttagtaagatctttttattcattcattgtcatatcttattcatctttgcatgctcagaatttgggcaaactgtaaaaatagaaatatggcaacatatgtgtatgacaaagtacgtatatatgtatgtgtatattgacaaagtatgtgtatatgtatgtatattatatatatacactatatatatgtgcttgctaggcacatggtgaataccaaaaagtaatataaagatgtactttaagtttgttttaaactataaattataaaggaattctggtttcacaaaataataaatcagaagagaataatttttagaattaaaattaacataaattcatactaacatatggcatctgttactggatttgaagaattttcacagatcacatttataaggtacatttcaacaaatttataattcactgtcataaagcaacttgagtaagctcagggttaaaaaggtggaagggtaggatcaaaattctaggtagcatttatgatttgtggtaggttagcagagagttaagtacatgtaagtaccacagtgaagagcaaaaatggctaatagcttacaactgtgtaccaagtatagttcagagttctttttatgtatttctttattaatcttaaaacatccctattgatatcataattgtacaattgaagaaaattacacaaagtgagaaaatctaatttgccaagggccatgtgtatatacatgtatatatacacataaagtaagtggcaaagctgtcctcaatctaggtagcttaaccacaaagccaccctctcaacctctgtatgcctctgtatgctgtttccaggaccttccagatgccaaaatccatggattctgaagtcttttatataagatggtgtaatatttgcttataacctacatgcatcctactgtatacttgaaatcatctctaggttaattacaatgcctcatacaatgtaaattctacgaagatagtttttatactgcattttttagggaataatgatgagaaaaaaaagtctttacatgtttagcacagacacaaccattccttttttttctgaatattttcaacctgtggttgactgaatccacagatgtggaacctgcagataccaagggctgactgtacctaaatggcctgtacaaagagcaataagtcatcattcaatatcaaaagtggtaaggaatcaggaaaacaaagatacattgcaaagaccaaagtagtgaatctaaccaaagaccaggaatagtttaggaatcaggaattcaagaatcaagctaggtggagcaatagcagctacaattagtgaagagagagacgggtactgatgcaaagcaccctcacatgtgtttttccagagcaaatcatggcttataagtggtgtgagtaatgtgcatagggaaatgggctccagatggctggaaagtcagaacaagtttgatactgatcttgaaggaagtgtcagctactggtaatcttttgcttttttttttttttttttttaaggcagacctttgctctacggcccaggctggagtgcagtggtgcgatctcggctcactgcaacctccgcctcctgggttcaagtgattctcatgcctcagcctcattctcatcccagcctgtaatctaggagctgggattacaggcatgtaccaccacaccaggccaatttttgcatttttagtagagacagggtttcatcatgttactccgactggtctcaaactactgacctcaagtgatccacccacctcggcctctcaaagtgctgggattacaggcatacgccaccacactgagccagctactggtaattttgacactagttggtaagctgttagcgctctccaactttaacaaacagattcaaacctcgtctcaattactgttgtgctggataattcttgaatagatcacattgtcttgtgcaacagttccttctaaaacacctttgagatggcttaacaacttatactgggaaaaaagtggtggacagtgtgtttagaatcagaactaaaaaatgctcaattgattctgtaagtccttccacctgtaaatctgagtatgaattggaactttcaggaatccacctggtatgaatgtaaactattactttaaattggaactgaaaatttcaattgtaggctcgatgtaagaatagtgagtttactgcctttgaaactcacccatgtctccatttgcaactggatatattttctctttgaaattctcttcaatcactctccagtcctgaatagcagcatcagtaattgtgtcaacagacatgatcattttatgatctgagaaagctggactgacaaatgcatcgccacttgaaatctaacctaaagatagaaacctgcattgtagagcagaaggctaagctgtacttacataacagcagcaacacttacaacctgtgctgcctttgctttattttttaaaggcatgaccgattttctatttcagatgacagaatattaaaatgttgggcagtgatgttttcaaatccacataatttttagtctatatcagtgataatataagtcactgattttttaaccggaagtcaggttagcagcaagatttctaattataactcattgctaatatttcatatggcttataaaacctatgaataacattgatttatgtaatggaaactcagaaaagaatagagaaaattatataaaaattactgtattcttggatcagaaattctagaaagatgtttgtttatattttgagatttcaagcagcaggggggaatgcttttagtcagccttctattgttatctataaaagagtgaataaataaataaaaatctctgcatagagatgaaatgaaccagcaaaataccaaaggaaactaacaccacagataagatttactgatcaaaattcactgtttttgtgtaggaacacagcatggtaaataggccttatataataaatacattattttctataacagatttctccaagaagacccaaaatgctataaagcagcactgcaataattctataaatatcattttgaagtactagcattccaatttcaagaaataattaaacaattctgaagttgatgacatttaggaatgggataaggacagtattgctattcaatagaaatgaatcaaatgcatatttatcaagttggctaaataggaatgctaagaaaatatacacataaatgataatcctttaagtaatttcattattatagcagcccatgaaatcatgtgagctttttcaatcctctctttaatttgaacttattgtaaacatttgacgttcaatactagaaatcagatcttttatctaagacttgattagtcagctttacttccttgtgacagacacactacatggtctactaatcctatcagctgtccacacattgaaatatatattcctgctcaaatctttatttcactcaggttaaccataattgccattattggcaccttttgtcttgtacttcctcagaaaaaacagctacgaaagtagtaaaataggccaggcgcagtggctcacacctgtagtcccagcactttgggaggccaaggtgggcggatcacgaggtcaggagtttgagaccagcctggccaatatggtgaaaccgcatctccactaaaaatataaaaattagccgggcgtggtggctcgtgcctgtggtcctagctacttaggaggctgaggcagaagaattgcttgaacccagggcggaggttgcagtgagtcaagatcatgccaccacactccagcctgggcaacagagtgagactctgtttcaaaaaaaaaaggtagtaaaataaaaaccaatccaggatgctataccatattattaccaaaacaataacacaatggtctgatcaacagcagcagctatagattctccctcatttaaacttgaattatcttttattttatttatttttttattatttatttatttaattattattatactttaagttttagggtacatgtgcacaacgtgcaggtttgttacatatgtatacatgtgccatgttggtgtgctgcacccattaactggtcatttagcattaggtatatctcctaatgttatccctcccccctccccccaccccacaacagtccccagtgtgtgatgttccccttcctgtgtccatgtgttctcattgttcaattcccacctatgagtgagaacatgcggtgtttggtttttttgtccttgcgatagttcgctgagaatgagttcatgtcctttgtagagacatggatgaaactggaaaccattttatttatttaaaaattatatttattcatttctttcattttaagatgggaatgtgaatatagggcattttcttttaagattaataaataacatctaattgacacagtcttagaaaacattattcccctataccctgatatctgaaaatataattcagagggtgaatataaaaaattagacatgataaaaccataaactgctaagctggatgggtcattaaaaagagtgaactaaagtggagagagataaagtgtcttgctgtccaaagctttatgtaggagtatttggggaaaacactagataaagataaatcacaaaagatttacttgcatcaaaggcatcaccaaaaccttgtaattttctgtgataataggaatgtgtacactcccagtttatttcaaactgtttggtatgggtaacagaatggctggttggcttcccagttagtttttgagtcttaattaacaagggagtcctgggatcaggaatgtctattatattgaggttcaaagaaatgcaatactaagtgtttattgttgaagaaatgctcagttaatgtaaattaaataagaagtttcaatgtggaatataatctaagaatctaaatttaaacatgaaattcaggtacaatttattttaaaaataagcgaaggttgcccggcgtggtggctcacgcctgtaatcccagcactttgggaggccaaagggggcagatcacctgaggttgggagttcgagaccagcctgaccaacatggagaaaccctgttgctactgaaacatacaaaaaagttagccggtgtggtggcatatgcctgtaatcccagctacttgggaggctgaggcaggagaaccgcttgaacccaggaggcagatattgcggtgagccgagaccataccactgcactccagcctgggcaacaagagcaaaactccatctcaaataaataaataagcaaaggttttaaataaacaagctctaaatgtcaaaaagatgacccaaagatttactaaagaaatatatggttaactaattattataacaaatgtatccaagctgtttccgtactgcccattgtacaatatgtggatatgatgtttgaaagcttagaagcctgttataatgaacgtagtaatcgcatgccccttagcacttacgtgtgcttcctcatgttacactgcacttaggcatctggccttgtataatacacaggcataacattctacccctcggtgatttacggcatcaacagtaattttaaattcttgatattttgaaacattcttcttaagttctcttttataatatcaaaacttctacttgccctgtggtttttttttaaaaaaaaaacatatttaatcaaaaatattcattatttctcatgtcaacagtgcaaatactaagaaattgtagtgtaacagaatgttgagtaggatttttcctttacctggaaatccaggtaaatcctaaagctgaaaggtctgggaagagcttcccaaaaactacctttactttacattctaagaggagtcagagagccatcctgaaggccaaccaagacatgccagaggcagccctacttgagcaagttcccatccactcttcctcttaaatctcattttttagggagaaaactgagagggaagggctcaagggcatcaagctgtggcttgtcagcctctgggaaagagccatgtttaggggagtggctttggctctttccctcaaaaggacagttctccaactgaaccacttgtggagactgctggtagctgcataaaaagatatcctaggtggatatttgctgaccaacaaaacctacaggtatacttggggctaccacaacagagaaggatggtaagatagtttattttagaacttcctgatgcatgaaatttattgatttctcacatgtgtgaaagtgtacattaacagagaaagtgcttatcgctagaaatttctaaaggctgcagaatttctggagaactctaaaccagtggtataaaaattataatagagtttcatcaggtccaaggcaaaaagttagggtgatggttatggttatatttaggtctagtagatggctaccagaaccctttggagatgaggaagagaaattagcagtttgggtggtcccacctccatgtgaaaaagaaatgaaagtcagatgatgggcaggtgccctagtcttttctagcagccactgggcaatgagacatctttcctagcaaaagtgttttaattgggggttttgatcaatagcaagggccaagagatgataggcctgctgttttctgaagggctcctcatcaaagaagatgctagttgaagctgaactcaactcaaggaagcaaagcacactactgatttggaaaccacctgtcagccatggttaccagcatatggaaccagactgaaccagagtgaagtcaaagatatttccccattgcaactgatgccaatgaaataaaataaattataagagattgctaaaagcaattatattcagataaaccagataatctaaaagaaatggaaaaaaaacactagaaaaaacttaccaagactgaatcattaagaaatatgaagtctgaacatacctttaattagtgtggagattaaaccagtaataaaaaatgtccctacaaagaaaagtgcaggaccagatggcttaactgctgaattacaccaaatatttaaagatttaatgccaacccttctcaaactattccaaaaaaactgaagaggagagaacacttccaaactaattttttgaggccagcattaccctcataccaaagccaaatacaacaaaggaaaagaaagctaaaagccaatattcctgatgagtatagaagcaaaattctcaacaaaatacaagcaaatcaaatccaatagcacattaaaaggatcatacaccatggccaattgggatttatccctgagttgcaaggatggcaacatatgaaaatcaattaatcattaataaaggataaaaattccataatcatccaaatagaagcagaaaggcatttgatgaaattcaaccacaattccatataaaaactgacaagaaactaggactagaaggaaaatacctcaacataataaagaccacatatgaaaagcctacaggtaacatcacactcagtggtgaaaagttgaaagatcgggacaaaggcaaggatgcctactcttagcacttctattcaacgtggtaatggaagtcccagccagggcaattagacaagaaaagaaagtaaaaggtatccaaattggaaagaagcaaaattgtccctgtttgcagatgacatcattttatgtatagaaaactctaaagactcaattattaaaaaaacaaaacaaaacactgttagaacaaacaaattcaatagagttaaatgatacaaaatcaacataaaaatcaattgtattgctatgtattaatgacaaactatctgaaaaaattgggaaaacagtctcacttacaatagcatcacaaataataaaaatacctagaaataagcctaaggagatgaaagacttatatactgaaaattaaagaatattgatgaaagaaattaaagacacaaacaaatggaaagacatcctgtatttatggattagaaggcttaatattgtgaaaatgccagactactcaaagtgatctacagattctatgcaatccctatcaaaatcccaaagaaatttcatagaagtagaaaaaatcctaaaatttatattaaactataaaagaacccaaatagcaaagcaattttgagcaagaagaacacagcaggaggcatctcccttcctgatttcaaaatatattacaaagctacaaaaatcaaaatgataaggtactggtataaatacagacatataagccaatagaacagaatagagaccccagaaataaatctgtgaatatttggtcaaatgatcttcagtgaggatgccaagaatatacaatggggaaaggacagtcttttcaacaaatagtgttgggaaaactagatatccacatgcacaggaataaaactggcacttttattattgccatatgcaaaaatcaagtcaaaatggattaaagaactaaatgtaagacctgaaattataatattgctagaaaaaaataggagaaaatctccatgacattcatctaggcaatgatttgatgaatttgacatccaaagcattggcgaagaaaacaaaaataaacaagaggcactacatcaaccaaaaatcttctgcagagcaaagaaagcagtaaaatgacaatctatgaaatcagaaaacatacttgaaagtgatatatctgagaatgagttagttttcaaaattggtaagaaacttctacaactcaatagcaaaaaaactaacccaacttaaaatataggcagaatagttgaatacacatttatccaaagaagatctacaaatggacaatagctatgagaacaaatgctcaacattatttcctgatgatttgcataatcaggaaaatgcaaatcaaaatcacaatgaggtatcacctcacacctgtcagaatgactattatcaaaaaaacaaccaatgttggcaagcatatggagaaactggaacccttgcacactgttggtggaaatgaggaatggtgtagtcgctatggaatacagcatggaggttcctcaaaaggtaaaaatagaactaccccatgacccagcagtctcccttctgagtatttatccaaaagaattgaaatcagggtctcaaagagatattagtattcctatcttcaccacagtactgttcacaagagtcaagatgtggaaacaatctaaatgtttattggcagatgaacggaaaagaaaatgagatgcataaataccatgaaatattatttatcttttttaaagaggaaattccgcaatatgtgacaacataaacaaaccttaaggatattagctaaaggaaataagccagtaacagaaagacaaatactgcatgatctcactcctatgtggaatctaaagaagttggtctcatagaagttaagtttagaatggtggttaccacttatatgagtcgaatcatataataatcaaattcatagaatgagagtgggatggatgttgccagggaatgggggcaggaataaatgagaaattactcatcaacattttaaagtttcaattgagcaagatgaataagctctagagacctactggacaacattgtagctatagtcaacaataatgtattgtgcacttaaaaatttgttaaggggataaaaaatgatgagttcatgtcctttgtagggacatagatgaagctggaaaccatcattctcagcaaactatcacaaggacaaaaaaaccaaacaccgcattttctcactcataggtgggaattgaacaatgagaacacatggacacaggaaggggaacatcacacaccggggactgttgtggggtagggggaggggggagggatagcattaggagatatacctaatgtaaatgataagttaatgggtgcagcacacaaacatggcacatgcatacatatgtaacaaacctgcacgttgtgcacatgtaccctaaaacttaaataataaaaaatttgttaagagggtagatttcatgttaagtgtttttaattataatacaacagttttttaattgtgtatgcttttagtggtaaataaattagctctctggtgcaaaaaataaaataaaataaaaagatatttccccattactgataagcctccggttaggtaagaacttggtctcatgtataaatcctcattgctcccacccagctataaagagacaaaaataagatgttatatccagaaagagactatcaaccctggacccaccatcatccttgcccatgagtcctcattcatactttgattggacaaaataacatctctagtttacagtggaggatgtaaggggtaagcttcagagaggatatgaggattgctgtcctaaatgatggtgaattaattttaatagccaaaaattatcagaaagctatggaatctgcactcaactcttctacaggacagaaaaggaagaaataatatcttgtttatatctccaacaaattaaaattatttggtaaactagttaaaattataaaaagaaaagacatttgcctactgttttatattagttttagtgaggggctcaaagttggaaagaaaaacagaacagagataatgaggcaaagaaggaaggaagcttcaggagtgtgtatgtgcctcctctttacttagaccttcccaacatgaattcaatattctgtttaaagtgaacattcaagatatcaaacatatccatagttacgttaacagaaagaaaaatatatattccaaaactaaaatatttccacataagccattactttcatattttaaaactctattaacacaggtaattcggaactgatgtaagtctttaaaactaagttatttagggttacctgattagcatacaaaacatctgggtttctaggttacatttctccaagaaaactgcagagctcctccctctctctccctctgtctctcacctctgcagactattatttaaacttcatataattgggagttgagaagattttttaaatgactgactttgaagtaaatgattattcctaaatttatatgcagatcattaaactgataaaaagtactacaaaaatttatgttgtccttcattttcattataaatgaccacattaaagtttaaaaatattgatcaagctacaaaataaagggaatgattcttccataagattttgataatcttaaaattaaatcaaaacaaagggtgctgctagagcctatttggtgacttcagcattgtgacaattgtttgtagctctttaataagttggaaatcatttcaaagggatttgggatctagccaagatgaaacgtactgagcaactataaaatcactatcaaggttgatactactgcaaggaaaatcaaaaagaaaaaacaatcaggatacataatcctgaataaataaaccagagaagaacaatgcctttgtcaatcacctgctaaacagcagtgattcagccccatactctgaagacttttcaaaattccactctattatacttcttcaaattgttttctttccatttatgccccaaagtttagctgctccaatgaacacacaaaagatccacaactatctaacaagaaaaattttgtttctcctctcaaatcagtgggccatctaaagactgggtagtttcttactctagttttgttttgtattttacataatgtagtcacaagccaatgtttctctaatttgttccttaaaatgaagctggcaaaagtgccacataactattgtttgcacagaggtactttccaacctgggtatttaatgaccatgacaggctccatgtatccacatgtttgttcccccaagacatactgaacttcttcaaaaagaaacaaaaatgctgaaagtgaattttatttttaattatattctactacaggaagaaaacgacactttgtgtccacatcagagctgccagtcaaatactgacacaccagtaattctctagcagtgttagcacagagtcactaaaattggaatgaaaccacatggagaactcagggaggaagcgttctgtaggaactgttcatcagttttgctgtgacaatagaaggggccaagtggtttctctcagtaatgtgtggtaaagcgtgtcttttcccacatcctgccagcaatataaattatccaaaaatgcagtctcatccatttagaaagaaaatctactctattatcagctgcaaggtgttagaactctaagctgaatacagaaaggcaaattacaggcacctaagtcaatcctaggtctgccagtttttcacatctaaacaatatcattcttagacatcatcctttttaaattccagtccttaaaaatgcttggagttatcaacgagggcttgaagaacaacttatccccataagatgtaattttctttctccatagtcacctgaattgagtctattatttatccacatggatttcatgaccagaacattctgattttcactgtaactcttccctggctccagattacatcaagttttctaatttccttgattcttaaactaacttgatattttcttttgttgtctattgcctttttcttttccctagctacttccttctcatcttgtttattttcaatcaatactttgccctatgcccactctctatattacatattcatatgttctggccttctgtaatttcatttgtaatttcagttcacctgtacttccccactgggagacagtgtagaacagtgttggatgaaaaatccttgcataagtgagcatgaagtgggatatgggtcctagacatctgtcaggtaggatacttcttaaattataactttagggctcaaagcattaagccactccagctgcaatagcctacttcattgtatgaatataaaataaactagacattagaaattcaaaatatctcctgtactcctagacagcaatccacccactgacaagaagtctctaaagaagtttttataagtggtaacaatgaataattttgcactagtcccatcacccatttattggaaggttgaagacttattgaaaaacatcttcctttacctgtatgccactgacactaaattataaaactactaaaaatttcaggagcattctctggcattccccccattacccctacccataggaattaccatgacacttcccctggctactccagctcaggaaaaccagacttgggaaagagcaacaacacaatccaagactctttctgaaaataggtgtctagttgattcacatcttctttcataaataccccaaaaagttgagatccccaaaccttggcttttcagaacatatattcagaatgtcagcagaatgagttgtgatgatattcaaataccatttctgtgatgtttgtcactttttttctaaatctaattgtctgcataaccaacaggcaactaccctcttcataaatgaggcaacattgcatgaggtcactttcaaaccacactgacacagctggcctaggacctggctcatgacttgctgttcatcgctccagagcccttctcagtctaagtatgcaagagagaataaagtcattagagatcatgtaattatacaaaatgtaaaggaaatcattactaatacaagaaatttttaataaatatcagaaatataaagtagaagtccataggttgatagataaaaataagtagaaaattcacaaactgaaatatactgcaagacagcttcaattacaatctattttcccaaagggaaccccatggagacacagcacacagagataggaagtaatttagattttatgagatttaaatgagattaaatactgtactgaaaataaagagtctaactacagagccattgatgatctatatacaggacaaggatgggagacccatcccactcaactggcatttacccctgggcaagaaaccagagggctcttctttaagaaaatgaacaaaattctgggaatagtaagatttctagtgtgtgtgctggcccttcccataggaacaaatatcctctttgcctgccaacaagtatttcccactctcctttgatctgcatagagtctgaatccctgggctgccttccccttcagatcagaaatctagggcaaaaacaagtcaatcgtttttcatagcagcagaggagaccaattccaaatatacaggattttttttttttttttgagatggagtctcaccctgtcacccaggctggaatgcaatggcatgatctcggctcactgcaacctctgcctcctgggtaaaagtgatactcctgcctcagcctcccgagtagctgggattacagatgcatgccaccatgcctggttaattttttctatctttagtacagatggggtttcaccatgttgggccaggctggtctcgaactcctgacctcgtgatcctcctgcctcgacctcccaaagtgctgggattacaggcataagccaccacacctggccccaggaatgtcttaaaccatgtaccaccacatagcaggagaggacagaagataaaacgaaactctctggtcttggaagacactgaattattccaaagaaggaaaatgaacttttaaaagttataagtaatatagagactagagaggaaaatacaaccatacatacaaacataaaggataaaattgagaacatgtagaatgcataaagcaaaaagataaatatgagagacagtgttagcaagataaaggatcatcccacagagtattatttggttaagagaattccaaaaaataaagaccagagaagatttgtatggtataatatctataaaataatacaaagaaatattccaatgctgatagatagacatgaatgtctacatgacaacatccgatggctgctctgcacagggaatgctggaggatgccaagttacccctagtttcctacaaaggtatttgacttattattgacaatactaggtactaaaaataacaaagtaatacctttaaagttctgatggaaaattttctattattgtttccaaatccaacaaaactatcaattgaaatgtaagccagaataaagctatctataagacattttctgaggtaacttccttcctttgcacctatcctgggaatttcttttaggatgcactccaaacatgcagaagtaaactaagaaggaggaaaacctggaatccatgaaatgatattccatcccagaatggtagagaaaggagagaaagagggtagtttcatggtaaactaaaaagcaaccagcaaagctgaaaacaaggagacacagaggtacagaagtgacatcctaagggggttgaatgaagacccacaaagataatgaagacagagaaagacacagagagaatgcataaccacaaacggtgcaagaaaaactaaaagaatgatgattggaaacaacattaaaattttttaaatctaaatataaagcaagtaaaaatgcattagaacgttaagcgatagactgaatataagagaagacaattcaggtgaccttgatgccagcaacatcctcttttaaatggccccaggtttatggtgtcagatattttgaagtgggaaatggaatcttagtccagaacttaaataatgtttacacagtcatcataatgtaaatgtttgttttctcctattagagtcaacccaggaacaaagaaaaagaaaattttattattctcacaggatagaatgccagtgttcacaatgggatgatgtaaaagtgtggctcaaaacaaacaaacaaaaaataagttgtatatgtgagaagaaatagtagagcaaagtatatatattttagcattttttaatgaaacagggagtcaagatatatgtcaaaaagctgtaaccaaaaatagaggattaagtatacttttctggggccacaaaatttactagaagaaaaatcagaatctcaaaaatatacaaagcaagctttggggagggaagagggtataaaagacagcaaaagtaaacaaattcttacctttatttcattttatttattttttaattttttttttttgagacagagtctcactctatcactgagactagaattcagtggcattatctcggctcattgcaacgtccgcctcccgggttcaagtgattctccttcctcagcctctcaagtagcttggactacagggagtgtgccaccatgcctggctaatttttgaatttttagtagagacagggtttcaccatgttgctcaggctggtctcaaactcctgagagtcaggtgatccatccaccttggcttcccaaagtgctgggattacaggcatgagccaccatgcccatcctcaaattccaacctttcttatcacattctcagaaaataacctaatagatgaagaagttgaggtataatacttgtagttattaacaaaaatactgcaaacaattcaaaaaggttgcctctctaaggaggtccaaaggtctggagaagtgaaatcagatattcttgcttttgacttaaagcaatcttctaaaataaaaacttcaaaagaaattaagaagtaaaacttaaaacaccattttaaatgacactgttaccatcacccacctaccctggagaagaaatgcacatttctggcttcagccaatgaggcttgttcaatgttccaacactgaaccatagctattggtttaataaatataccattacatcaaaaccattactatagttactggcagaacattgaactcctcatcaatgtgggagataagcaactccactgattttggctggaatataatacagctcttagataaccttagagagttccagcatgactgactgcaggcttggcaagcagtccagtaagtctgtaaacagagactaaagggatattaaaaaagaatgtgatgaatttggaaaaccatgtattcatcataacacattccaatgctggatgtgtcatctctaaggagttagggattttcccacctattatacggtcagtgatgaagctacatcttcaggactgaggtttgaaatcttactacctgaatcttcagatgtgttttccaactctctcttcactttgctttttttctacagagttaagtctttgagtgctttgtgatctgaaatcccccaaggcaactaacattccacttctttttcattttctttttaattagacactcacagaatacactgtactattttttttagaaacaggctccttttaattttttttagactgttttgcagactggccccaagactacatctactatctgataccattgatcgacctgactgttaaggtgtggactcagcacttcctgtgaagaggttccctgatgaatactgactctattaggcaagggtagtataacatgactcacagtcttctgtcagccctattgaattccaagctctgtctcagaactggctcgaattctctggtgattccttttccctcagttaactttgagcaaccatatactataagggtagacaacagatcctctagggcaggggttcccagcccccaggccatagactggtaccggtttgtggcctgttaggaactgggctgcgtagcaggaggtgagcagcacaagcattactgcctgagttctgcctcctgtcagatcggcacaggcatcagattctcataggagtgtgagccctattgtgaactgagcatgcaagggatctaggatgcatacttgttatgagaatctaatgcctgatgatatgtcactgtctcccatcacccccagatggaactctgtagttgcaggaaaataagctcagggctcccactgattctacattatggtgagttgtataattatttcattatatattacaatgtattataataataatagaaataaagcacataataaatgtaatgcacttaaatcatcctgaaaccatccctctcaccccaagtccatggaaaaactgtcttctatgaaaccagtccctggtcccaaaaatgttggggaccgctgctatagggaataaaataaaatctgctacttgactcatgagttgtatctttgaacttaaggtaagaaaaaaaatttaaccaaaccaacataattgaataatcagatgtcaatgtggaactcagaaacattatccttgtttacatacacactgttttttgaaattgtaagcctgtgatactctcgcatttgtgagatgccaacccctaaaaaaaaattgtatttcctaaggcagtataatgagttttgctttctttcttatatttgtgtctctcttattttgagaacttaacttccaagtgcaatttttggtcttgaacccaaatatatttctctcatcacccaattattagctctcatccactcttctcccagaatggttactaacaagaaacatgatggaggctgatggaggcaaccactgtgtaatgcaaacagctttagtattggtcaaatgctatagctggagagtcatgagtaagccctttctagtctctgagctttggtttcctcatctgtaaatatgtttaacatctgcaaagtcaatgccccatgtagacagggcccagcattatgtaatatttaaaaactaaattctcaccaacattttgagaagtgattaaaatatttcttgatgtcactcacaaatggcaaaagaagactcaattcacagcacagagcaaacaaaaagtcattttccccaactttttgtattgttctgttttggttttttgttttgttttttgaggcagggtctcactctgtcacccaggttggagtgcagcgatgtgatctccacccactgcaacctccacctcctggcctcaagtgatcctcccacctcagtcccccaagtaactggaactacatgcacaagccaccatgcccagataatttttgtattttttgtagagacagggtttcaccatgttgcccagtctgatctcaaactcctgaggtgaagcgattcatccatctcggcctcccaaagtgcttggattagaggcataaaccaccacacccggcccccagcttttaatatctctaatacttgcaactatccttaaatctctttcttctgttaaacctctacagaaatcctctatcagcccacactgactgactctcatctctttttctctcttcccacctttttggtattttcattttctattccttaaaatgtcagtgaggatcctgagctcctgagttttattcctcaaaatgtcaatgagctccagtctgactgcaaaggtgggtatttctctcttcactatcaaagtctaattataaaccagacttacacttacagcccccattgactctgttgtatcctttctaggtcagtgaggtggtcttcttgtcttcttcaaaagcacaggttgtgcaagcttttgactccaggaaaacatcctaaagccaaaccatgtaatcattcatttcactaccaacccaatggctccaaagcttatcgtagctgtcctgtttcagtgggaaattttatccataactcacagtcctatttttccaaacttggccatcaattccttaaattcttaggagtactggtggtttctaagtctaaccataggataaaaccacagtcaggagagcagaggtttaggttatcacccaatctaggcatgggtgccacatctccttcctccatcctgaatggtatctcgtttcttaacatagctgacatcttgggagataaagttgaaaagccaatttccaatctgcagttacctaaaggaacttcctagaagtcttgatttagtgtaatcatttaacactaactttaaaaataatccatttagtaatccaataccaaatagtagattatcaccccaaagggctactcttaatctcagagtagtaacaaaatttccctctaactttagtataatatttcaaggacaacgaaatacaaatttctgtgaaatttccaaagtgtaaaacactatgaagttctactctaatatatgtcctagatgatgatttactccaaaaaaaaaaagtagatgtgacattttacattccagtactgtaaccacagaaaactcagctgcctcatggaactataacataatgtctaaacatcaaaaactaattcgaaagcaacttaagtattaattgaaatttctcagcaatgccaaaagataaatctctatgtaacccaatgcaatttcttaaaagcctttttgtaccctcttgagcatgctttctccgtggaaggcctctcaattcaaagcattttttttctctctctctcctcgcctcttttaatgtgtatctttctcattttgcagctgccccaaagactctctttcttctttcataactcttaaaatctcccaccaaacccaacccatgcttctttctctattccctccttttcatctcctaatctattcatttccttctcttatgtttttagtgtaaatcaatcaaactgatttcaatgattcctgactctccctctcattcatcagtctgattatgggcagcaaagatgtttctttttaaagagaagactaaagtgagaaactcttactagtcttatatccatatttttcctgttacatataaaaagcaatacccatcataatgggttgattggaaactctatgaaattatgtatttacatatatttctgacatgtaggttttttaaagaatttttggttaaagtaataaaaatagtaagatggaaaacaggatacaatttgtcctctctggatacagctgttcagtctccctatcccatttccacttagcatcctaaagatcgaatggaaataacagaaaagagaaggataaaagatggcagaaaggagattagtagtttatgtgaggaaggagcaagtggtgtggagaagaatacagtttgacttagtgtgtctgctagctccatgagctgagctgtgcatttgccaggtggtgaggagggcagaggcagccacaaagctcccgaacagctgttcctttctcttcttccactcaacatttagagagtctgggcagtttaggggcagccactaagggagcagcagcagatggctgtcatgctgcagaggtgtactctagaaggatgaggggctccagttacaaaaagcagctatcttttatgtgctttaaagatatgtgctaaagtctacttgaaggctgtataaaggcacattaataaaaatcaccatttttaatttggtctttaattcagttctctaattttagtagtattttacattagatattagctatcggacaattattaaacttaaagaggaaaaaaaaagaacttaaaaaagacctatttttctcttcccatcctggcctcatccatttgaagcaagggtgacaaccttgttgtcataaccctacaaggaaatttttcacatttaacccacatttactgagaatctactctgtgtgccagtaatagtaccagactttttcatggccattatcttacgtaaagtaggtatgaaatggtatttttctaagtagaggtaaaggattctactcctcccactaaaaatacaaaataaaagaaaaagaaagacacaaaagttagagaaaacaaaatattagaagtttggttctgtttaaatgtatgcaaatccaattaggactaaatttacacttcaaaatatgtcaaaaattctctaacaggaaaaaaggacaaagttgaattttgttttctgttcttttcatgtgactttttgtgactggtattctttatacaaaatgactatggctcccataaataataaccaacaattctatagtattttgaagttttcaaagtattttcacataaaaaaattcttttgatctttaaaaactttctataaactaagaatctctatataataggaactttcgattcacatatgaggaaagatttcagtgcagtaacatgctgactggaatcagcctcaacactggaatagtgacatttaataagtccatggcaggcaatagacctgacaagtaggctttgctctgatgcaggcagaacatgtcatcattgtccaactagttttataaagtttttatgagaagggaaaaagtagttggtattctaggaaaaggaatttttacttgcctttcttctagatcgcaccaggagtgtccataatttgtcaactgaaataaagctcagccccagtgtcttctaaatttgtccactaactcattcacctatgcaaaattgtggcatttaaggaattagtaaaaactaattaacttaaataagatatttatttaatactctgttaatcaatgttatagaaaaggttactaagtaaattttgaaatgatatatctcccttaaaaggtccctaaattccttaaaatgagatcagataaatattaaggaaatattacagaataaatcaggatatttggtaaaaagaaaacgtgcttatcccatatgaaaaaaaaaagttgtggttagaacaaattagtatttttaaatttttttcagtaagttataaattaaatacatgcctattcactaataattcaaatggccaaagagcactgttaaatgatggttttctctgagggccatctttttatagacattgatacagttaatcttcctaatgtccagctggcatcaggttatttccttagagtagtgactgataatagttatcggataaaagccatgttccaagttgaaatccaaactccaaaattttctttttaaataggacttctatgatttctcttcttagtccctctgtttttcatgaaaattccaagactccctctttttgcctttgtgcaatccattctctacccctggtatttcctatcttcatgtcccttgtccagaatagtctagatccatctagcttaaatgtgatcttcttcttaaggctttcttctttttcctaaaatctctttcttctgcattctcgtctacttaagattgatcatgagctccaccatctcctggtctcccatatccaatcagtcatcaacttctgcctgatttccatttatcggtattcctgaaagcacgaacattggcatcagatatatatgcttttgaattttagctatgtctccactagctgaatgaacttaaataagcaacttattgttaatcatagtttcctcttctataaaatggtcattcaaagagtacctaattcacagaattatagtaaagatcaaacgagttaataaatatgtaattcaacttagatggaaaattcaatggaagccaacatttctcaaagtaggtttaaggaatattggttccataaatattcttcaaataaaaaggaattcgtagttaaaacaacttattaaaaagtatacctaatacccacttctctgtcagtcatgaagtatattagcacattaaagtctccaagaggtcttaaaaaaatagaaaaaaaaacaattatcctaacattccctaaacttatttgaccaggaagcctttttatgcatatatagtagctacttaaaagcctgcagaaccagtgttctgaggaaggctttgagaaaatgcttacctggacaagaaccacagctatcatcttgaaagttatttcagccttaggttttcaatttttagaaaaaaataaaaaataaaaaataaaaacattgtgaaagagaccatctcctaatgttcagagtcattagaaattctcagaaaatgaataaaattctgccctttgggaagatatgcccaaaagggtagcagaatggtattagctttccaaggccaattacttcttaacaatctcttaaaggatatgaaaaagttctatttttcatggaatgcccagtaattgcttatccagctggtagcagatgcaaaacttcatctcaggaggaaagcttaacgtacaaatttgtgaagacctgataaagagtgagaagaactctcaggagtctcaggaaatgaataagttcatgcctgtgatgaagacagaattgagacgtgatcactatacctgaggtctaatacatctaccttcaaacataaaactgtttactctatacaaataaaagggcaatacaggtacacctcacattacggtgcttttttttattgtacttcactgatagcatgtttttttgcaagttgaatgccgagcaagtctctcagcaccatttttcaaacagcatgtacccacttcatgtctctgtgtcacattttggtaattcttatatttcaagctttttcattattattatatctgttttggtgatctgtggtccgtgatctgttttgttactattgtaattgttttggagtgcaacagaactacacctatataagtcaacacagataactgataaatgttgtgtgttctgactgctcaatgaaccccctgttcccccatctctatacctctctttgggccttgatattccctaagaaacagtaatattgaaattaggccaactaccaacactacaatggcttctaattgttcaagtgaaagacatatctaactttaaatcacaagctagaaatgataatatttagtgaggaaggtatatcaaaagctgagacagataaaaattaggcctcttccaccaaatagttaaccaagttgtaaatgcaaagaaaagttattgaagaaaataaaaagttctactccagggaacacataaataataagaaagtaaaacagccttattgctgatatggagaaagttttagtggtctggatagaagaacaaaccatccacaacattcccttaaaccaaagcctaatccaaagcaaggtcctaattcttttaagtctatgaaagctggcagaggtgaagaagctgcataagaaaagctcgaagacagcagaggtttgttcatgagatttaaggaacaaagcaacctctataacataaaagggcaaggtgatgtagcaagtactcatatgggagctaaagcaagttatccaggcaatctagataagataatgaatgaaggtgtctacaacaatcaatagattttaaatggagaagaaacagccttctattggaagaaggggccatctaagacttccattgctagaaagaagtcaatgcctggcttcaagcttcaaaggagaatctgactctcttattagggcctaatgaagcaggtgactttaaatcgaatccaatgctcattgaacattctgaaaaacctagggccctttagaattatgctaaatctagttggcctgtgttgcataaatggaagtacaaagcctgttacccaggttctcactcaggctttgtagtttcatgtatgttggtttacaacatggtttactgaatattttaaacatatcattgggatgaacttctcataaaaaaagattccctttaaaatattactggtctttgacaaggtacttagtcaccccaaagctccagtggagatatatagagagatcaatgttgttttcatgcctgaatatacaacatccaatctgtaggccaaatatcaaggagtaatattgaatttcatgtcttattacttaagaaatgcacttcttgccaggagtggtggctcatgcctgtagtcccagcactttgggaggctaaggcgggtggatgacctgaggtcaggagtttgagaccagcctggccaacatggtgaaaccccatctctactaaaaatacaaaaattagctgagtgtggtcatgcgcgcctgtagtcccagctacttggaaggctgaggcaggaaaattgcttgaacccgggaaaggaggttgcagcaagccaagattgtaccattgcactcccagcccgggtgacaggagtgaaactctgtctcacacacacacacataaaataataaaaataaaaaaataagaaagaaaagaaaagtaatacatttcttaatgctgtagctgccatactgattcctctgacaggtctggagaaaatacattgaaaacttcctggaaaggcttcaccattctagatgccattgagaacattcaagattcattaaaagaggtcaaaatataaatattaacaagagtttggaagaagttgattccactctcatggatgactttgaggtgtttaatcttcagtggaggaagtaactgtagaagtgatagaaataccaagagaactagattagaattggagcctgaagatgtgactgaattgctacaatctcatgataaaacttgaacagatgagtaactgcttcctatgaatgagcaaaaaaagtggtttcttgagacagaatctactcctgctgacgatttggtgaacattgttgaaatgacaacaaaggatttcaaatattacataaacacagttgataaagcagcaatacagtttgagattcattccaatttcaaagtaagttctacagtaggtaaaatgttaccaaacagtatcatatgctgcagataaatctttcacgaaagagtccatttatatggcaaactcaatgttgtcttattttttaaaattgccacagcctccccaaccttcagcaactgtcaccctaattattagcagccatcaacacagaggcaagaccctctaccaacaaaaagattatgactcagtgaagactcagataattagcactttttaacaattattatttcaaaattaagatacgtgtttttttagatatattgccatggcacacttaatagactagagtatactgtaaagataactttttttttattttttgagacagagtctcacaccataacccaggctggagtgcagtggtgcaatctgggctcattgcaactccatctcctgggttcaagccattctcctgcctcagcctcctgagtacctagaattacaggcacacgccaccatgcccgactaattttggtatttttagtggagacagggactcaccttaatgtgcatgtctgacactaacctgtaatatctctgaggtatgcctataaatgtttgttgaccgattgtctcaatgttacaagctgaatgtaaccaaattttagatggcacagcagaaattccgaaatcatttaattttcttttcatgagaagcaaaataagactaccttacatttatagctcatttgtggtctgctcttctataaaccataaaaactcctaactttacaaacatagaacttaactcttctttcatcttcatcaaaaagtgcttttcaaacaattagcatttcccaaataacgtttgtcgtttccgcttaggcctgttttagtctacctaatagaataaatttagcttccctgtagcagagccctatttttaaaagcatcttttaatacatgctgctgtgagagcaaaaaaaaaaatcatagtcattttgaataatttttacatgtttattaaaacaatggtaagcaaaataagtggttattatatgctctcatgttagtcttagtattcataagctaaaagcactcatccttctttaaaataaataacccaattgaaaataaaatgttattaatcatataaagaagatctctgaattcttaaacactgtgaattcttaaacactgtgagtatagcatcgcttctatttatacaaataaatgaaaccacaaacttattagagtaccttttaactataaaaataaatagataagcagaaaaatacattctaacctaattttcaatatctgaaataaataattagagaatatataaggaagaaattttggtgaataactgtagcaaattcctaattctatgaatatggaaattgaggcactacatattaaacaataaggcataaacccatctgagtattagtgagaattaaaaacacatctcctaatttccagttatgcttttcgtatcatcacaatcttcataaggtttgtccattaagttcatttgtgccttaaacaacacgaaatccacccgttacacattttatggatactatttataaaaatcagccaattcttcaataaactaacattagaaacaggataattagttgcctgagtttaaaaaattgaacgcaaatcaataaacataatcccgcatataaacagaatcaacaacaaaaaccacatgattatctcaatagacacagaaaatgcctttgaaaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactccttttcaacatagtgttggaagttatggccagggtaatcaggcaggagaaagaaataaagggtattcaattaggaaaagaggaagtcaaattgtccctgtttgtagatgacatgattgtgtatttagaaaaccccattgtctcagcccaaaatctccttaagctgataagcaacctcagcaaagtctcaggatacaaaatcaatgtgcaaaaatcacaagcattctcatataccaataacagacaaacagagagccaaatcatgaatggactcccattcacaactgcttcaaagagaataaaatacctaggaatccaacttacaagggatgtgaaggaactcttcaaggagaactacaaaccactgctcaacgaaaaaaaagtggatacaaacaaatggaagaacattccatgctcatggataggaaaaatcaatatcatgaaaatggccatactgcccaaggtaatttatagatttaatgccatctccatcaagctaccaatgactttcttcacagaattggaaaaaatactttaaagttcatatgaaccaaaaaagagcctgcattgccaagacaatcctaagccaaaagaacaaagctggaggcatcatgctacctgacttcaaactatactacaaggctatagtaaccaaaacagcatggtactggtaccaaaacagagatacagaccaatggaacagaacagagccctcagaaataataaccacacatctacaaccatctgatctttgacaaacctgacaaaaacaagaaatggggaaaggattccctatttaataaatggtgctgggaaaactggatagccatatgtagaaagctcaaactggatcccttccttataccttatacaaaaattaaatcaagatggattaaaggttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagggcttctgcacagcaaaagaaactaccatcagagtgaacaggcaacctacagaataggagaaaatttttgcaatctactcatctgacaaagggctaatatccagaatctacaaagaactcaaacaaatttacaaaaaaaaaccaagcccatcaaaaactgggtgaaggatatgaacagatacatctcaaaagaacacatttatgcagcccacagacacaggaaaaaatgctcatcatcactggtcatcagagaaatgcaaatcaaaaccacaatgagataccatctcacaccagttagaaaggcaatcattaaaaagtcaggaaacaacaggtgatggagaggatgtggagaaataggaacacctttacactgttggtgggactgtaaactagttcaaccattgtggaagtcagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaatccaaatgtccatcaatgatagactggattaagaaaatgtggcacatatacaccatggaatactatgcagccataaaaaaggatgagttcatgttctttgtagggacagggatgaagctggaaaccatcattttcagcaaactatcgcagggacaaaaaaaccaaacaccgcatattctcactcataggtgggaattgaacaatgagaacacttggacacaggaaggggaacatgacacaccgggcctgtcatgggatgggcggggggagggatagccttaggagatatacctaatgtaaatgacgagttaatgggtgcagcacaccaacatggcacatgtatacatatataacaaacctgcatgttgtgcacatgtgccctagaacttaaagtatcataaaaaaaagaaaaaaaagtaatgtgaagtatgaaaaataatatctgaagagtttactaaatttatgtaattaaaaatcccaagattaaaaaaaaaaaaagaaaaagaaagaacagtcactaagtttaaagtatgttcttagtaggggatttatatagcatatgacaactgcggtctcctctgattcccttcagaaaaatctcacaaagatgttgggtcagcagtctcaaggacaatgtaatggcttcatctagaactcatatctgatttttgaatctaatgaaataacctgaatgtaaaaaaacatatgtacccatggctctgacagctagaaaagcagtcaaatgagaactagttacaggcaagtctagaagagtattagaataacttaagaaagacagagcagagacaattttaatgaagtcttggatactcagtaagagtttggttctagtgccatagacagtataatgttgatagaaagttgaaaagtgttttgatttgcctttctctgatgattacctgttggtgggggtataaattatttcacccagtgtgaaaagcagtttgcagaattctcaaagaactaagagttgaactaccattcgacccagcaatctcattactggacatatgcccaaaggaaaataaatcattctaccaaaaagacatatgcactcatatgcatatcacagagctattcacaaaagcaaagacgtgacatcaacccagatgcccatcagtggtgaactggataaagaaaatgtgacacataggatttatgggggaaaatggcagatgggaggcaggactaaattgcagctcccactcagacaggcagagcagcatgtggagatacatcatgaacttttcctgaaagaactactggaggaacataccaggaaagccaaaagaatccacagaccctttgaaggaagcagattgctcctgcaggacccaggagacagcccaaatactatgagtgcccaaagtatgaaagtgggaaagggtgaacacacaccctcactggggaactcgaaggtccaggttatgggagaaggatttgaccctacctagaactgagacaatttagagagccaagtgaaatacaggagtagaggaagtgccagaagagccctgtgggctctctcggtccccagggaagccatttctgactttgtctcacagggatccttggggagggttgccagtggaactgggaaaagaccacagataaaaagaaacctcaagctgaactttgtaacaattccaaccaaacatgcaaaatttcttggacagaacttgggggagagagtgaatccagagtgcagacacaggcaggcaaggaggtatgaaacctgaaagtcctgcttgctttctcagctgggaggctggtagcctggggcaagttcttagccctgcttgcccactgcctaaaaacaaactcagtgctattgcggggaggcacagtgagagtgagactggccttttggattgcatgggagccgggtgaggcctgtaactgtcggctgtcccccacttccctggcaacctacatgacacagcagaggcagccataatcctactggtaacgtaactccattgacccgggaaccacaaacccatcccccacagcagctgcagcaagccctgcccaaggagaatcagctcagacatgtctaaccctgccccaacttgatggtatttctctacccaccctggtagctgaagacaaagatcagattctcttgggagttctagggctccagccactgcctgatcttccctatactaccacggctcatgctctcttgaaagtgccacctcctggcaagaggccaatcagcacaaaactagtgcaataaacaacaataatacaactacgggccctcacagaatgcatttcactcccctgccacctccactggagcaggtgctgctatccatgactaagagacagaaagatggttcacatcacagaactctgtgcagacaccccctagtaggtaagtactacatcaagggagcaccccatgggacaaaacagtctgaacagaagcccttgagccccagatcttccctctgacatagcctacacaaatgtaaaagaaccagaaaatcacttctggtaatgacaaaacaaggttgtttagcaccctcaaaatatcacactagctcaccagtaatggatccaaagcatgaagaaagtcttgatatgccagaaaaagaattcagaaggccaattattaagctaattaaggaggcagcagagaaaggtgaagtccaatttcatgaaataaaaaaaaaaaatgatagacggtataagggaaaaatcttcagtgaaattgatagcataaataaaaatatcacaatttctggaaatcaaggacacatttatagaaaagcaaaatgcactgaaagtctcagcaatagaattgaacaagcagaagaaagaacttcagagctcaaagacaaggtttttgaaataatccaattcaacaaagacaaagaaaaaaagaatttaaaaaaatgaacaaagcctgcaagaagtttgggattatgttaaatgaccaaacctaagaataattggtattcctgaagaaatctaaaggtttggaaaacatatatgggagaataatcgaggaaaacttccccagtcttgatagagatctagacattcaaatacaagaagctcaaagaacacctgggaaattcatcataaaaagattatcacctatacacattgtcatcaggttgtctacagttaagatgaaggaagaatcttaaaagctgtgaggcaaaagtgccatgtaacctgtaaaggaaaacctatcagattaacagcagttttctcagcagaaaccctccacactagaagagattggggccctatcttcagcctacttaaacaaaacaattatcagccaataattttgtatccagtgaaactaagcttaataaataaaggaaagatacaatatttttcaacaaacaaatgctgagagaatataccactaccaagccagcactgtaagaactactaaaaggtgctctaaatcttgaaacaaatccttgaaattcatcaaaacagaacatccttaaagcataaatttcacaggaccaataaaacaacaacaccataaattttttttttaaaaaaaggtatttaggcaacaaatagcacaatgaatagcacctcacatctcaataccaacattgaatgtaaatgacttaaaaactccacttaagagatacagaatggcagaatggataataattcaccaactaagtatctgctgccttcaagagactcacctaaaacataagaactcacataagcttaagataaagaggtggaaaaagacattccatgtaaatggaaaccaaaagagagcagatagtcattcttacatcagacaaaacaaactttaaagcaacagcagttaaaaaagacaaagagggacataatacaatgataagaggccttgtataacagaaaagtatcacaatcctaaatatatatacacctaacactggagcttccaaatttataaaatgattactactagacctaagaaatgagatagacagcaacacattaatagtgggggacttcaatactccactgacagcattagagaggtcatcaagacagaaagtcaacaaagaaacaatggatttaaactataccctagaacaaatggacttaacagatatttacagaacattcaaagataaatttaaaaatttcttgagacaaacaaaaatgaacatacaacatacccaaacctgtgggatacaacagaaacagttccaagaggaaagttcatagcaataaatgcttgcatcaaaaaagaccagtctaaggtaaacaacctaactttgtaccttaaggaactagaaaaataagaacaaactaagctcaaagttagtagaaggaaggaaaaaaaaaagatcatcacagaaataaataaaatagatattagaaactcactagaaaagatcaacaaaactaagagttggtttctggaaaagattaacaaatttgacaaaacttaaagagacacagataaataaaatcataaatgaaaaaggagacattacaactgatacatcagaaacacaaaagattgtgagggtacaatgaacaattacgtgcaaacaaatagaaaaactcagaaaaaaatgggtaaattccttgatgtatacaacttaccaagaccagactattaaaaaatagaaaatcttagcagaccaataatgaataaacacataaacagaccaataatgagtaaggagattgaatcaataatataaagtctcccatcaaaaaaaaaaaagcccagaacctgatggcttcattgctgaattctatcaaaaacttaaagaatgactcatatcaattatttaaaaccttaaaaaattgaagagggaatacttccaaattcattttacaagatcagcatcaccctgataccaaagccagataaaaacactacaaaaaaaaagaaaaacctcaagccaatatccctgatgaacactgatgtaaaacatcttcaacaaaatattggcaaacagaattcaaaggcacgtgaaaaagatcttcagcattatcaaatgggattcatcttagggatacaaggatggttcaacatatgtaaattaataaatgtgatacatcacattaactgaagggagaacaaaaaacgtatgatcatttcaatagatgcagataaaaaatatttgacaacattcaacatactttcatgataaaaactctcaacaattaggtataaaaactctcaacaattaggtataaaaagcatgtacatcaacataataaaggccatatatgacaaacccgtagctaacatcaaactcactggggaaaagttggacgctttttctctaagatctagaagaagacaagagtggccactcttgccacttcttctattcagtacatactggaggtcatagtcaaagcaataggcaagagaaagcaaatgaatctaaattagaaaagaagagataaattgtccttgtttgtagatgacatgctgttatttataacaaacactaaaaaactactagaactaatatccaaattcagtaatgttacattacacacaatcaacatacaaaaatcagagaacaatctgaaaaagtcaagaaagtgatcccctttatataactacaaaaaataaaacatttgtgaataaacttaacgaggagttagaagatctatacattgaaaattatgaaatactggtgaaaaaatttgaaaggatagaaataaatgaaaagatatcctgtgttcacagattgaaaaagttgatattgttaaaatgtccatactacaccaagcaatctacaattcaatgcaatccctatcaaaatgcaagtgccattcttcacagaactagaaaaaacaattttaaaatttgtatgaaactacaacagactttgaatagccaacacaatctggagtgaaaagaacaaagctgcatcatgttacctaactttaaaatgtacaacaaagctatagttactacaacagcatagtactgacatgaaaacaaatgtaccaatggaacagaatagagagccctgaaataaatccatacatttacagcaaactgattcaacaaaggtaccaagaacatacaatggggaaatcacagtcttttcaataactgatgttgggaaaactggatatctaccatgcagaagaataaatttaggtaattttctcacatcatatgaaaattaacttaaaatggattaaatacttaaatataagacccaaaactatgaaactgctataagaaaacataggtgaaaatctccatgacataggtctaagtaatgactttttggatgtgactccaaaagcacagaaaacaaaagcaaaaataaatgaggggactatacaaaactaaaaagcttctgcacagtaaaggaaacaatcaacaagagtgaagagacatcctacagaatgggagaaaatatctgtacattatacatctggctaaaggttttatccaaaatatatgatactcaaacagctcattagcaagaaaacaaataacctggtaaaaattgggcaaaggacctgaatagatgcttttcaaaagaagacatacaaatagacaataggtatatgaaaaaacgcccaacatcacaaatcattaggaaaatgcaaattaaaaccataatgaggtatcacttcacacatgataggatggctgttatcaaaaagagaaaaagtattagtgaggatatggagaaaatggaattttgcaagctgttggtgggaatgtaaattagtgcagccattatggaaaataatatgaagattcctcaaaaaattaaaaatagaaataccatatgatctggccatctcctactcgatatatatccaggggaagtgaaatcagtatgttgaagatatatctgtgctatcatgttcattgtagcattattcatgatagtcaagatgtagaatcaacctaagtgtccatcagtggatgaatggataaggaaaatgtggtgtatatacataatggaatactgtttatccataaaaataatgaaatactgtcatctgtgaaaacttgcatgaagctagaggacattatgttgagtaaaataagccaggtacagaaagataaataccatattatctcactcatatatggaatctagaaagatgcagagagtagaatcatggttaacaagggcttgggtcattgaaggatggcagaatttgtgagatattgggcaaaagatacaaaatttcacttaggaggaatatgttcaagagatctattgtacagcatagtgactatagataataatatattgtattcattaaaaatgctaaaagagtggatataaagtgttcttatcacaaaaatcatgactatgtgaggtaatgcttatgttagctagatttaagcattccacaacgtatatatacttcaaaacatcatgttgtacataataaatacataaattttatctgtccattaagaaatgatttagttcagttctgagacaagacatcactctaccctgctgttctctaaatacaattcaataaatgctcatggcaggtttcttcataactattttacaggtgtcctttaaagggtgggtggttaaacaaaccttggtacattcatcattagagtactagtcaacaataaaaagcaatgcagcaacttggatgaaattaaaaaaaaatatgctcagtaaaaaaagctaaatccaaaggcttacatactgtgtgatttgtttacacagctttgatgaaaattttatattactttatttttacttttattttaggttcagaggtacatgtgaagtttggtttgtggatttttgtttttttggtttttgttctttttgtttttgtttttgagaaaggatctcactgtgttacccaggttagagtgcagtgacatgatcgcagttcacggcaacctccccttccccagtagctgggactacaggcacacaccaccaccccagctaattctggtattttattttattttattttattttattttattttattttattttattttattttattattttattatttattttgtagagatggggttttgtcatgttgcccgggctggtctcaaactcccggactcaagtaatcagcctgtctgggcctcccaaagtgctaggattataggtgtgagccactgcacctggtccaggtttgttatacaggtaaagggtatgtcacaggggtttggtgtacatattattttgacaccaaggtaagaagcatagtacttaatagggtacccatgtttctgcaaaggacatgatctccttttttatatggccatgtagtattccatgatgtatacgtaccacattttctttattcagtctactgttgatgggcatttaggatgattccatgtctttcctattgtgaacagtgctgcagttaacatgaacatgcgtgtgtctttatgatagaatgatttatagtccggctggtcgcagtagctcatgcctgtaatcccaacatttgggcagccaaagcagccagatcatttcagctcacgagtttgagaccagcctggacaatatggtgaaaccatgtctttactaaagatacaaatatcagatgggtgtggtggcacaggctactcaggaggctgagccacaagaatcgcttgaacccaggaggcagaggttgcagtgagctgagatagcaccactgctctccagagtgggtaacagagtgagactctgaatcaaacaaaaaccccaaaaaccaaaactatattcctttgggtatatacgccagtaatgggattgctggggtgaatggtaatcctgttttaagttctttgagaaatctccaaactgatttccacaatggctaaactaatttacttttgcaccagcagtgtataaacattcccattttctccataacctcaccagcacctgctttttttgactttttaataatagctattctgactgatgtgaaatggcatctgattgtggttttgatctgcatttctctaatgattagtaaagttgaacgttttttcatatacttgttggctacatgtatgccttcttttgagaaatgtcttttcatgtcctttgcccacttattgatggggttgtataacattctagaaatgacaaaattatgtaaatagagaacacattagtggttgtcaggcattggggagtgaggcatatgggagagaaatcaatatggatataacaagacaacataaggaatccttgcgataacagaaatgttctgtatgtttactgtggtagcacatacgcagatataaatggttaacaaaatagcagagagctaaatacatagtataagcatatgcactcacacacacagaggaatacaagtaaaactagggagatctgaataagattgatagattatataaatgtcaatatcctagttgcgatactgtacaataattttgcaaaatgttatcattggaaaaaactatgtaaaagggacatggaatcttaattatttcctacaactgcaaatgtatctgcaattatctcacaataacatcaataaaaatgattttataacaaatgaaagcaatcaaatactagtaaaatttagtacatttctatgtccttgttgtatatttcatcatttaaatatacaacaaagcgaaataatctaaaaagaaaacattattttatacctcaaacccctgagattatacacaattgcatatttctgtaacttcatttgaaaatatggcatccataaccatattaacatactacggggagtttaggaggatcctagcttttggctctcctccctcagttaattattggaagctttgaggaaaggtgtcacgagaaatttttgattcagtcaataaacattaatttttcttttgtcttgcttttataaatcactggcctatctacaatgggaggctacatcttttaattaatatacaatacttttcagttcttagttgtaattatcttgtatgttttagatttcacataacgctgatgaaacccactgaacttttaaaagtactctaggatacaggattcacatgtaaatctaccacaataaaatgactttttaccagttattcctccatcccagagcttcattttatgtttataaccttattttaaccttatttattctacttgttatgttaaaattgtacttattttactcctcccaaggttaaaataaggattaaaatatcatttattttcatttttattactttattatctccataaaagtctagagtcactagcttcttttatccatctttggtgctggtataaaaacacatttcttgcttcacgttatgtctttaagcagcatcactttctttgattttccttttccaattaaaccactatctttgaactttttaattttcatggatacataatagttgtgcatatctgtggggtacatatgacattttgatacatgcacacaatatgtaatgataaaatcaggggatttaggatctccttcaaacatttatcatttctttgtgttgggaacattctgaatcttctcttccagctattttcaattatacaataaagtattgttaactatcatcatcctatagtgctattgaacactagaactccttccttctagctgactatatttttgtacccactacctagccttcttaattcccctcccccactcctccctgcctttgctaaccatcattctattcacaaaatatcacatgttctcagtcatatgtggtctaccttttttgtttcttctctatttctgttattttcagttattatttaaataactaattaaattcttgtggttttttcctattttttttataatgataggtttttaatgccctatttctccctgacaaacaactagacaccctgaatactagtagattgccctagaaacctgcctccaactggatctaataactgaattcagcttctcaagtcctaatcagattaaatcagatttggtatggcatagttttgtatattcttaaaatagtaacaagattacttcacctactctactgaacagcctagatgaatctatttgttattattattgggaaaatctaagttgagtatgaactaaaattcactaacaccctttattccttcttcctaatgtcctcacttatttatttgtcctactgtgataaatgtatcttagtaaggcctttcgaaatattttatgaattaaggctggaacaaagtagataaataggcaagagagaatctatcagaaaattaagtaaaatagaaaaaaaaaatcttaattacggctttgacttagctcacggactacctcttctccagctaatctgcactttgctgccaaagacattctcctgaagcttaaatgtgagcatctctctattgaaaaactcagtgtagctcaaaaatatcttaaaatgttctcatggtatatgaggtcttatagaatttaagttcaagctatctctcttcattccccacaatgttctctgataagatggtcctctgttctgggagctcagaatcatactcagtcccgtaaagaaactgagcctttatctaggtatgaaaacctagacaacgtcctcatctgtattattgtacttaacaacctgcattatgaagtccttgtgtaagcagaacagatctgcccattcaatggcagatgctcctcaaagacagttatcagaagtcactcagtaactctaaggccgtcttcagtatttgtaggtctgcaaatggcatgggcaagaataaaagccagtggtaatagtaacaacgtgccccacagaattttatctgggtcacatacatgcactcctcttgctcctgtgtgtaactttggactttccctcagattctatctggcctgattgcaaggatcttttaacgtgattatccattctggagtttgtccttgattaccttgacaatggctcctagctctacccttactacagtgtgctcctcggttatacattatctcagttatcatagggtcagctcacctttttggccttgtaaagataacagtgctttaaatttttggtttattaatttattcatgaacatttagtaagtcccatattatactaatcattgaagacataaagccaagtagaacaggttccttgcctccaattatcttgcttctctgagaacggaaggtaagagtcaggctgcatctatcaggcatctaactactatggtctttttgacccatttgtactgaaatgttttaaaccagatacaccaacacagttctctagttcctcagcctccagaccaagagagaatatgtttccttgtgaatgctgatcatactttgctaataatgaatgtgtgtttaaagttaaaaaagaataaaggaacacagctggatgtattagtatgggctcatgaaagagacatatccttggatgctgaacccgcatagtcctgttacttcatggatgacacaatgaactgaatctaagacacttctaaaccatcccagcctgcactagagcattggcaaactggaggtgctgttttacaaaatgaatatatgaatggatgaatggtggatggacgaatggatgctttttcaatggcctatatgttcttccaaatattttgaccattaaaagaatttaaagtctagtttgaatttcatctatgtcaagaaactatccagtgtccctagtttaaggtgatcattgattccttgaattcacattcaaaccactgaattcaaatagtttattatttaatctgtacctgtataattatgcaattattgtagttatgagtatatggttgctttaataaattagaaatccgttgatatctggaaatacagttgacccttggacaacatgggtttggagtgtatgggtctacttctacattggtttttttcaatcgaacacagacagaaaatattgtattggcagatgtgaaacctgcctataagaaggcctgatttttcatatgcatggcttctgactaggggaaatgatcatgcatagattttggtatatgtggggtcctgaaaccaattccccatatctacatagggatgactgtatatcttatactgatgccctgccatggactatcatcctgcctggcagggaacagtcactgaataaataatctgtacatgagtgtacttcctaatagataatcttggatcatccatctatgttcagtcaatatgtagaaaagatcagcatattattcatgacatattaaatacacacttattgagtacttattctgggcttggcaaggatgtggttaaaatttaatcaccttaacacttgctcaatgtgtgaataatatgactctaccaaatcatattgttatcttttatcttgttattttataaacagagatataagtaatgacctcaaaatgactttttgaaagaataaattagcatctaataaacaaatacacagctttaaaaatcatcttgttgcaaggaaaggaaacagaacaaagtattttcataatcaagtacaaagttaagaactagagtggcattttttttttattatactttaagttttagggtacatgtgcacattgtgcaggttagttacatatgtatacatgtgccatgctggtgcgctgcacccactaactcgtcatctagcattaggtatatctcccaatgctatccctctcccctccccccaccccaccacagtccccagagtgtgatattccccttcctgtgtccatgtgatctcattgttcaattcccacctatgagtgagaatatgcggtgtttggttttttgtacttgcgatagtttactgagaatgatgatttccaatttcatccatgtccctacaaacgacatgaactcatcattttttatggctgcatagtattccgtggtgtatatgcgccatattttcttaatccagtctatcgttgttggacatttgggttggttccaagtctttgctatggtgaataatgccgcaataaacatacgtgtgcatgtgtctttatagcagcatgatttatagtcatttgggtatatacccagtaatgggatggctgggtcaaatggtacttctagttctaaatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggctagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctgcatattagccctttgtcagatgagtaggttgtgaaaattttctcccattttgtgggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttgagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtagcagtaccatgctgttttggttactgtagccttgtagtatagtttgaagtcaggtagcgtgatgcctccagctttgttcttttggcttaggattgacttggcgatgcgggctctttttcggttccatatgaactttaaagtagttttttccaattctgtgaagaaagtcattggtagcttgatggggatggcattgaatctgtaaattaccttgggcagtatggccattttcaccgtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagacaattttagaccaatatccttgatgaacattgatgcaaaaatcctcaataaaatactggcaaaccgaatccagcagcacatcaaaaagcttatccaccatgatcaagttggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctctataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtcactgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaatagagtggcatttaaagttctaacagaatatagagaaagggcccagggaattgactcacacttatgctatgtaggaaaaggagtgcatcatataatacttatttcatagggtgaatatgtgtgtgtacatatatatatgtatgtatgtatgtgtttgtgtatatatgtatcataggaaagagcattttcacatgtaagcaactttgcaaacagggaaacagaggcaaacagaaaatgcatgtttcctaactgtcaaagcaagcaaaggtcaagtcttctctcaaaccctgtttcaactctattcagtccattgttacttcaaaaccattttaatatttttcattatataaaagctgttcctctatgaaattaatgaaagtaatgatttttgcattaaaaaaaaacagttgtttatccagaataaaaacaaaatccctgagacaaatggggagactcaggaattttccctttttttaatccaagcaagccaaggaagccccagtatacatacatatagcatgtatatatttaactgatcatctataggaaaatacatacattcaattaaaataaatactatactataggtatgtggtaaagaccaatttaatggagcaaaattccatcagaaagtttgctcaagttttagtttttcccaaagcatttgaatcacagaggctacttttttaaatatcaaaacaaatactttgggcttattgtgtagacagacaagttatcatggtgcatatacctctctttacagctactccctattcagaacatcagaataaagacagaaagaagactgcaaatacagcttcagtttgatttcatactgaaatacccactataggtcctctatagtaggctggttgtactggcaaaacaaaacaaaaattattattatcacattcgttcaatacttaatatgtaccagtcaatgttctaggatttttgtacatgcaatttccttgatgatctcagaactctatcaagttggtagataaagaacctgagtctaagtcacatgcccaaggctggctatacagctcatgaatgaaaggtcagaattcaaacatcttctgtttgactttgagatctttttcttgatcaccatattacaatgcatctactattcataataatatctattatcccacttagatgagaaaactgaggctcaaagctcagtatcctgtcagaagtttttcttctatggagtcatccactgaaaattaaatcaggttcaaaattattaattcagtttctccttcaaatcacccttccaaattacactctgccactaataattgggcagattgggacacccttgtgaagtcactattctttgttatttatcatttatattcaacttatttccttgattataaaaagaataatatgttgaaaccaataaaaacatatgtttcattcctacagtaatcaagaaaaagtggatctggttggaaaaagcattaaaaaaagccccgagttatttttggcccatacagcatccccagtacacgttctccctgtggacacagagcagcatatggctgttcttttcacagttcaggctcttctgtttactctgaacctctaggttacaatatgttttgtaatcactaataaggaccacctgtctcttgagagattctgcctaataaaatagagagactcattgttcaaatccactctcaggtagacaatacatgcctcatgtgtgggccgagattactgagtagaaaacttaaacaaattatgctgattgtaattgccaaattaagaacatatgttagtttcataaaaagaaaaaagaaacagtaatgtttggaacaataaagataatgcttttgaggaaatgaaatacctaatatattttccaggaaaaagaaaaagaataatctacttatttaaaaaattcgttcaatccactaagagatattcaaggcaaatttactgcattccaatatgcctaaccatataccctctttgtacaaatttatactatggttgaattcagccagaaaaactggctctttgaaaacaagcagagttcaatccaataactgactgataaatgcttaccactgagaatgtgaaagctatcataaatctggtttaatagaacaagaagagatacagtatatggataagagtaaatcctcctgtcagtatcctcctttggccacagtgacaattcccaccagaggtcaggccagattagcaacctctctctaggctgccattgcaaacccatatatatataccttcatcagtgcacctgctccattgcgctagagtggttggtccgagtgtttgtctctccttctaatctgtgagttccctgagaacagggttcacatattcactatagtctcaacaccttttaacagagtatgagcacagactgaatttcccaaatctattcaaaaaataactgcctaggtgatgatatctattcacatggtagcacaggaaaataaatttatctcatataaagtttgttttttgagtgcagagggattttccaagtattaaggccaatgtcaaagacaggcagaaaggactggctgtggggacagtcagcattttaaatgcagagactgtctctgaactttctcacacaaactcaagtccctcttctaatgggaccttcgctttgcccagtagactcattatctatcaggtgtctcactgaccacatagaatattgagatactgaattaatcataagtaacatttatagatctcaggtgtaccaaacactgggcaaagggctttgttgtattacttcatttaatgcttattacaaccatataaggtgggtgctactgttttcattttagacatgataaaactgaggcaaataatttgtttagtgctttgccatagatctaagcaaaacattaacaagttggtagcttgccaagcactctactactccaccttcaagcaggtgactaatccaactcctaaggataaaagtcatttgatttgtcctgataatcctcagaattcaattcttaatttataacctctctccacagtgcaatttattgttttttcttctaagagatgcattttccatttcggtaaaacccgcaacgctatctagttataaatgatcataatcatgcatgagaaataattctcacaaattgttttgatacattttatgaacgataatacagtcataaacataaaactttcatgcactgttaaatgtacataaaagagcagcttgagattcaataggaagtttataactacattatgcgtatatggcgagatgtgtatatatgtgtacttgtgtgtaaaattatgttatgtaatggtgttgtatgttagtgtatatatttctcaaacactggattttgctgtgtaaatccctaatcatcagaatatattaatgataggcagtccgacattaataaaagtcagataaaaagctttcctatcttagaccttgtcaaaacatttctgtcttatttcatttcctataggtcctctttcaaaagggcttctgtcaaaaagctattgattatcaataacctgtggcattatcaaagttgtgtttcaataaatgtcaatatggattgcagaacaatggataagatttcatgaagcacctagaagtagtaaagtattgatatgtggccttacgtatcactacaatagttagaaacataagctgtctgtgcattattaaatgcatagctgcaataattatgaggaagaaaataaatcataatctccctagttttgtaatttctcatcgtctaattttctgagaacttgggtgactggtgctgcatagacatatcactttgggggacatatttggaaatacaaaacaaaaaaaaattgattaaaaatatcaaattgatgtcttctgattaggttcaaacatgagaaagcatgtatacactctcacagtattatggtagctctgagaatcaagaagaggagatgttttttgctagaggaaagagtgaattacacattaaaacaacagaacagaagaagaatattttcctagtttatttgaagcattttaaaaacatcctactgtctaccgttctttttttatgtatttttattattattattatactttaagttttagggtacatgtgcacaatgtgaaggttagttacatatgtatacacgtgccatgctagtgcgctgcacccactaactcgtcatctagcattaggtatatcacccaatgctatccctcccccctccccccaccccacaacagtccccagactgtgatgttccccttcctgtgtccatgtctactgttcttgtagttatttcctggccaccaaatttctgtgaaaagtcctacttttctgtggaagagatgctggatgaatgaactctaaacctcgactgagactacagaacgtgctccatacttctctatacttaaaaaagccagtgtgcactaatatggggcaaagggctgttaaaatgtgaaataattcttcacctggtggtaagtagatgctgccctccttgccctccccaccccagcatccacagccctgtgcactgatttcctgggcctcccttatccatcaagttcagaattggtttcctgttccagagccccttaggactgaagagtgatggtacctagcagctctccccaaatcccccaaagacctctgccctaagagagctcctctgagggagtgcccaccagcctgagacacctgatgaagttcctcctccgtactgccatccccacgtgctaaccccactgggtacccatcagactccagccgaaagaaacagaactctgggtgatggtgcggcacctggcaggcaaatgcccaggtgcttttgggcaccaatcccaggccttgggaacttgcttccggctgggctcttcaagtcgccctcacatggccacttgtggaaactgcagaattaatggacactggacctgaagagtgcctgcggtagacaaaaatagcaggtagctctaaaggctgttaagtaatctgaacatcacccttagatacatcaaccttccctggtgttgcaactgaaagaggcaatataaacacagagtatgattcacttctatcaaccagatatagccagaaggtctccccttgtgatgtggcaaaagtgatgtgccctttttttttttttttttttcttgagacggagtctcgctctgacgcccaggctagagtgcagtggcgcgacctcggctcactgcaagctccgcctcccgggttcacgccattctcctgcctcagcctcccaaatagctgggactacaagcacccaccaccacccctggctaattttttttgtatttttagtagagatggggtttcaccttgttagccagatgtgacctttttttaagcccaaatttataaatgagggcatattcagtcgattccacaccacctccaacacacagacatacaaaaaatgtacaaagattacaacaaatgactctttcataaaagggcaaaatttatctaagggtatagtcaactgcaggaaaaaaatcagatcattcattaaattcttacagatatcaggagatttctctaaagaggctgaagaatgtccataacatttttaaattgaagagagaatcaagtcatacattttctaagagtttatttatggggaaaacctattctagcaaaagttatacacttaaaaataaagcatccctcctggagagctatatacattaatatatgtttatgacgatacttgcttttagatgaagctgattggtccagtggccgatgactttgtactctgtgcttttgttggttatttgatactggaagatatcataacgtccaggagcatctccgttttcattaaaagtgacaggagtgccagcactgcctataaagatttagaaaacaatgttaataaagttttagtaagatagcccactgggtttatttttcttttagaaggaatggtagataaaaatatattgtgtgaagtaagtgatgcaaagattgcaatccatacaaggtcattcttgatagcataatatcttttacatgaaaaagaagcccagacatacacacacgagtaagacgtgctttattgtacatattagaaagtaaatgatgagtatccaagttaagcaatgcacataacagctaaataaataaaagttgataggctgaatattcaatactggctacatagtatgatagttaatagagaaaaatgtaaatgttttgaagcatgacagctattgtacaatacgaactacaaacagcaattcaaaatatggcaggagaactttctggccagaatcctgagttttgctttttccaaactctctaaagcagttagagagcaccgttcctgtgcctctgctacctctgcccaagagtatatcaatgtggtctactgttgggaacctctcaatgggtgaggcattgatctatgggaagtcccaactctgcccagatcatgattgttctcccccttcacagtgacaggtctaacagtggcagagcagcagggtgcaagaactgtagtcttttctaaactccattcctctcggaagttttcatcttttctcttaatagtttctgctcacttttattttccctcttattaacttttatgtaattacaggggaagagtagaaatggatcaccaccccaatgtcttcttgttccatctagcttcactatctatacagactttccttttctctaacagcttttaggcttctctacatttttttattattattattctttcctgtcttgaaaaattcacctgacaccaatcccttttcttggtgtctgtcttccctctgcaggccttttatctgactctcttctcacaggatattggatttaatttctaaactgtgctagagggtttccccttcttgttatctctgtctcatactgtattctccaaaagtatacataactaatagttatatacgtcaactgtacatattcccatcttataatgagcttcttattctatctgtagagttgtttacctaattaccagccatcacaaaattgtaaaatatttaacttatcaaacaaatcgatgactttatcaaaaaaacacagtaacctgtaaataaatgtaatcagagtcacataacaacaatgtgaatacttttccagtaattaatggacagatgtctaatattctgttttcttgattcttcctaaaaatctaaacatggtgtaagttctctgatgagactacagacatctggtatcatcaggaactgctgaggctgcaagagatggcaccgcatggaagaaagagctctgctcccggaactggaagttccatgtccaggctcactccattccccattgatttccacaacttgtgtatgtcccttttccttcacttaccacacagacttaacaataaatatgaataaattttgaagtcctaaaagagctgtaaatatgtacattattattactattattattaattcacatgagaaatgactttatatataaattgatagatgtacattactcagggaataaaataagagctctccaatcaagcagtactatcttagctactccttatatatggaagtagaacctatttgccaaacctgaccaaaacctttctcagctcctagtgacctcgagcaggttaacctcttaaatcctcagtttcttcacctgtaaaatgggagtaataatgatacttttctcatagagttgttgtgagaattaaataatcaacacttgtcaagtgcttagaacagtgcatggggataaattattcactgcacatttactttcagtacacaccaacacatagtaatagaaaggatgttgaaagttctctaagtgatggctagacaaaagattattgaaattcaaatgaggaagatatttctggctggaaaaacacgtatgttgagaatttcacattaacatgatcaacttctgacatttatatatcactttgaaatattttaattacatattctctcctcaataaagggatacttaattttctctacttaaaatctcccaagttgtcaactccttgactcaatgactccttatcttctacaacagcagttcccaatcttttttacaataacagtacctaagatgaaataatgtaatttgtataacacattaccatgaatataccctaagttatacataattcctaatgtgttagctgtttctatatccaagtcaagaaagcctctcaagagagctcattagagagccacattgtcacaaaatataataatttccaacttagatactttgaatatcattattaaaatcaagttacactaaatttgacattgtattaaggtgcaatattctaaagcagttataagtgtgggttctggagacagatcattgggttcaaacgcccctctgtcacttattgatgtggtgtcttgaatgcatttcttaatttccctatatctcacatttctcagttatatagtgggctaatagcaattcccacctcagagggatatataaggattaaatgaatcaatatatataaaacatttagtacatcatattacgtattaactataatttcttttgttgttttgtggaaatgttgtgtttgagagccactgtctatatgagaacatataaactcagtgagcgtataagttttcctgatgtcactctcactaatctctgatctctttcaacacaatgccacctatacctaaaattccggtccctaaattcattatgctctgtctcaccattctgtctttgctcaggctattttctctaatttcccattctctttcctccttacccctctctatataattccttcaagatgaggctcaagggtcatgcacttacagaagcttaatcttactccaaccctggggaaggtgcccaaccacctctttatgtcctaacatgcaatatcgaagcactcgcaacattccacagacttactatccattctgtacctgaccaaacatttattgcacagatacttttttagagcctattatgtgctcaacactgggtggaccctctgcaatcttcacaaaactatggtcttcttaagaaaggcaaaagtatctattatctttgtaagcactgcagcaaagacagtgttcagtactgagcaagtaatcaataaattataggaaagcatgaaagaggcatcccctaatgatcccaagcaaatccatgcttccctcttcatgacattatgaacttcatgtatattttctgtcatcttttatattcacaaacggagagaccaaataaatcctctcactttgttattaatgtgacattagaaaccacggggaaactttgacatatctgtgaatgggctctgagttaatcaccagtagctgaagtggtttttattactgatgacccttgcatcttgttttcctaatgcgatttctagtcttaaattaggcttgcagttgaattacttcaaccctttttcaggaagaactgattccattacatattgactcatttcaaatgactgccatggaactctggtcaatgtagaaagagcatcgttgagtagccataaggaactaactcattagctgtttaataattcctacaagtttgccatcttttaaaaatgtcattgtttgtactgaaactggccactctgagaaacagaattaagtggcgaattttttttttgtccacaaaaaaatttcaaatgacaaatgtctgttaatatagtcattaatttatcaaggtttaataacaacacaggtaagaaatataactttgacagagtggggttccaagatggccaaataagaacagctccagtctacagctcccagtgtgagcgacgcagaagacgggtgatttctgcatttccaactgaggtaccaggttcatctcactggggcttgtcggacagtgtggacaggacagtgggtgcagcccaccgagtgtgagccaaagcagggcgaggcatcgcctcacccggaaagtgcaaggggtcagggaattccctttcctagccaagggaatgggtgacagacggcacctggaaaatcaggtcactcccaccttaatactgcgcttttccaacggtcttagcaaacggcacaccaggagattatatcccacacctggctcagagggtcccatgcccacggagcctcactcattgctagcacagcagactgagatccaactgcaaggcagcagcgaggctgggggaggggcacacgccattgctgaggcttgagtaggtaaacaaagcagcccggattccctcaaactgggtggaacctactgcagctcaaggaggtctgcctgcctctgtagactccacctctgggggcagggcatagccaaacaaaaggcagcagacctctgcagacttaaatgtccctgtctgacagctttgaagagagtagtggttctcccagcacggagtttgagatctgagaacggacagactgccttctcaagtaggtccctgacctccaagtagcctaactgggaggcacctcccagtaggggcagactaacacctcacacggccgggtacccttctgagacgaaacttccagaggaacggtcaggcagcatcgtttgctgttcagcaatattcactactctgcagcctccactgctgatacccaagcaaacagggtctggagtggacctccagcaaactccaacagacctgcagctgagggtcctgactgttagaaggaaactaacagacagaaaggacatccacaccaaaaccacatctgtacatcaccatcatcaaagaccaaaggcagataaaaaccacaaagatggggaaaaaacagagctgaaaagctgaaaattctaaaaatcagagcacctctccccctccaaaggaacgcagctcctcaccagcaatggaacaaagctggatggagaatgactttgacaagctgagagaaggcttcagatgatcaaacttctctgagctaaaggaggaagttcgaacccaatgcaaagaagttaaaaaccttgaaaaaagattagacaaatggctaactagaataaccagtgtagagaagtccttaaatgacctgatggagctgaaaactatggcacgagaaatacgtgatgaatgcacaagcttcagtagctgatttgatcaactggaagaaagggtatcagtgattgaagatcaaatgaatgcaatgaagcgagaacagaagtttagagaaaaaagagtaaaaaggaaagaacaaagcctctaagaaatacgggactatgtgaaaagaccaaatctacgtctgattggtgtacctgaaagtgacagggagaatggaaccaagttggaaaacactctgcaggatattatccaggagaacttccccaacctagcaaggcaggacaacattcaaattcaggaaatacagagaacaccacaaagatactcctcgagaagagcaactccaagacacataattgtcagattcaccaaagttgaaatgagggaaaaaatgttaagggcagccagagagaaatgtagggttacccacaaagggaaaccaattagactaatagcagatctctcggcagaaactctacaagccagaagagagtgggggccaatattcaacattcttaaagaaaagaattttcaacccagaatttcatatccagccaaactaagcttcataagtgaaggagaaataaaatcctttagagacaagcaaatgctgagagattttgtcaccaccaggcctgccctacaagagctcctgaaggaagcactaaacatggaaaggaacaaccagtaccagccactgcaaaaacatgccaaattgtaaagaccatcaaggctaggaagaaacagcatcaactattaagcaaaataaccagctaacatcataatgacaggatcaaattcacatataacaatattaaccttaaatataaatgggctaaatgctccaattaaaagacacagactggcaaattggataaagagtcaagactgatcagagtgctgtattcaggagacccatctcacgtgcagagacacacataggctcaaaataaagggatggaggaagatctaccaagcaaatggaaaacaaaaaaaggcgggggttgcaatcctagtctctgatgaaacagactttaaaccaacaaagatcaaaagagacaaagaaggccattacataatggtaaagggatcaattcaacaagaagagctaactatcttaaatatatatgcacccaatacaggagcacccagattcataaagcaagtacttagagacctacaaagagacttagactcccacacaataataatgggagactttaacaccccactgtcaacattagacagatcaacgagacagaaagttaacaaggatatccaggaattgaactcagctctgcacaaagcagacctaatagacatctacagaactctccaccccaaatcaacagaatatacattcttctcagcaccacatcacacttattccaaaattgaccacatacttggaagtaaagcactcctcagcaaatgtaaaagaacagaaattataacaaactatctctcagaccacagtgcaatcaaactacaactcaggattaagaatctcactcaaaactgctcaactacatggaaactgaacaacctgctcctgaatgactactgggtacataacgaaatgaagtcagaaataaagacgttctttgaaaccaatgagaacaaagacacaacataacagaatctctgggacacatttaaagcagtgtgtagagggaaatttatagcacgaaatgcccacaagagaaagcaggacagatctaaaatcgacaccctaacatcacaattaaaagaactagagaagcaagagcaaacacattcaaaagctagcagaaggcaagaaataactaagatcagagcagaactgaaggagatagagacacaaaaaaactcttcaaaaaatcaatgaatccaggagctggtttttgaaaagatcaacaaaattgatagaccgctagcaagactaataaagaagaaaagagggaagaatcaaataaacgcaataaaaaatgataaaggggatatcaccaccaatcccacagaaatacaaactaccatcagagaatactataaacaccactgcggaaataaactagaaaatctagaagaaatggaaaaattcctcgacacatacaccctcccaagactaaaccaagaagaacttgaatccctgaacagaccaataacaggctctgaaattgaggcaataattaatagcctaccaaccaaaaaaagtccaggaccagacggattcagagccaaattctaccagaggtacaatgaggagctggtaccattccttctgaaaatattccaatcaatagaaaaagagggaatcctccctaactcattttatgaggccagcattatcctgataccaaagcctggcagagacacaaccaaaaaagacaattttagaccaatatccctgatgaacatcgctgtgaaaattctcaataaaatactggcaaaccaaatccagaagcacatcaaaaagtttatccaccatgatcaagttggcttcatcccagggatgcaaggctggttcaacatacgaaaatcaataaacgtaatccagcatataaacagaaccaaagacaaaagccacatgattatctcaatagatgaagaaaaggcctttgacaaaattcatctgcctttcatgctaaaaactctcagtaaattaggtattgatgggatgtatctcaaaataataagagctatttatgacaaacccacagccaatatcatactgaatgggcaaaaactggaagcattccctttgaaaactggcacaagacagagatgccctctctcaccactcctatgcaacatagtgttggaagttctggccagggcaatcaggcaggagaaagaaataaagggtattcaattaggaaaagaggaagtcaaattgtccctgtttgcagatgacatgattgtatatttagaaaaccccactgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccatttacaattgcttcaaagagaataaaatacctaggaatccaacttacaagggatgtgaaggaactcttcaaggagaactacaaaccactgctcaacaaaataaaagaggatacaaacaaatggaagaacattccatcctcatggatgggaagaaaatatcatgaaaatggccatactgcccaaggtaatttatagattcaatgccatccccatcaagctaccaatgactttcttcacagaattggaaaaaactactttaaggttaatatggaaccaaaaatagagccctcattgccaagacaatcctaagccaaaagaacaaagctggaggcatcacgctacctgacttcaaattatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctcaaactggatcccttccttacaccttatacaaaaattaattcaagatggattaaagacttaaatgttagacctaaaaccataaaaaccctagaagaaaacctgggcaataccattcacgacataggcatgggcatggacttcatgtctaaaacaccaaaagcaatggcaacaaaagtcaaaattgacaaatgggatctaattaaactaaggagcttctacacagcgaaagaaactaccatcagagtgaacaggcaacctacagaaggggagaaaatttttaccatctactcatctgacaaagggctaatatccacaatctacaaagaactcaaacaaatttacaagaaaaaaacaaccccatcaacaagtgcgcaaaggatatgaacagacacttctcaaaagaagacatttatgcagccaacagacacatgaaaaaatgctcatcatcactggccatcagagaaatgcaaatcaaaaccacaatgagataccatctgacaccagttagaatggcgatcattaaaaagtcaggaaacaacaggtgatggagaggatgtggagaaacaggaacacttttacactgttgttgggactgtaaactagttcaaccattgtggaagacagtgtggtgattcctcaaggatctagaactagaaacaccatttgacccagccatcccattactgggtatatacccaaaggattataaattatgctgctataaaggcacttgcacacgtatgtttattgcggcactattcacagtagcaaagacttggaactaacccaaatgtccatcagtgatagactggattaagaaaatgtggcacatatacaccacggagtactatgcagtcataaaaaatgatgagttcatgtcctttgtagggacatggatgaagctggaaatcatcgttctcagcaaactaccccaagaacaaaaaaccaaacaccgcatgttctcactcacaggtgggaattgaacagtgagaacacatggacacaggaaggggaacatcacacactggggcctgttgtggggtgagggaagtggggagggaaagcattaagagatataccgacaagttaatgggtacagcacaccaacatggcacatgtatacacatgtaacaaacctgcacgttgtgcacatgtaccctagaacttaaagtataataagaaaaaaggaaaaaaaagaaatgctatttacattaaaaaaagaaatataacaaatatatttgattaagcaatattcacacatattttacatgataaattatgctcacattttcctgttttatttctctccatcctatacgttaggtatttcagaaattttgatgtgtattaattttgtttttgaggagggtggtggaaagggtctccctctgtcactcaggctggaactcggtggtgtcatcttggctcactgcaacatctgcctcctaggatcgagggatcctccaaccttggcctcctgagtagctgggatcacaggcctgtgccaccatgcccagctaatttttgtaatttttggtagacatagggttttgcatgctgcccaggctggtcttgaactcctggggtcaagcaatcctccctccttggcctcccaaaatgccagaattacaggcatgaataaatgtgcccagccaaaagtggattaattttttaaaatggttttcacactgggtgcagtggctcatactttgggaatctgaggtaggaggatctcttcaggccaggagttcaagaccagcctgggcaacacagtgagacccccatctctaccaaaagataaattagccaggcatggtggcatgcacctgtactcctcattactcaggaggctggggtagaaacatcgcttgagaccaggagcttgaggttacagtgaactagaattgcgctactgcactccaactccaggtgacagagcaagatgctgtcttaaaacaaacttttccatccacatgtgctagtgcagaaatggaaacaaacaacatggagttgtgaggtaatgtttactcatcaggtgctacccttagatgtcacacatctccttgaatattttctgttcaataagaaatgtgtgaaaaagtatatttttattcgtaggcatctcaagcactccaacatggttttgtagggaaaatgatatattcaatgaaggttttttttttcaaatgttggctcttttgaatattgcgcaggggaagaatatgggcttgggatgcagggactagagtctgctttctggctctaccaattatccgtgtgatctgagtaagttaccctccttaagcctgttttctcatctgccaagcaggcataataaccccaaccttcctaaactgttgcatgagatgacagtgtatatgactggtacacaatagatgtgcaatgaacgcaaacactcatcatcttccattcctttggctgcacttatgcccccttagtatacattttcttgtttacaccatgcaaaacacaatgtaaaaataatgcattcacctttatgtgcaaaaattatacatctctttgttagtgcaatcctctcagttttttgtcaagtttattcttccctgctcccctcatgctaccaaaaccttattttcctgatcatcactgcctaaactattggaaaagcaggaaaaaaataagaaagctagaaatgaaatgggttaatttagtaatttttagcacccttaaataaagaataaatatgtgagatttgtcattgaccaaaatgccataggaagtagcaattttcaacagtgtctcaattattcatgctctctttccttatccaatttactttactaagtatttattacacttaaatagattcacatatttgaattaaaatcatatagttttattatttaggaacttgattactcttacatgtatcaattactcaccccagttctctgaagcctttagcatgtgacttactgtattctcctccaaccacatttctgttatctctttggtggtagtataatttactcaacactcaacatcctggctgcagagttagacttacttatttccaattaccttttttgtttgtttgtttgtctgtttgtttgatttgagatgaagtcttgtctctgtcctccaggctggagtgaagtggctccatctcggctcactgcaacctccgcctcccaggttcaagtgattctcctgtctaagcttcctgagtagctgggattacaggcatgtgccaccatgcctggccaatttttgtagttttagtagagacagggtttcaccatgttggcaaggctggtctttaactcctgacctcaggtgatccacccacctctgcctcccaaagtgctgggattacaggtgtgagacatcatgcctggccccaatcaccatttaaaaaaaaaaaatcattcacgcatcttgacacatactatcatagtcactctctggaaattgtcttgtctagtaaccatatcatctccaaaagtttcctctttggacaccaccttccatcctcactgcaacaattctatgatttcctacacttcccaattcattaatcaccctgttttgtcacactgcttcgctcccatgatagtgactcttctctcctattcctagacatgttctatgatctttctagggaataccctctattctcttgcgcttctctctgtccagtgaattgctctatcaaaatcacagtcattgtacaattaaattcaattgtacatcttctttgcctgcacccaagaagctgaacattgtttaataaaatgataaaattttattgtctgacaagaccaggactaggctgaggcaaatgagatgcccagggcatgactccgagagggaatctatctccctgaattttgcatgctaggtgcctcacttcctttaccttgtccctgctgtctggtcttactttaaattcataccctcagatttcacatggacaatcagcattgctctgcaatcctatcacactttcccagttggcccatttccccctcgcttctaggtaatatttgactgtttcatgacttattctcatccctcacatatccaacaccttccttcccctgtcattccggcttgcttcatacgtttccactgagaaaagacagcaatacaaaaacttcctcatcattccaccacaaaatctaccgcctacctgtatccacactcatattctcccatccctcctgatgcaacacatatcccaggtccaatcaaaggaatgtcctcccttggtgctggggccccatcactctcaccttccatgcactttcagttcagttatcttttctttcttttacataaacaaatttagacttttggcagaagtatccccatcaatttacaaatcagttctaatagctctcaagaagaaagcaactaaaatccgttactctatccccacagactcattcagctactgcttcatttttcactcccttcatggtaaaattgtgttcattttctccactttcttatttctcttttactctttgacacattttaagttaaaatttaacctcattcctccactgatgagtctcaaatttatatgtctagccctgaatgcagacttttccaattatctgtatctccacgttattgtttgataattatctcagacacaatgcttgattcttacatatttccaaacatgttcttcagacagtcatctccgcttagtaagcagcttactgtccaaccattcaatcaattcaaaacctaatttaatacccacatctatagcaacacacaggactaaatcttaatgtaaactaagttaataatgatgtatcatactgatccattagctttcatacatgtaccacattcatacaagatgttaacggttgggggagctatgtgtgtgtggaggggtgtaatatagaaattgtgctctatgttcagattttttgtaaatgtaaattattttcttaaaaagtctaaatttttttaatggtgacattaattttaatatactttatgtaaactaacatatgaaaaatatcacatcaaaatataatcaatatagaaatattgaggtactttatgcacttatttcctaagtcttcaaaatcttatgtatactttatactacagcttatcacaattcagattagccctgtttcaactgctcaacacccacatggttagtgctgaccagattaaaacaacacaggtctaaaaggcagataatttcagcagccactgctccctcgctccaacactccattcactggggatgaaggcccactgctgagcctttctcatctggcctcctcttcaactggactgaaccccccttcaatcatttcttccctaaatgtatgtggaccaaccaaagactgacgtatggctcagtggatgccagatctggagaccagatcctaaaataaaatctaaacttctccagaggtaaaaataaacaaggcccatatctaggccaggcatggtggcatacacctgtaattccagccacttaagaggctgagttgggaggatggcttgagcccgggaggtggaagctgcagtgagctgtgatagcaccactgcactccagcctgggtgacagagagagaacctgtccccaccccctgctcaaaaaagcttacatctaatgcatggacaggttctatcttcagaacgtatctagaatttgcccattctttttaccccctcttgcattaaccttgtcttggctactataacctctccctgaactcttagcaggtatcctgcattcacactgaacaacaacaatccactctctaccctacagtcagaatgtcaatgaaacacaaatcaaataatatccctcttcttgatatccttcaatggcttcccatttcacttagaataaaactcaaaggcttatcatggcctttaagtctcttatttatctgatcttgctcattttctgtactccttccaacctggtcttctttctgtttgcaagcacatgaaggttgctctctctcagggattttctgttttctcttcccagtgttcttcccgacttgatcttctgactggcttctttcattactcgtatcccacccaaaatatcaagagaggcttgtcggatcaccatatctaatttagcctgatttctatccctgtcattcactattacacacattattgccttcatagtacttttaaatatctaaaaatatttggtttgtttaactgatcgatataaatcgctggatgatatgcctgtgattgtggaaaatatttctatcacattctccaccatatatatagctcagactattggatgaggatccaaataaatattatctttttcctgggcacatagctaggctacccttttccagtcttccttgcacttaggcatggccaaattattagttcagacaatcaattgtgagcacacgtgatatgcactacataggagggcattaaaaccccctaagtggtcttctatggtcttttctcttcctagctggctagaatgaaaatgttatgctggacactttgagcatctgcatgttaaaaacgacagaacttacattaggctggattccagcgtgagtgcatgaatatccgtgctactaacctgttaatccaccattcctttagcataattgtgtgagtataaaacaaacttctattctgtttgagtcattacaggttgtcagtctatttcttccagcagacacccataacatccaaatatctagtgagttctcaatgaatagttattaaatgaataagtgaaatcatattaagtctggaaataaatgtttcacttcatgtcacattataaagcttcaagaatagtgtagagtgagtatcagacactggcatggattaataacttgtttcagattgtccttaagagttaatactcattacttcaatgtggatatatataatataaggtggacttgagaaagtgtaatcattcttcagaattgcactggataagtatccatgtttatttaccttggctaaaatacacaattcgtttccataaaaaccaaatatagaagtattaaaaatgtgtgcccaattttaggttgaaaatggctttaactgttttggtgtgttaaaaaaaaaaagacacgacaagaaatgtagttgaatagcatttctaattctctgaaccaactcttcttcttgatctatcaaaaaactgagataacagtaatttctcctgtggaaatgtcttcatgatccttggataaaatgtgctttaaggttgcaaagtgtcattgtcattaatgaatagcactatttgagaaacagaaatagaccctataattgcatttatagtactcaaataagctgattcaacttttaaaataggaaaagacccattattctgtgatatgcatctcagggaagcagatgaattaggaggtttaaataaaatctcttgtaagaaaagtaaccacagagactattaaaatatcaaatgtttggctaaaggaaataaataaaaaagaacatataataattaggcaagattaggtaatatatcttaaaatgaatgtgagaacaaaccaaaatacgttacaataccctgaatctaatatattttcattctgtaacagaaatcctcttttcatcttatgtacttgaagccctttattattttttctggggtacattaaatactttacatataaaaatgtgtatatatgacttccattataaaaaggactttgctttattaatcattgtatctctaatagtgatgattacatatatgagagaagtgtgtgtgtgtgtgtgtgtgtgtgtgtgtacatatggtccaaccttttcaaatttgctgtactaggaaaaggtctttcatcaactagtccattgtgttggtggaaaaagaaagattctctttccatctggatttacaagagtcacatttatcagtctttataatgatgctctcatggcttgtataagaatctcttttgtacccccaagtctaaaagttattagtttacattttttactaagagtttttaaattatgctgttgatattttcatttaatatacctgtagttgacatccctaccatagtaggtaagggatatgaggtagaaatacaatttcactttttttctatattggtagccattttttcagttctttttgttgaataataccctatttcctactggctggagcaatgcttctattttatatctaagatctgtaaatggatcttgttctggcctatcctgttgcattcaccatttgtccatccttgacacaataccaatggtcaatataaattactaaagttttataataagacaaagcagtatgacaagtttcctatttttctttcttagaagtgttctaccttctctttgctttatacttctccatataaaatgtagaacaatctggctggcatgttggctcatgcctgtaatcctagcatttggggaggctcaggcaggaggatcgcttgaccccaggagtttgaaaccagcctgggcaacaaagtgagaccttgtctcaattaaaatatttttaaaatgtagaaccgtcttaataatttccatgaacaacactgtatagattatcactggagaatttataaaatctgtaaatcaattgggaaagatttaatatctttatattgtcttcctaaccatgtgtattgcttgcttccattatttagaccttctcttataagtcttaaaacagttatataattttcttttcatagcacctaaccatttttgtacatttattcctagataatattatctgatactattgttaatgtttcttaaactacattatctattactttgctgttagtatacaaaatgcagctaactttttctgtatcagtcttatagctagctcagtggttgaggtgattttgtccctcacaggatatttggcacaatgtctggagatatttttgataatcccaactgggaaggtgatgttattggcaactagtggaagaggtcaaagatgctactaaacatcccacaaggcacaggacagtgtcctacagcagtaaattatccaaaatgtcagtagtttcatgtttcagaaaccgttgcaaattcttttattatacctaataattgatctctagattttttatttctatggaaagcatcaagttttctgcaaatatttatatttttatgtctcccttaacagttcttgtagcttaaatatttttttcttcttttcttattgtactatctaggaccttcagtacaatgctaataagaagtggcaatagtgaacacctttgcattttttttaactttaaaagaatgcctcccatattccccagttagtatcatattcatttaggccttttatgtgcacttttcatcagtttaagaaagtccctcatattctaaatgaactaatatttttattatgaatatattttaaatgttagcaatcttttttcctttaatctgttaccataatgaattatatttctatatttctaaatgttgcattatggaaacatggagtgaacacaacttgatttcaataatttgcatttttattcactattggattcgatctgctaatgttttgtttagaatgtttacattcatacttatgagtgagaaggatctgtaatttttgtttcttataatgttcttcttgtttgggtatcaggttatactgacctcaaagaataaatgggaaagtagtccctctttttcttttctttttttttgttcgagacacagcctcgctctgtcgcccaggctggagtgcagtggcgtgatctcagctcactgcgacctccacctcccaggtagttcaagagattctcctgcctcagcctcctgagtagctgggattacaggcgtgtgccaccatgcccagctaatttttgtatttttagtagagacagggtttcactgtgttgccaggatggtctcgatctcctgatctcgtgaaccgcctacctcagcctcccaaagtgctaggattacaggcgtgagccactgtgcccagcctagtccctcttttcctattgcctgcaaatgtttgagtaaacttgtaataatatctttcttgaaagttttgtatagctcaactggaattgccctaaatgcccacaggatagtgaacaaatcaatcatggtatatggtaaattcatacaatggaatattatactgcagtcaaaatggatgaactacagagatggccacaaatatagataaatctcagcaatatattaaatgaaaaaagtaagtatacaaaatacattttataaatgtgtaacaattacttaaaattttttcattcattttgagaaagatgcaagacaaatgtattttaaaaggcaaaggagtgttgttagttattcaggaggaatgagaatgggttggtaatttaaatacatgtttaaatatagctttttgtcaaaatactagcttttggggacataagagtgttttcatagatgcatattacatttttaaataactaactaaataaatgaaagtcactttgcatggatcaatgataactatgtgtcataagccaaacagccaataaatagaggaaaaaaaagcagaagagggaggaggaggaaaaaaggagaggaagggataatgaaagagtgagggaaggaaatgaaaggtagaaataataaatcaaataacaaacattaaaaaaatggggaaaatccacactaaaactatggaaaagaaaggtatactaaacaacaattctttaactttcgtgtaactctgtgaattaactgactgctacttaggcttgctattgtgcccatggagaatatgaatcctccccggaggtcaatgaacccagacaaaataggtcacatacagaattgcctttacccaattctctaaagcagcttttctgcacatttttagattttacatcagtcaaccttctgtctgttatttccggtttataaactataactgtgtgggattagaatcgcattacatttttaagccaaaaagcttaattcattttttttcactttgtacactttttaaagagtaaaatcaggcagaaagtcacctcttcccagttgagtcattatttcacttcttgttaagtttcaaattgttcttttatcttgggttatgcatgcctttgtaataatttattgtttgaataaggtatagtctttcaatgcatttaacaattaatattttcttaatgtttgcagaattacagtgagccaatcaaatacacaggactttataggaacagatgcctaagtgtctaaagaaataaaaaaaatatcaaactaggagagatctactcatctctgacaataatttatggatttaacttaaaaagatagcagataatttatttataatggacctgattttctgtaattacatgaactgtcaatgaatattaggccactgtgatagatgtgaattgtctatgttactatggtgatttgaggtgtttctattctacactgcacgcataacaatgtggagcataattaaaagacatagtgaaatatattttaaaattgctgtcaattaaaaagcaaaacatagtctgactttagcataatcctttcagaagctggcctatcaaactgatgaaaacaataattattagttaatatattgtcttttcaaatgtatctaaaacatttacaaaaatgattattttctgccaaaatgaaatgctagcaatcatgattttgaaatcttagttcatattctctgaccattatgtgataaaacatgaaattcttaacaaaagccttaaaaaattaaaaagttaacacaacaccaaataagaaaaaaacaatagcctccaaagatttagaacaaaaaactaagcacttattttaattaattagtcaaagaaaaaattaaaattaaaatcatagagtgctatttaacagataacaatatatcaaaatacctaaagaatgtgaccaaggctgtcatcagaggaaaatttagagaataaaaagttttattgaccaggaagaaattgaatccctgactagaccaataacaagtctgaaactgaggcagtaataaataggctaccaaccacaaaaagtccaggaccagacatattagcaactgaattggtatctaccagaggtacaaagaagagctggtaccattcctactgacactattccaaaaaattgaaaaggttggattcctctctaagtcgttaaatgaggccagcatcttcctaataccaaaacctagcagagatacaacaacaaaaaacttcaggccaatatccttgatgaacatcaatggaaaaacgctcaacaaaatactagcaaactgaatccagcagcacacacaaaagtttatccaggatgatcaagtagacttcatccccgagatgcaagggtggttcaacatatacaagtcaacaaatgtgattcatcatgtacacagaactaaagataaaaatcatatgattatctcaatggatgcagaaaaggcctttgataaaattcaacatccttcatgttaaaaactctcaataaactaggtattgaaggaacatgcctcaaaataataagagccatagactacaaacccacacagccaatatcatattgaatgggcaaaagctgaaagcattccccttgaaagctggcacaagacaaggatgccctctcttaccattcctactcaacacagtattagaagttctagccagggcaatcaggcaaaataaaaaaataaagggtattcaaataggaagagaggaagtcaaattatctttgtttgtagatgacatgatcctatatctagcatagaaaaccctataatctgtctaaaagattcttatgttgataaaccactactgcaaagtctcatgatacaaaatcaatgtgcaaaaatcactagcatttctatacaccaacaggcaagccaagagccaaatcatgtatgaactccctttcacaactgccacaaaaataataaaacacctaggaatatagctaacaagggaagtgaaggacctcttcaaggagaactacaaaccactgcccaaagaaatcagagatgacacaaacaaacggaaactcatttcataatcatggataggaagaatcaatatcgtaaaaatggccatactgcccaaagcaatttatagattcaatgctattcccattaaactaccaatgatattcttcacagaatcagaaaaaaactatcttaaaattgatattaaaaacaaaaaaaaactcgcataggcaagacaatcgtaagaaaaaggaacaaacctggaggcatcatgcaacctgacttcaaactatactacaaggctacagtaaccagatagcacggtactggtacaaaaacaggcacgtagaccaatataacgaatagagactcagaaataaaaccacacatttacaaccatcttatctttgacaaacctgacaaaaacaagcaatggcagaaggactcccgatttaataaatggtgctgggagaactggctagccatatgcagaaaattgaaactggatcccttttttacaccttatacaaaaattaactcaagatggattaaagacttaaatgtaaaacccaaaactataaatccctagaagaaaatctaggcaataccattcaggacataggcatgggcaaagattttgtgatgaaatcatcaaaagcaattgcaacaaaaggaaaaattgacaaattggatctaattatactaaagagcttctgcacagcaaacaaaactatcatcagagcaaacagacaacccacagaatgggagaaaatttttgcaatctatccatctgacaaaggtctgatagccagaatctacaagaaacttaagcaaatttataagaaaaaaacaaacaagtccattaataagtgggcaaagaatagaaacagatacttctaaagaaaagacctatgtgcagccaacaaacatatgaaagaaagctcaacatcactgatcattagagaaatgcaaatcaaaaccacaatgagataccacctcatgccagtcagaatggcgactattaaaaagtcaagaaacaacagatgcttgtgaggttgtggaggaacaggaacacttttacactgttggtgggaatgtaaattaatttacccactgtggaagacagtttggcaattcctcaaagatttaaaaccagaaataccatttgacccagcaatcctattattcagtatatacccaaaggaatataaattattctattacaaagatacctgcacacatatgttcactgcaacactattcacaataaaaaagtcatgcaatcaacctaagtacccatcaataagagactggataaagaaaatgtggtacatatacaccatggaatactatgcagccctaaaaaggaacaagataatgtcccttgcagggacatggatggagctggaagccattatcctcagcaaactaatgcaggaacagaatatcaaatactgcatgttcttacttataggtaggagctgaatgatgggcacctatggagacatgggggaacaacacacactggggcctgtcagatggtagaggataggaggagcgagagcatgatatagagacacgtttttttaaagttaagcaccaaaattagattatttttgttagtaaagtgtaaactaatctaatttttcctctttattattttatttcctgtaataatcattttatttttattaaaaatacattaaaaatatttgctttgaatataggaaatatggaagacctggaagaataaaataagaaaagttatattttggtaaacaatacacatcgtatcaatggctaatatatgcaaattttagcagatagaagtagctctcagaatctgctgaccacaatgctttcccccataaagtggagaagaaatgtggaagagcctagttccattaccctggttctgtaaaaaacaaacaaacaaacaaaaaacaaattacagttcaccagtgagtccagttcaagttggccagacttgaactgagaagaacactaataatattcatgtagtttcatctaaaagatgttagtaccagaaaataaaaaggaaatgtgtgtgttcaacaattgatgagcgctagcatcaatgctcctgaagatcttgatgttattcgctcttggtctgtgtctatagatagatataagctacttggagcacttggatgacaaaatctttttgattaaaatgaaaacaattgttgtgctaaaacaaatgatcgaaacagttttcatgacactgatattcttatatcatttaatcttaaatgttgaagacctttaaatagttaaaaacatatctgtttttttgaaaagcactaggaattaaatccatgtccaaaaatacaattttttgtatgttaaaataacctctttcactaaataactatttggtacatatagaatgttcatattaatctatttatatgtaccatataaatattatatgtaccatataaataactatttggtacatatagaatgtaaaaattgaaagaatttaagtccctattttataattaattccatttagttttaatgctaattaagagagaacactctatttctcatatttttagtatatcacaagtatatgaaaaaatgcctattttatcttaaaacagctatgctttcaatgtaattttatagattttattagtatattagttatcttttacagaagataaactacatagaatttagtttaaattaggaataaatttcttggcttcatttaaaaggagaaggaggttattattcatgatcattagaggaaatatcctattgccattttaaagttcttttatatggaaacacactgaattaaaaagtgaaggaattaagattgattagaagtgttttaaagtggcttttagatgtatctgcaaaaataaaaagtcagttctatcccaggccattatcagctgtcttgttaagtgcccctagcattctcatattgaagtcctgcagtgccacataaaataagtcctggggaagatctgaccccaccttgtgaatttctctgggctttgccttatttccccttctcattcatcaactgaatgggtttcctgaccccacaggcaagtgaaacttggtttctcactttccttgtttcctttgcatttcaaaacttagctctagactattcaatctcaatgttatcttaaacccctatagtatctggggtttgctcatattttctactggctgcaagctcaaaattggtgtaccagagcgctttctaacatagcccagtcctccaacacacctagaaacacacctgcctaccttctccccctggccttcctgccttccttcctccccccacctttcagggagattgtacattttcatcatctccactgaaatgattactaatattatcaaatgattattgggtccttatttgcagacgttatgagtatatggaaatataagtctagcctttacttaagacaatacctgagattttagtgattttatctccaaagcagtgatgttaatgtttacttttaatgatgaaatgttaaataatctccatgagggtcatgactagacaaccatccaaagagagaagggtctagcagtagaaagagcagaggctttagactcaaacctgccatcactgtgagatcctgagacaccatccctgtgcgtgttccctcctcttacgggggtgaaagtcacccacatcatagactgggctggagaattaaatgactaaacatttacaaaagtgctatatgttgtcaataattgttagtctccctccctcagtgccatgtctatgaaagtagaataagtcaataattttgttcagcccaataactaattaattcaaaaagctaattttatctttccttgcccattgatttgatcaagagtataaaaaataaacaagttgacatttcattttcttcaacatgaattcccgtttgaaaagagttaatgccttatagctatttatgctcatattggtgactaatatcaactttctgtatttcccactatatttggctaattgaaaaatttatcaactgaatccaactaactctaaaaatatatattaattaagaacattaaactcatacgaccctttactttgagtattgttgccttctgttgaggcctaactttatagagttttaatgcagttatttgttcctgagaataaaattaaaatttgggtacatcacaaaatgtattctttcagaaatataatttttacaccacatgctctgaggagtttttttttaatttctgttatgagtctcatatttttgaactacctctccctaagaactctggtacattactggaattagcatcagtaggcaaaattccctatccaaatgcataacacaggtggcatacctgttctttatcttacttgggagaggaaacctgatcccttgctttgtgctgactgctactcagatcacagacacacttgttaaaggactataatgtgattcagctcaaccattaatttatgagataataaatttaccactttattcaaacaatattagatttcctaaatacacacaagcatttacacatcataaattcaccactaaaaccacaaacattcttgtactagaaagttgatattacaggtaaatggggctggcatttcacatatatgtattttttcaattcataaggggatgttttacacattccaaaatgtctgaaaagaaaataaaaatattctttagaatttttatgaagctatatttttcttcctttgaaattgctaaatgctttatgcattctgatttaaatgccttttggaattgggatttctgaagtttatagatgcatttacctttatgactaaaaatctctcagaaacttatataaaatacatattttgtatttttaaattatgagaacagcataggagaatagtgtatataatatgtaaagttattccctggggtccagagaggcttggtttctaggcctcccatggataccaaaatccaaggacactcaagttcccgatataaaatggcatataacctatgtacatcctcctgtatattttaaattaactctaaattacttatacctaatacaaggtaaatattatgtaaatagctgttccactgtattgtataggtaataatgacaataaaaaagtctgtacatgttcaatacaaatgcaattttttaaaaaatattttccatccatggttttttgaatctacagatgcagaatccatggataccaacgatacaaaagaagattctgcaacccccttttatctgaaggaaaaacaaaatcagagaccatacttctagtttttttttctgtcatctgaaagcttgtaggaattcatctaagtctgtaggttatctcattagttaatttgttcttataccctaactaaattcaaacacaaaataggaatttttataaaaataacaaaagcacagtaattgaaagtgcctttaataaactggatgccttgtgacattttatctttcaataatatacaacttatttatatttatttaggttcttttttcattttatttaacttttgttgcatggatttctaaagttcttcatcatctcaatagcaatgatgttattaaaatagctacgccacatttaaggataatttgtaatgttaccttataagaacaaatgatcaaattatctcattggagaggaggaaaaaaataacactttattggcccattgtcaagttcattgattgtatatcaacaaaagaaaactattatctgagggccaatatccaattaaatatgctagcatgcatgtgaaaatgcattatccaggagagaataattaattcaaagctcgaaggagtcatgacaccagaaatctatttttgaaatagtcatacaatttgggtgcgagggaaggatatgataagcaaaaaaagaaaataaaagaaaaccatattgctttaactgtacagaatcatataaataaaaatgactaaggaacaaaaataaggactcttgttctggagatgagtagtagtgatggttgttcaacaaggtgaatgcacttcacatcacgaaactcaaaaataattaaaatgacatattctgttatgtatattttactgtaatttaaaaaaaagaagttaaataaataaataaataatggttctggatatttccagataacaaaccaccaaaaagcaaatacaaaaatggcttagacatcgttgctctgttgaaagatacttatttctccttgcacaaaatattacagtgtagaacattaatgtctccctgaaacatgtggctagaaaagaagcattagcctgttgtgtaggccaaatttaatttgagtaattatgttcttgctacctcgaagtcccttgaagtctctcataatctgtgtcccttctatgcttaatctatttacagcagtctgtggcctttcgagtaatcattaccatctgcccctaaggtagctgcatttcagcagaagggatcatgatttctgtattttagaagtacccaacatgaacaattattcccctgaaggtagatgatacaaatatatacgagatcacctgtgaaataaatgaaaaatcttcataaaaatgggtcatttttagtagtgataatattaatttcccattcctcctatctcctgaagtttgtttaaactgacacttttccatgatgaaggtatatttcgaaaataaataaataaataaaagcattatataccacacttttctgtaacatgggtgtgatatgatttttttaaataatacatttatatttttaaaataaacttttatcaggtgctaaaatatattttttgtttagttttgtaaactgggttgcctaagtaccactgattaattttaataacacttcttctttccctcattgtgtttctagaaagagccaactctatccacaaaaagaaggggagcatcttgtatgacatagaagcctccagataccttcctactgctctggcacaaggcagagaaattcccactattagcataactatttggattaaccacaagattatgtgtaaaatgcaaaagaattattgctttgggaagttaacccactaatttgttcatatattagcacagacaactttatctgttaaataactcaatgcaggattctgatgggatggggcatatagacaagtaggtttatttagaaaggcagcctagagtactggaaggggatgctgggtggacatgtattgtaggtcagccagaagtcactagagaatggaatggagtaccatagagagggccagcaggataaaaagcaattgtcaagtataaatcactaggatgtacctaagataacattcgcctgtgatgtaacttagtctatcttgcttcttaggtgtatttatagaaggtagggcactacagaacaagtcagaaacatcccagtctagacaccctggagccactcattctctccctgaatatactataccaggttcttcaccaagtaatttctgtaagttgtcccatgtatctttcctttgactgtgggcccagtttcactggccttctgggcaccccactgccacttctgtactctacttcaacctcactgcattttccacctcacgtgccactgaatctcaccacacaatctactctagccacgtggtccactggagctacacgctggcttccccagggacatccactctcccaaaattgctcaagcacttcaaacaacctaaaatgcgtatctgtcttttcttctgctatgaaactctgaatcttctttcaagtgcttgtccagatgccacttccttggcatgctcttttcctgccattcggaagtaactttaacactttgcttgcatctctctttagggcatctattttattttgcatggaagtgcatctactgaccacatagtacatatgaggtcacaaattgtaagaggtaaggatgtatcctcccatcccctggcatagtgccttacccaaagcagatgcttaacaaccatttattaaatttatttccagcagtgtggggtccaaaggcccaaagggggagttatttgagagtgcaaaggggcaaatagaagggacatgaagacaattccataggcttatctctcggcttctttgtacctttctgatagttttcttaattttcagtctcattacattagtaggggtcataacagtgctggaagccagtctccagcaggactagctcattctggagtcacagccaagcaagaagaggcaaagttaggacatttcttccctgcaagcctaggaagggtattgtttcaaaaagcaaaaagtgaaattacactaaactaaagtagcatgacaaagattaaaataggggacaacaatattgggattaatactgatcacgattaaatgaataatgtagcaatacctggattttcattagccagttctggcagtaataattttgtgttcagcagactcagaagctgtggtgtgaatgagactaacaactaagcactctctagttggatgatgtgaagaatcatttaccacatcttgctgaagaacattacaggttataaaaatgtcatctagaccatgcagacaagcccatctgtatttaaggctgaattcctttgaaataaaagcactccatgtggttcaaatgggtctgtgatttcaaatgtcagaaaactcttaacacataaccagaacacacagaccataatagggcaatcgaaggaatgtgagatatgaaatctttccaatagtctcacttagagcctaactcatcaaaagagtccattttatacataaagataaaagagaatgttttaagaattttataacatatcaatataattaatcagaacctatgatagcctttagtgcaattaatggctggagttctagttcatgaggtgttaagaaggagaggtcaagatatttatgattgtcattggataccatatgccacgtgtgggagagagggaggtggagtgttttatgagaataaactagaataactaaggataaaatattatttcaaactgagggaaaacaaagctagtttattttctagaattatatcaatgagctagattgatgtttgagatgaaatcaactactttaatacctatgcatattgatttatgtataaaactatgcatttatatattgatttatgtataaaagtatgcatttatattatcaatctctctctctgtcagtatggacaaagaatatatattagggtgggtgcatatatattttctgcagtttttgagcctagaggaaatcaggagtaaagctgtctggttggatttcttgacaacgtatgtctactcccctccttccatccctgtcattttctgaaactagagtagttgttctggaccttccccccctcctacccaatcttccttcttcctttctgctctctccctgtctcctgatttcactttctttatttcaggtgtatacaggtgggaaagctcatgagaagagcgtccctatctgaattatattttgctacccttcttgccatatcaaacccaaaataactgaaagaacatactgctcggtaatatgtcattaaaaagtgaattacctctaaccaagagggtgtttaattatctagtgtgaatcaatatattctactattattagcactttttaaagaaaattggtataaatgcaccataaaatgtcataatcacttgctttatacactactactttggtcactgacaaaagcctgcatagttaacatcagcttatatttcattttgaatcatattcttcaagagctctgttagcaatgggaatactttactttttaaaagtttctcttgcctatatttatgtgctctctttgtccccagtgcaatggtctgtgactattcaataaaatcttttaaactgaccatctactgttctgaacccaaaacaaagaaaaagtctgcaaatctgtgggataaatttaggttggcttaagctctagaataacacatacttttagtccaataaaaagaaactcactatgagtaagcgtcagtgacttcaagaagcttacctttatttggtaagaaagacacaaatactattaatcaaaataaagaaaaaaatagtatgtgacatggagtaagcatggtgcagagtggcccttgggggagaaagagcaagatcatttctgctgagcacatgagaaagcttctttgagaaactattcactgttttgttccagctaccatatggagaagctttcttacattattccatttaatcctcacatccctgacaagtagggagttttactatttcatgatgagaaaaataaagcttagaaaaattcattaatttagtgaaaaaaattacccatggccactaatccacaggcctctttctacaccactacatgatcttgcagcagagactggagggtgggtgggatttggaaaggtaaaatgggcagagtagacaacatcagctgaggcacaaaggtatgaggatccaaagcacatgtctcttgtggcaaaattgttcttttttatctgaaaaaaagaaaacttctccacactttaacctcctgtcttccagttacacctcattggcaagactgtcatgggagctcctctaactagaacttgggtgggcacactgctatcccaaagtaaattagactgtattcagccatacaaaatgagtagatattgggtaggcactagcatcgtctgtcataaagggtcagccacataggaagcactgaataaatggtagctcttcattattgttactatatctcattagtctaaagaacacatttcctacacacaaacatttcttaatgagtatatattttacagtggttgtgaggagcacattgcacaactcggctttgtgctgaaggtatttgatgctcatccctgtgtcactttcactggaagcaccacacatcattagactttacatttttatttctaattgtgatttaaaatgtcatcaaaaaagatgatactgtaggccaggggcggtggttcacgcctgtaatcccagcactttgggaggctgaggcgggcagatcacaaggtcaggagatcaagaccatcctggctaacacggtgaaaccccatctctactaaaaataccaaaaacattagccgggagtgctggcggacgcctgtagtcccagctacttgggaggctaaggcgggagaatagtgtgaacctgggaggcagatcttgcagtgagccgagatcatgccactgccctccagcctgggtgacagagcgagactccatctaaaaaaaataataataataacaataataataataatgctgtaatacaacattcaagcaaagggttgttacaccaaatacgatagagatagagttgaagaaagcagatttcctttaagaggcagtgttgctagtggtcaaaaacacacttgctggaatcagaagcttccgatctagttcttccactcaagagccaggtgattctggggaagttactttctctcctgtttcttatccataaaatgggggtgacaatagggtaagtgtaaggattacatgagttaatattaatgagtgccaacaattgtgtttggcacataggaagtgcttaataaatgttaactatcattgttagtaataatgttggaagcaggccaggtgcagtggctcaagcctataatcccagcatgttgggagggtgaggagggtggattgtttgagcataggaatttgagaccagcctgggcaacatggcaagacccgtctctaccaaaatacaaaaaaatggctgggcatggtgaagcatgcctgtggtcccagctacttgggaggctgaggtagaaagatggcttgagccccatggggcagaagtttcagtgagctgagattgtgccactgtactccagcatgggtgacagagtgagaacttgtctcaaaaaaaaaaaaaaaaaaaaaaaaaaaaaatatatatatatatatatatatatatatatatatatagtttgaagcaatgatcactgtaggtaaaaaaaaaaaatgtgtattatcatgttataaatccaacatcaagtggtttccaatttttaagaaagaatatatacacatataattaaaaccttgtgtatatttatatgtgtgtatatgtccatgtatatgtatagctattaaatttaaaaaatcacctaatatgcatgcgaaaggataattaaaagcaacagaatttgtcaaatatcctggaatatcataggattttaaaaactacgagaagttccagagatccactgtgtttaattaaagactaaaactcaattactgtcaaaaacttccagctgatgttcaagaaaaactgtttaatatccagcagtatctacttctattatggaaaatttaaaactaggaattcaacaaaataggaaatgccaacaaaacctggtattcttccctatgcttcaacattattctgtcaaagctaaggcaagtgaagaggtcaagatcagaagcacaggctttggaaagtcactcaacagtgggtcaccgaaggtcgtgcagaatgcacagactatatatatgataaaggcttagactgaacttttgatcatgatacagaagagtctagtcaaataaaatcatttgaataaatgtatgaaaaagtgggtttggttaaaaggaaatcatgtacatttaatgtagagtttcgtcttttgcagaaatatgcttctaaagtcgatggtgaatcttacattagatggtatcttggatctatgttgtgattccaaaatttgtccttcagtgctaactgtgaatcaatcagtccaaactttatttgtggaatgaagtttaatattaaaatatatcgtattttcaaatttaaacataaagtttgaatcataaatgcctcatgtcaacagcggcctcatactttactcataaatattccctctttcattataatttggttgggtttttgaaaggaatgtagacaaagtgtgagaactcacatcatcccttggcttttatgctttaagatctaattttcaaggcttaaatatgtctgatgccgtgaccatatggcagtgttttccatggatagaaatgatacatccccaaggacagaagtcatgctgcaaaagaggatggttttcctcctattgaaaattagtctattcaatcaaaatctcatgaaaacattggctagttttctgtgtatagctcgcacttcacttaccagactgttgcctaaatcttccctattctggaagactgtatatacagtgcaagtattatatgatataaccaatttccaaatgctttctaattcccacagtggggaaagaacaactggcaacacagtgaattatttcagtttaacagctgattatcaagacaaataactggatattgtctgcagtgacaaccatgaccagggtccagggaaccacactcagaaaaggtcataatagataaccattttcccaaaaggaagaattattctctgtgaggatactaatgtctccctgttctgagttctgttcagtctacagtccattctctacactctccccagtgttattgaaactgcctttgcaaaatcatgatagcaagagaagtccgacagtgttgacgccatcttacttctgacctctgaggtgtccttggtcattcccgggcataggccaagctaacttttgaaggaatttagtttatagtttaacttgaaagctaggacgatactagtctccccttaaaactaaccctttccttgctcagggaccaaaaaccacctttgttagactaataaaaggccacaagaataggattatgggaggaacctgaactcttctgagatgtaggcatagtttctctaatctcttactgctctggagtcatgtggccagaagtcacaagatctctgacttctccaattgctcctatagataacatcattattgtagaacctaagattggtttttgagtactttttcagatgaatcccaccaaaacttgtgactcatgactcaactggccccatggccccacccagaggaagactcagcacacaaaggctgttttccacacccctatgattttattcccaaccaatcaacagcatcaattccctagccccctgcccaccaaacagtccataaaaaccctagcctccaagctattagggaggttgagtgatagctccagttctcccacatgggctgaactcatgtcagttaaactctatactgcaatagcaccatctcaattgattaattttgtctatgcagtgaacaggaagaacccattgagtgaccacattacaagtttaaaatgtttttctggtgagggaaagagaaataaaacatggcttgtctgattagtactaagtagtacttcaacttcatgatcattagtattcaaaagacttcaacactgcctgggaatctcactagatttcttagccatctggctctctctcactcggctcaacaaatagtgcccctcttctacctcctactaaatctcagtttccatttgccttttgcctcagctgatgaacttaccctatattttaccagggaaaatagaagtcatacaccatagcccctacttttattccacaactgaattttcaaggtcttttactcaccccctccctctctgtctctagagctgaagtagagagaaagtgttacattaagggtcaatcccactgcactctggtcatcatccctccacatgcccaggggcctctattcacaagttattatgtcttactgctttcttaacctcttcttccctgccaacacttaacctatctgcattcaaatgcagattggtttactttaggattaaaggaagaagtgacttcagggtggaagagagagaagaagaaaaggaagagagaaggagggaaagaaggaaggaaggaaggaaggaaggaaggaaggaaggaaggaaagaaggaaggaaggaagaaaggaaggaaggaagttcctttgataccctgatccttcttcagctaccaccgtatctttctacttttcttttcagccaaaggtctcaaaaaagttacctaaaagactatctccactcactaacccatcttccttcatccttcatccctctgtaatttcctccctctctcagcattgaaacttccatttcaaaggctacaaattgtgtccatgttgccaaaccaggagaggcttatcagttcttcctcacaatggcctctcagctgtgtgataccacccacatgcttaagagaaggcattctgcaggcttaggtaagtctgaatccaaggctcaccacacactggatttatctataaacttttaaacctcctcatcaataaaatgaggatagcaattattttcctccattggctttttgtagtgattaaatgatataatccatgtaaagtgcttaatcttgtacttggcacatagcaaagattctacagttgtcagtttttatagctggtaatactcttggtgttattcttctgtaattgttctctcatgttgcatttcattaaacaacactctccagaggaagagagatggttgtcccatttcctgcatacagtggccagggctggtgctatatttactttgagccatcatgattttgcccaggggtggcagcaatgttgtctttctcagatgacttttagggggtgattctagggccttgttcccagtgggtaatgctggaaggtctgcaaacttcacagtatcttttaataaatctcctttaggagccaagcacagtggtgcatgcgtgcagtcccagctactcaggaagtgaggtgggaagattgcttgagccccacagcttaaggccagcctatgcaacacagcaagacccccctaaatcaacaaatgtataagcacatttattgtgaaggatttagggggatcttgctctctacataaatagatggatagatagatagatagatagatagatagatagatagatagatagatagatatagatatagatagatataaatagatatataaatatatctatttatatatctatatatcttacgagttaaatttgccatatttggcttttattgcttgcaatgaaaaattctagtcaaatatctaactcagcctattcccttcttcaaatttcagattcatatattcaactacgcccctgacattccaactcagatatttcatagccatcacaaattaaaaaatgcagaaatgaactatcaagctccctctcctccattccaaaccacttgcctcttagcatatggaaacaccatccagagttgcttacatgaagaatctggagccatcattgaaagctctctctttatacattttccaagtggtcagttttgcctcaaaatacacttcaaatttgtccactcatttctctctgcatttgttaccaccttaagttgaatcaccattatctcacaaatgcaccgaaacatctgcttgtaaaatgtctcacccttttcccatgttgttctcttccaatgcattttcttcatagcaaactaaatttctagaaacaaaatcatgtaattaccttaatcaaaattcttcaatggtgtgccattgtacattggaagaaatccaaagtttttactatcacttccaaaacaatgaacaatttagattctggctagctccttagctgcatcatatgtgccatctcacattcaattctccaggatcctacctcatttcacctccttaaaaccgataggcttttctgttttgggacctttgcacaagctgtttactctgccaggaaggtgctgcccacctgatctgacctcattgcaaacttcagagagacctttttatcctgtcagtgtcaccaaagagtccttattacactctctcaagccatcccctatatacctatcatagttcacagaaatcactgatttttaatgtgattattatctatcctccctatctgtctgattttcattaaaattgtcattttagtaaaaattttctgattttcataagaaatgacaattgttctattttatctatctctagtattttatgcctaatgtagtgccaggtacacagagttgctgttcaaaaatatctgttcaatgtttgaattaattattttcaatcacaacacccatgattcctctgtggtctgtagtagttttctttgtgcagtgtctgtcacagctctaaagagaagggtaagaacaatagaactgtctaacaggacagattcattagctgagattcaaaaccaaaaggcaaatctggctaatttctcagatgactggatgcatttatgcttttggatcagggatgacatttgctgatagataccaacaagttgcatatctagaaactccattatctgaaacatacacacaaactcaaacagaaaaatttactatgatttaaatatctttaaatgaacaaatgctgaacgacactgatattaagacctatttattagagcaatataatccttagatgaagaatatagggaaacaccatattcccaccatatttactggagtagttatctttacttctgtggcatccctacagtgatgatataatttggagacttcatttgccagtcatttacgaaatggctgtgagaagaaagtctcatgatcatagactcacttttagaagctatgttagcttggtgcatttcttagtcaagtacatcacactatcttaatctatgtctaaaaaatgtggatcccaaatgtgaattatctattataaatgtgataacagagacaaaggagggagatccacttaagagggtatgatggttaataccgagtgtcaacttgattggattgaaggatgcaaggtattgactctgggtgggtctgtgagggtgttgccaaaggagattaacattgaatcagtgggctgtgaaaggcagacccacccttaatatgggtggccaccatctaatcagctgccagcacagccagaatataaagcaggcagaaaaacatgaaaagactagactggcttagcctcccagcctacatctttctcccatgctggatgcttcctgtcctcaaatatcggactccaagttcttcagctttgggactcagactggcttccttgcttctcagcttgcagagagcctgttgagggacattgtgattgtgtgagttaatactctttaataaactgtcttttatatatatatctatcctattagttctgtccctccagagaaccttgactaatacagattttggtacctggagtggagtcagtagagacattccttctaaggtgaaggataagttgctgcatttggcccctcctacaaccaagaaagaggcacagcgcctaatgggcctatttgatttggaggcaatacattcctcagttggatgtgttactttggcccatttatcgagtgacccaaaaggctgccagttttgagtggtgtccagaacaggagaaggctctgcaacaggtacaggctgctgtgcaagctgctctgccacttgggccatatgacccaggagatccaatggtgcctgaggtatcaggagaagatacggattgtatttggagcctttggcaggctcccacaggtgaatcacagcagaggcctctaggattttggaacaaggctctgccatctcctgcagataactactctccttttgagagatagctcttgtcccgttactgggctttggtggaaactgaatatttgactatgggtcatcaagtcaccacgtctgcctatcacttgaactgcctatcatgaactgggtgctttctgacccacctactcacaaagtgggtcatgtccacagcattccatcatcaaatggaagtagtatatatgtgattgggtttgagcaggtcctgaagttatatgaggaaatggctcaaatgcccatggtccccagtcctgccaccctgccttctctcacccagcctgcaccaatggcctcatggggagttccctataatcagttgacagaggaagagaagaccagggcctcgttcacagatggttctgcacaatatgcaggcaccacccaaaagaggacagctgtagcattatagcccctttctaggatatccctgaaggacagcagtgaagggaaatcttcccctgtgggcagaacttcaagcagtgcatctggatgtgcactttgcatggaaggagaaatggccagatgtgtgattatatactgattgatgggctgtagccagtggtttggctggatggtcagggacttggaagaagcatgattggaaaattggcaacaaagaaatttggggaagagttatgtgaatagacctctctgagtggtcaaaaactctgaagatatttgtatcccaagtgagcgctcaccaacaggtgacttcagcagaggaggattttaataatcaagtggacaggataacccattcaatggataccactcagcctctttccccagccacccccgtcatcacccaatgggcccataaacaaagtggccattgtggcagggatggaggttacgcatgggctcagcaacatggacttccactcaccaaggctgacctagctacagccactgctgagtgcccgatttgccagaagcagagactgatgctgagccctcaatatggcaccattccttgaggtgatcagccatctacctggtggcaggttgattatattggacctgttccatcacggaaagggcagaggtttgtcctcactggaatagacatgtactccagatatgagtttgcctgtcctgcacacaatgcttctgccaagactaccatccatggactcacagaatgcccggtccactgtcatggtatcccacacagcattgcctctgaccaaggcactcactttgtggccaaagaagtgtggcagtgggctcatgctcatggaattcactggtcttaccatgttccccatcatcctgaagcagctggattgacagaatggcagaatggccttttgaagtcacaattaaaatgccaactaggtgacaatactttgcagggctggggcaaagtcctctggaaggctgtgtatgctctgaatcggcgtcctatatatggtactgtttctcccatagccaagattcactggtccaggaatcaaggggtggaagtcgaagtggcagcactcaccatcacccttagtgatccaccagcaaaatttttgcttcctggtaccgcgacattatgttctgctcgcctagaggtcttagttccagagggaggaatgctgccaccaggaaacacaacaataattccattaaactggatgttaagattgccacctggacactttgggctcctcctacctttaagtcaacaggctaagaagggagttacagtgttagctggggtgactgacccagactatcaagatgaaatcagtctactgctccacaatgaaggtaaagaagagtatgcatggaatacagtagatcaattgcggcgtctcttagtattaccatgccctgtgattcaggtcaatgggaaactacaacagcccaatccaggcaggactacaaatggccaagacccttcaggaatgaaggtttgggtgactccaccaggaaaaaaccatgacctgctggggtgcttgctgaaggcaaagggaatacagaatgggtagaaggtagtcatcaataccagctacgaccatgtgaccagttgcagaaacgaggactgtaattgtcatgagtatttcctccttcttttggtaaaaccatgtttgtgtatgtatacacctgtactaaggaaatatgttcattttatttcctttttcttttaacatgtgacatcagatttacttcatattagcgtttaagtatcgttagctttatgtaatagcatttgggttggggattggtgcatttctggttgtacgaaggatagctgcattatgttacgtgtaattatgaccttattattgtctttatttgaagataatgtgtgatctcagatgcgtatgggttcaagtcgacaaggcgtagacttacaatgattaatactgagtgtcaacttgattggattgaaggatgcaacatattgatactgggtgtgtctgtgagggtgttgccaaaggagactaacatttgagtaagtggactgggaaaggcagacctaccttcatctgggtgacaaagagggtgacaaagaaatcatctggtgggcaccatctaatcagctgccagcatggccagaatataaagcaggcagaaaaatgtgaaaagactagactggcttagcctccaatcctacatctttctcccatgctggatgcttcctgccctcgaacatgagactccaagttcttcagctttggggctcaaactggcttccttgcttctcaacttgcagacagcctattgtgggacctttgattgtgtgagttaattccttaataaactcccctttatatatgtatatatatcctattagttacatcactctaaagaaccctgaccaatacagaaggcttacactctttattctaacaggcttaaggctaactctatatgtctccttcccaatgtcaggaatctctgtagcttagaggaacagttttcctcagtgacatatgtaactcagtgattagtcacaggaacactgacctcatcacaataaaatagggatctccctattttaagatccccctaaggaataaagagctatgcactttagggaaaactctataaaacgtgtgagaatcaaaagagttcaaaaatggccaaaaccagccaggcaagatagtgagaatacatgtctacagaaacattttttaaatagcaaggtgtgttggtacatgcctgtagtcccaactattagggaggctgaggtggaggatcacttgatcccaggagtttgaggctgcagtgagctacgattgccactgcactccatcctgggtgacagagtgagatcctgtctccaaaaaaaaaaaaaaaaggcaaggagagggtgatccttactaaaacaggcaattcaatattcaattagggggattcattcaaaccatttatttcacagaaatggccaaataagtggccttgttaataagaagataaaaccctttcctttttgcattaaaataactgattttgtctcaaattatattaaataaggtaactacaacagaaataagaagaaaattacattgattgtatagacaagaattagtttctgaaagcacataaacctttacagaaaatacgcttactttatcaaagtggttcagttttcagctgcttctatggcttacaacaaaaaagggattctgttacatatggaaacttcaaaaatcacaaagctcaaataaaaataatagtccagggcaattaatctggaacaagaatacccatgaatactctgggtatttgttttaatgcacttcagttcaatagtgttgttttctttctcatcaaagagcaaactatatttctatttatcatcttcagaagtagtaacagagcctatcctggtaatatgcattgtggggaagaagaggatacaattgaacacaaggctatttcaaataatagaaaagatacctttaataattggcaggagatcttataacacaaactataaacaactgctggatttgaaagtcacaaaagcatagtcctagagtccatatcgtgggatcataagacagttacagctttccctagagtcaagaggaaatgtcatccattagaattcaagtgaactctctatatacccatttatagaaataactagacccctaagcagattcaggtacattcttcttattcttctacatctggccctgaattaggtgaggtgacaagtgtgatttttcagaccaactcatggtctttctggcttatggttatactgatcgcccctggtgacttgtgtgtgaacaaacctcagagcattcaaatccctgggttctgctctggctctgctagtatcctgctctgcaaacttaacctctctgggctttcatttctttatcttcaaattgaagaaaaatgtgatactttatccttaaggtcaacctctagttccaaattcttaatcagaaaaattatggcaggcttatggtctacagaattaaaatcaaagagccttgctgaggtaagcgacaacatttgcaaaggacaatgtaaggttcattttcttctagcccgaatgaattgtacccagtatttatgtggacttgaaaactataagtgtttttaataaattaaatctaaaatgaaggcatttaaaattattagcggcttatcagcatgaaacacaaagaacactgaagtgggagatttttccagtgaaactcatcattaaactttcaataacaatgtcatcatttcttttcccttctgtgatcacaccatctcccaggcacaattttaggtttaacagtcttaaaaccaggtaagactagggaagctgagcaggcaaatcaaatgattaagttttaaaaagttttataggtatttaagccttgggaaagcttaattaatgaagaatttaaaacaggagtgaaaattaaagcagtaggaaatattcaagaaaaaaattactatgccattgaaaaaattcaggaagagccacagggaactaatgcaaataatcattgactggaggaaatgtctctggcaaatgcaagaagtgacccaaagaaacagaactgagaaaatttggccagaaaagtaaaaaaagaacatacataaaatggatggtacaacattgcttttatttttcaggaagaaaatgtgattgattctgcgtaaaggtgcttttcataacttttatattgtcataaagacaataataatatccttagctcttcatattcctttgccagtctatcattcactcatgttttcaatgtaatattcagaacccactgtatcagatcatctggttgagttccataccaccatcttctctatccacttatcctatgagatcccagttgcatcccataatctttttaaatataatggaaaatttaaaacatttcatctgatatagtttgactctgtatccccacctaaatctcatctcgaattatcatccccatgtgttgagggagagatctgatgggaggtgattgcattatggtctttctctctctctctctctctctgttgctgtctctctctctcagtctcagtatctttatagcagtgttaaaacggactaataaatcatccttcttggtctcaactactggtcattcatcttaaaccatgcttatctctgatggatactatctagaaataaacacatgagatgacattttcttggatatctcattacaaacatattaggcatctgaatcagtattattgttttaatttatcaaataatgtccaaaattatgatggaaacaaaatagctggtccaaatctaaagaagatattttacttgcttaatcacaaggattatttaaaacatccacatgtggtttaactgactcccaaggtagatacatttccaaagcatgacacaagggaaagatatagcattaaaatcacattccagggtacctatatttatagaaacacacagaaaatgggctaatctttgcactttctcctattgagagaaatagatattctactcaaccctttcttcatagctggtaatgtaacataaataataaaatttatcttaaattgcctaccaatcatcaaattcagggaactgtccactgaacttttagtattggctttccatttgttggggaggggaagagtggggttacaaattatagactagaaataataacaataaaataattccaaggggcattaaatgccagagttctggggatttggagattggggtaagataactagagtaacttgctgactgtgccccacacatcctttccttctggtagtcaaaacagtgagaaatgtgaaggaggggcttaggcaaaagccagccttgacggcctggggcatcttattggcatttgaattggtgagagagctaacagtttccactcctcctcatgttattttggaagcaagacctaccaaacaggccaggcacagtggctcactcctgtaaacctagcactttgggaggccaaggcgggcggatcgcaaggtcaggagatcgagaccaacctgaccaacatggtttctactaaaaatacaaaaattagccaggtttggtggcacgtgcctgtaatcccaagctgctcaggaggctgaggcaggagaatcgcttgaacctgggaggcggaagctgcagtgagccgagattgtgccactgcactctagcctagatgacaaagcaagactctgtctcaaaaataaaaaaataaaaaaacaaaagacctaccaaacagaaccacagccactaaaagaagatcagagttaacagttggacagagaggggttatttctgcatgttggagatgcttgtgttcacagagtagctgtgtttatcattaataataataataataaaaagttatgcctctcatcagtaagcatagcctttaaaagctaggcatattcagggaaacaaattcatccacttctgacatcggttgcagggtcttacctctggcaacagattaatgcattagcaaggaacccaaatgaaaagtgcttatgtagacagcacaatggctgtgatttagtaatgttcgtacagcaatttatatttactgagtgctacaatggtttctattatttattcttcaagagaaatccatgaggtactgtcttcatttttttaggtgaggaaaataaggcatagggaaattaatatggaatcacagagatcaagtcaggttgtgcctgtacacacaaaaataaccttttagaaaggaaaaatgagcttaagttacgagatcaagtcaggttgtgcctgtacacacaaaaataaccttttagaaaggaaaaatgagcttaagttacttgcttgacattaaatattacattggtgcaaaagtaattgtggtttttaattgtggtgaaaaccgcaaatactcttgtaccaacctaatagagcagtggacactgacatattttcttagcagtaaaaacaacccccccccaaaaaagtcacatacaattccaatttacaaacaagataacaattacacagcattagtaaaccaaatataaatttctaacgtttactaattattagggcaatcaatgctttaggaacataaactttgaaatcagagggcatgtataatagttccaagcttctatcactctcagcttctgtgaatttcagaacttctgaactccagagtctgcaggctttaggaagaaagtgtttgcctaaacataacaggtcaaaagtataaattcagtaaaactactttgtttgcataaacctaatgacatagtgtgtatgctgggaatgtacttgaacctttgaattcagttgtttaattagtgagctattgtggtgggggtggagtgagtggggaaacccacagaggaggagcctccgctgagtgatttaaagcgtgcaggaaagaaggcctgtggcctgtgtatgcatagggggagctcctccctaatcctcattatagatttgtgttctctaaagccggaaacgacaaactaaaattaagtaaagagatgctaacggttatattaatttttaaagaagaaacaacagcctgcagctgatgatgtgttggctggaatggcctgagccgctgggaaagaatttaatggaactagagcttttaaaagtcatatgagttcaaaaggggaaacaggaaaaataaataaagagaagtaggcagaaagaacaggtgagattcagctgagtgaagttgatggcataacatatgctgaggccacacatttccaacaacagtccatcagccatgagctgagttatggctcccagagtcatggaaagcagttctgaacagaagctaaatgttggtgaactcaaattccaaaaagaataaagtcatgcttctccagagaccaaagagaagataaagaaaatggcctggccttatacttgagggagaaagcaaaatgatttacaaagaacagaactagtgattggaaccaatgagtaggactggatgagcagagaataggatctaaaactggcagtcttggaaggagcctaagagagcatcgaatccaagaagtttggggatgataaatgtgaggcacatgtatcacctgttatctatgtccacagtccactcaatactgcaacctggtccaagatgaatcctgtggcattgggtttatctgttaacagtttataagaagaccacattctagatcaactggagcaaaatacttcaactttttacaccagggaaccagggatgatgtatgtgctctaaggaactggaatggaggaatatactttatgtaaagaaggaagaccagaaatcccaatattagattggaaaaaaaatcctcttcgtcttctgccgggcccgcccagcagaccctggccaaatgacagatgaaaaaacgtacacagacacaggtgttttgcctggccgcgcggctaggggaccgagccactcacagacatcaaggaggatgccgtaaagagtcacagaggccgcagccttgacaagcggccgctacagtcatttattcagtacagatataaagacaaaggccttgaggcaacacacttgtaggtaattaatatggttgcgccccgccccccgccccgcccccaggttcagaggcctaagtaaactaacttaccttgatcaattctcttacacttccttgttatctactcttagagaattcagctgccttcagcccaatcctttcccaaagcttctgcaaaacctcccagccttccaggaatgtttccatctttctataatttttcccaccaccctgaccgatctcctacaatctccaaaattgtgaaatagaaaatcaagctattacaagtggcagggggaacctacctgtggtggcatttctgttaaataataatgtgtacgtgattgagctttgtaaactaaaaataactagaaaagggaagtgatgctctggagtggctttagatttgagtgtttacttcactatacatacatatttttttcctaaatacaaatatgatacgtccatttagaatatttggaaaacagaagtgaaagattttttaaagagagagagaaatattcaaccataataagccttccacttagaactgatcactgttaacaatttggtgcactacatactagtatttaattcatatgcagatctgtgccttgtttataaataaaagtgagacccttttcctttctttttacttggcaatacattgtgtgctttgccatttcattttattcttaaaacattaaagactgcattaaattctactgcttttcatcaattctctaaagttaaaaacttaggtctttgtatttccactatttcaaataaaagtgtggattgatatccttgattttgtttgcatttatttgtgtgctagtaagactaatcatttttcatgttttgggccatttacacttcttttgtatattggtttcatgttactgtccatttttttcctagagtattaagctttttaaaagacctctttacattaaatatattaatccatcctctgtcatatacatttaaaatatcattgatttgtcttatttcatttaaggtattttcttcaagaggggaggcctttagtttttatgtagctaaattttttccttcatggcttttgtttttggtgacaagttttgaaagatctctgtgctgcaactacatatacatattcagcagtagttccatttagttcttttaacgagcattgtttaaaagcgtggggactggaagccattcctaacactgaccttaatcttatgatctattctgcctccactgatctatgattaatctgatctgtgctttaatttctttatcataaaactaataagtagtactagtatttgcctcacagagcagttaaaagtagtaaactggataatctatataaagtgcaaggcataatatctggcacataataaataataaatgctagggattatttaactccctaatatctacgaacattattttagagactatgatacaaataaatctaagtttaattttctccaaatttgtgccaacactatattttgaataaaacatattgtgtctcactaattttatatgccacttctattatatactaaatgattacaggtgtttggatacatgtctacactttttattgaagtctactgatttccctggctagtaatataagtctactacaatattaaaatcagtatggctgaataatattttaattacttttagtgcaattatccgtccttaattattcttttctcagaaaatacccctgactaatcaggctgccaaaacttctggttaaagttccaagagggaattaacaaaagtatatgaaactgtcattcttataacgagcactacctttaaatattttttgggaaagtccaaggtgaacttttctgcccaaattatatttcacaccaatcacttcctagtttctgtccagtaaagtataaatgtataagggtcagtatcaactgtcaaaacaaatcaggtttttcgactgaactcattgagatagagaatagaaggttaccagagactgggaagggtagtaagagagatggcatggagaggaggtggggatggttaatgggttaaaaaaatagttagaaagaatgaataagacatagtatttgatagcacaacagggtgactatagtcaacaatgacttaatttacattttactaacattttactaaaagagtgtaatcggattgtttgtaacacaaagtgtaaacataaacacttgaacggatggatacatcatttcccatgatgtgattattatgcactgcatgcctgtatcaaaacatctcatgtaccccataagtatatatacctacaatatacctacacaaattaaaacttaaaaaaatctctttattttcttgtaaatgatctttattgaatttgaatttttatatcttctaatataaaacatatgttttaaaaaactcaggtttctaagtgtacccttgtaaaacatttaaaggccaaaaggagaatacattgtaccttctaaatcactttctaaacccagccctgggaccctcaggactccactcattacaggatgggggtcagccagcatgaatagccccggcttcattggtgatcatgaggagcaagaaaacaaacacctgaagagcctgagaatggaagcccaagtgtcagttcttccttgtagtgcctctgcactgtcgcaaatgggctgtggggagactttatgtgcctcactcagggggttcgtcatgcctccttctttgagtaggaagaggaattggaaatatacaagcatcagaagtgtgactgccatactcttcctcccaagagagcagatttaaaatccactcatagagatggaagtaaaaaagctccctaacaacttgtttcaaatcaatatgccactttaatatgagaaagttcccatgtcttcacagtggcttcacaagtggatttctgtcttgtctcatatttaatgattctataactgtgtgtgcaaagcatatgatttgatacatgactaaaaaggtattgttattaactgttaaaataccatgactacattcctactttgctcagttttaattttataataaataccttaagattttccaaattgctctaaatttacattttgtaacaggttcttcaagtttgttttgttttgttttttattttctccagggattgggaagcttaaaggaaaataagactgcaaagggatctcttaatagaaatgtataaattatgctgaagataacagaataagcaatgataaaaactgcaatttttcaaattaagtctggccaccaagtagattgggagtgtgaaaatgaaagaaaccataggaaaaaagtgtctatgacatcttaagcctcatcagagctagtgaaaggaacattagctttaatcagatgaatagaagccaggaagggaggcttcaaaaaaaagtcctaataaaggggagcatgaaaccatggctgaaactctgaaatggaagaaggctcaagaggtttattagactattcagaaagaaatttcaatttttcttctgcaaataattcagaaaacaaaaaaggtgggggcaggaaggcatatctaaagagatcaataggaatctctgatgacctcaaatttcatgaggatttgtgcaaatcatagaaggacaaatagtacagaggagaatgttcctaaacttagagtcaggaaagctcaaaaacataataagctaaggcttgaaaatgtatagacagcaagaaaaatattctattttttttttctttttaaagtgccatccagtacaacaagagtcgtaaagccaaggagcttccgttcatcacagaggaaatggattatgaaatgtttagtgttgatggatggggtgttgctctacttctcattattttctgtaatagaggacaactgtcaattaaagaatgttggtgtcaatactggcatgaagccaggcacgaagctggacagacagggatattgtaaaatgcattttctcactctgaaggaattagagactctcagccatgttcacttatgggcgaccacatgtcctcatttgtctgagatattcctagcttatgcctgcctttctggcatagctattaatagacctcctttccattttaaaagattttaagcactgagcagaccaatatcaagttccaaagttgaatcagtaataccaacaaacaaaagccctacggcagatggattcatggccaaattccaccagatagacaaagaagaactggtaccaatcctactgacgctattccaaaaaatggaggaggagggactcccctctaactcattttatgaagctagcataacccggataccaaaagctggcaaagacacaaagaaaaaagaaaactacaggccaatatccctgatgaacatagattgaaaaatcctcaacaaaatactagcaaactgaatccagcagcacatcaaaaagttaattcaccatgattaagtaggcttcatttccaagatgcaagcctggttcaacatatgcaaatcaataaatgcgattcaccacagaaacagaactttttaaaaccacatgtaatcatttcaatagatgcagaaaaagcttttgataaaatctaacaacccttcatgataaaagctttcaacaaactaggcatcaaaagaacatatctcaaaataataagagccatctatgacaaactcacagccaacatcatactgaacaggcaaaagctggatacatccccacttagaacaggaacaagacaaggatgcctgctcccaccactcctattcaacatagtactggaattcctagtcagagcaaccaggcaagaaaaagaaatcaaaggcatccaaataggaaaatacatcatcaaattatctctcttcactgacaatattattctatacctagaaaaccatctcagactccaccaaaaggctcctattctgataaatgactttagtaaagtgtccggatacaaaatcaacgtggagaaatcagtagcatttctatacaccaataatgctcaagctgagagccaaatcaagaacatgatcccatttacaatagccacacatacacacaaatctaggaatatatttaacctaggaggtgaaatatctctaaagggactacaagacactgctgaaagaaatcagagatgacacaaacaaaacaaaaaacattccatgctcatggattagaagaatcaatattgttaaaatggtcatactgcccaaagcaatctacagattcaatgctattcctatcaaattatcaatgttatctctcatagagttcgaaaaactattctaaaattcatatggaaccaaaaaagagcccaaatactcaaagcaatactaagcaaaaagaacaaagccaggggcattgcattattcaatttcaaactatactttaaggctaaagaaacaaaaacaacatggtactggtataaaaacagacacatagactaatgtaacagaataggaaacccagaaataaagtcatccaatcttcaacaaagttgacaaaaataagcaatggaaaaaaggctccctgttcaatatatggtcctgggataactggctagccatatgtggaagaatgaaactggacccctacctttcactatatacaacaaataattgaagatagattaaaaagttaaatataagacctcaaactataagaatcctagaagaaaacttaggaaatacaattctggtcattggccttgggaaaaaaaatatgagtaagtcctcaaaggcaactgcaataaaaataacaatcaataactaggacctaattcaactaaagaccctctgcacagcaaaagaaactatcaaactgcaaactacagaatgggagaaaatatttgcaaactatgcatccaacaaagttctaatatccagaatctataaggaacttaaacaattcagcaagacaattgtaaaaaccaataactccactaaacagtgggcaaaagatataaatagacacttcttaaaacacaaaagcagccaaaaaacatggaaaaatgctcaacatcattaatcatcagataaatgcaaatcaaaactacatgagataccatctcacaccagtcagaatggctattatttaaaagttaaaaataacagatgttggtaaggctgtggagaaaatacactgttggtgggaatgtaaattagttcagtcactgtggaaagcagtctggagatttctcaaagaagttacaacagagctaccaatcaacccagaaattccattactgggcagataccaaaggaacataaatcattctaccaaaaagacacatgtgcttgtatgtgcattgcaacactatttgcaatagcaaagacatggaatcaacctgggtgcctatcgacaatggactgggtaaagaaaacctaatacgtattcaccatagaatactatgcagccataaaaaagaatgaagtcatgtcctttgcagcactgtggatgcagctagaggccattatcctaagaaaattaatgcaggaacagaaaaccacatactgcatgttctcactcataagtgagaactaagcattgggtacacatggacattaagatgagaacaacagacactggggactactagaagaaggaaagaaggagggcggaagacgcaaaaatctattaggtaccatactcactaactaagtgataggatcatttacatcacaaaaccttagcatcatgcgatatacctaaacatgcacttgtactccctgaatcaaaaataaaagttgaaattatataaaatataatattaaattatataaaataaaactatctttatttgaatgacaaattatgtagtcatctttaacatatatcaacatgccaagagtactgcatgttttattgttttcaataatcttcttgataatctgaggaacagattatcaaacagatttttgtgatgactttgaaagagagaaagcaaacagaaagaggaaacatgggtttttaaagactaaattaggtgagagcctccttatttctttcttcattagggctattgcagtacatgtcatgggatttctgtagatagatcaaatatggattttaacaagacctcagacaaagatctttttgatagttagagtcaaggacggaaatatgaattgtcatacagtctgatgtattttaatgagttgaatggctattccaaatagtgttgactaatgtttactaatgagcaatgtcaactctgcccttggtactgtccttttcaatatttttatcaccaaattgtattaagacatgctgatcaaagttgtatctgatgcacggtaatagcagatattgagatgacagagtcaggatccaaaattatctcatcagactaggaaaatgtgccaagcctgaaaaattaaatttcatggggaaaaacaatttcacagggagaaacttatttttccaaagaccagttgcacaaaaataataagagaaaatatgagatgaaagaaagaacgtttttgctgattaaaaatcataattggtgaactggccacaaaagcattaatatcaacattaagaggctgatgtatcaatcctactgcgtccagcatgtcacacccaaaataacatgttccactctgggaacctcagcttaagcaagatagtggcaaactgagaaccatacaaaaaaataataggagagtaaattctaacagtgatttaaaaaaaaaagaataagaacaaaaatagtaacaacacagatttgcaatcccttatctgcagttttaaaatccaaagtgtttgaaaaccaaaaatatgtttaatttttgtcaaatcctgacctgaaatagagaaggtatctatgctctttatctatttcaacttgttgtacatataatttgctgtacatatttgcataaatattaatatacttgattatgggattctgccttatgctccattggggatattacataatatcaccagtgtatctctgtattgcctttaagaaaaacccaacaataggaatttcaaaatatagctggtctcaaggtttggagtaaaggattttgacctaatggtaataacaacaataatgataataataacagataacacaaaaatagcacttactatatgtcagacactgtcctaggaacttagcatatattaattcattcaatttttgcaataaccagagatgtatataccattattattatcctcactctacaataaagtaaactgaagcacaaagatttgcccagagccacatactaagatgctatttgaatgttaatatgatacttgaatagttgtcttcaagttgaaacattgtacgtggaagtagcaggaagcaggatgcctacaaatgtaaagcttaattggggtgtcactgtagaatgttcttaaaatattttgaagcttacagaaatacaccttgaagcaaattatttttgcttgagtagtctttctttgtaattttagaaggaaaatgtgccaattattcagggaggatcaaaacagaaaataattttgtaattgatcaaaccacaacttcctaaagctactacaatgcaaagttgaagcttcagaaggaaaagagaatgagaatctgacaatggacttccaagattcaaagctgaggagaaggtggaagggaagcacaacttcaccttaatgaaaaggaaaaagaatgatgtaggctggtgagccaggcccaagacaggtatttaaaggcaaagctgttgggcacagcttctgactagtaccaagaactgctctggatgcaaggcactgtggggagacttcgtggcacaacagctgagcatgtttgtgtgaactgaatatccacggtggtgtcaccagtgcatccagaccagcagtagcctcaccatggcagaggacaggatgcaagagcaacatgtggccacgggaagcagcaagaacagactgccatacttttgcttcgacctttatctgttgttagaagcaaaaaccacaccctgtgtggactgaatacaccagcaacctactgagacagcgaaggggtgcctggagaaactccaagcagcctgcccactggggtggagccacagaagttccagccctttgcagcggtgaggagccgggctcctcctcttcctgggtggaacctgggattccgacaacccagcgggaagtgctctagcggggattctgggcttgtgagagtccctgtttacccccctttcttccttttcatccattaaaaccctactttactcaccattcaaactgtttgtgagcctaaattttcatagccgtaggacggacaaggaccccatcgctagctgaactaaggaaaagtcctgaaacatttttggcctgcaacgtggggactcaagaagcagtgagtgaaatggggactgaaactcttactgttccttctaagcctttacatccctggacttctgagggtggagaaccatgcccccaaccccctgtctcccccaggccttttcatgccttttccttcctttttcgagacccacctgtgagcagcagctccccaccgccacccccatccctgccagcactgggacgcatggcccaagggtcctgcacagccactggctggttcgcagccaggcatgctgccgcagccttccacctccctggtcaaggggttcagctccatcagacagtaaataagcttttctcttggtggagggaccacttatctaagaataagaggttcttccccaggcatttttaaactgttcttttttctttccccttctccattctgttggcagttaacttttaaagtttttttttagatgttttactaggccaggcttcacccagcaactgggtttccttttgcctgtctgtgtattgtgtgtaatgtctgtcaaaagagctctaattattattgatggacatttgggttggttccaagactttgctattgtaaatagtgctgcaataaagataaagaaaatgtaacacatatataccatggaatactatgcagccataaaaaagaatgacatcatgtcctttgcagagacatggatgaaggtggaagccatcattctcagcaaactaacacaggaacagaaaaccaaacactgcatgttctcactcataagtgggagttgaacagcaagaacacatggacacagcaaggggaacatcacacacccgggcctgttggggagtcaggggcaaaaggaaggagggcattaggacaaatacctaatgaatgtggggcttaaaacctagataacggtttcataggtgcagcaaaccacaatggtacatgtatacctatgtaacaaacctacacattctgcacatgtatcctggaactaaagtaaaattaaaaatttttaaaaaaaagtcaacaagaaaaaaaaaagctgtaattaatttggccaaaagaaagacaattgcttggatctgatgtttttaaagggaagataaaatctatggtacctttcagttcatgtgactttaatctttaagaaataaaaacacccctaaggactattagtaaaatgcaggtcagatgcaaagttttctaagtgttgtgagtttacaaactgctttttgggttttgagaactatttgacttgctggcttcacaattggtaaggcctggggactatggaactaactatgccccttattatgctatagtcaaaccttggttgcagttagcacacaattaaagcaacttaacaagtttcaccttaaagataacaattgctggggttaccattataacaggtaattgagactactcaaaatagatttacatgcaaggggtataagaacagtaaaatgtgctttttctttgtaaaatgttataagaaggcatggaaatataaatttttgcctagggttaaaggattgttttaaattagataagagaaagccgaaggttcaaacaagtggtagaagaactggggaaattaatcttgcagaagaggttctctgggtgaacatattgactaacttcaaaaaagggtattatatggtttttctgtaaattgaacattaaaatataagaacaacaaggtattcttaaaatgctaatctgctccttaacaaaattcaaaagggttataaaaggtttttgcttctttaaaatttctgagtcattttggcaaaataaataatttatggtaatctggaattctatttcataatattaagtgctttaaacatatttaacagctttcccaaaatcaaacttcagtttcaaaattgtcttccctggcacctggttttttgaatacttcagagggcccctgaagtgtctagaaaagagaggtaaaaaggattatttgacatgtttaggtatatgagattgccaaaatgatgctcaatcttctttaggttatatcttggtggataatactaatatatgttccaaaattgtatgggatttctaaaattctaaggtctaagtatatgccataaatcataattaaggttgttatgttaagttattgtaaaacagagataacaaaacttctttgtcaattgtgtgtctaactgtaactaccctggacattttgttattcacagacgattgttgtcttgttttaatcctttcaaaagatggtttataataagctatacaactttaacaggtactttcaaatacaggcttctgataactttagagactgtaacattggaataaaggaaaaagtacaggactcataaagagctgaaatgttcatgaatgtcaagcaaaacaagagttaagtaaatggactgaactcaggaagctaaagcaaatctttttgacttttgcttggaatattgatgatccttgctttagttttttttatagtcaaggaaacttagtttgaactatttacgacctttaataattaagtgaagtatacactcctgtggtcaaaatttggagcatgtttgtttctctctgcctggttcctctagaatttggaaactatctgtcagtattcttatggcaatatagttgtttgcatcagtacaataagaatccatttttcttttgcaacaggacacaattagagaacgtagttattttaccagggttttgactggaagggtatgcttccctttaaggagtcaatcttgacttgcagagccaataaaaatctagtgggaaactggcctcatacccttgtccatgtagtccctgtacagggttcttgacctgtggtcagtaaagaatgtcactttctaacaggtccaggagctccaagtttgtcttgggaccttaagaggagaaaatcacccaactcacgggtatttgacaatacaaacccatggctgggcttggctttaaaaggtcttatctaagattccttgggaaacagagttccatgaaagccaattcaaaaggcctatgtagaaatagttattcttgctgcactttatgcaaataaccaggccaagtataagactaaagtctgttttataaatcattccatcatgatgatatttaacaaaaatgaggacttgcaagagagaaatcacgtttcaaaacttatcatatgcttgtcattaaattctaaactcaccagtcattttcaagttttcacctacattttagatcaaccctacttgttcctgtgaaccaaccactgatccccagctgcagctcagaaagaacaagagggatgggtaatgtagaaatctggatcaatagtctagttctgaacagttatcctacaaatcctgccaggtagtgggaataaataggatgcccataacccagaggtttcctttttgggaaagtaagaccaacgtagctaaccaaagctaagtgtcatccaccgaaatcccagcaagcataactatggctaccagttatctgggtgtgtcacaagacatccattcctctctcttgttggaggagaactcagctccagtttgaccttagcatttggcttatgacaaggagtccatgcgacccccgctgagacacatttttgtctgaaactcaattccaagcttcagataaaaaccctaggaaggaaaactggatctgagggatccagaggcagacaataacagaagttaaaaggcatagcacatgtgagcatggctgatttctaccgattaaaccaaccccaagctttcatgaataaaggccatgttaatatccatagcataaatgaggactaaggaactccaaggctactgacagtagcggagatagtggcataggtgagagtgggtaattcctattctctaggtcctccctgcttcatgggtgcaagtcactttgacacccatggtggcatctgccgaggtcactggaccctggggatgcaaggacagaagaggaaaagaggatgctcttccctctcttcctcatgtactgtgggtatctgctaggaaaagaaaggaaccagggatgcctgctcccctttttctagatgggtagccatttatattcactctgtacccctttagactgcatcctaaacccctgggaatcctttaaaaggcaccttctcttttctcttcctctggtctctcttcacaaataggtaatcatgtctctgtactattagacacttccctctaatgaatcctccaaactgggaaaagttaattttccaaaccttaaacttgttggctcaggatcaagctcagcgggaaaggaacccagaagcacaacatgctggcaaaagggtaaagttcctcttccagtagggcttttggcttccctctccctatgcaaactggtaaaaggccttgggatttttgagctatccttacccctccccttgtttcattttgatacatgttttctaataacgtggtgtatctgttcttactttcaagcatcaaactccaaacactcctgtaaccagagcctctcacatggccccttctactaggaacccttagataggcctctgagggtgatctgcctgctgtttccccaaaacagtgcccccttatcaggcgaaagcagttaagatagttctttgtccctatccttaatctaatggcagttagatgtatttctctagaaggtggtatgagacagccaggtgggagggggtgcctggagaaactccaagcggcctgcccactgcggtggagccatggaagttggcaccctttgcaagcagggaggagctgcggtcctcctcttcctatgtggaacctgggattcaaacaacctgtcaggaagcactctagcagggactctggccttgtgagagtccctgtttctcccttttcttccttttcccccaacaaaaccctccttactcactgttcagatgatctgcaagcctacgtttttatggctttgggacagacaaggaccctgtctttagttgaactaagggtaagtcctacaacactacttgggcaatttagggaaatactttcaagtgggagataatggatttagaggatgtatacacaggtgtcttgcaaagtggatccacttaaggtagccatgtaatgcacaatggtttgagacaaattctatgttgcctcactagaaatagactttactggagaaagaggaaacatgcaaagacaggatcaacacaccaagaacacatggattcccatcctcccactgtctttatagacaggtgtgtggggccgagtgagctgctagatacaaagtgtagcttgctatgctttttccttttagaaagcaagatcatgcttatcaaattcgtcatggtagatgctgaattttaataactgataactttttagttgttattttgagtgttttaatccctcctaatgtgttgctccaaattctaacatttaatagcatgtattaaatataaaagttaaggagatagtgggagaggtagactatatgacctctaagatactttccaactcagcgtctttagttttatgagacactctggagaagtattacatattattaatattttccctaatcttagttggcgttcgattagccttcttcactgatactgcacactgacttgagaacttaaatatatcaatatagaccttttcctcaattctattaactgattcagtacaatataaactgcactccagttgaacatcatttctacctaactcaaacactacaattcaatctcttccgattcttattccatctctcaacctgctggccagttcccatttattttctttccctactcacgccactgattccacaaaatccatactccagctctactgtactgcttactagagatttaataatccccaaatagcaactaagtagacttacagatgtctgtgttgtaacaactgaggaatataaaaggcagcgtgtttttccctagtcataatccttaaatgaagctgataacgtttactgtgaactatttgagattctttctcccctaaataagagggtacattgtcttcccttcagttggtacaccctcaaatttgaatctacagaaacactcactgtttgtgtctatactcaaagcatcttaatagcactggtttcacattaggtatcacattaataagaccactgaatgggtcaaacttaggtttctaagaaatctattatactataagaaatatactggagaaataattagttgcaggtcttggcattcaagaactcacagtataaaaataaaaaataactataatttaatgaaataagtataataaaggaaaaaagtacaattggccttcccaagaatatcatgtagcccccagaaaaaaaaagaaaaattagagtaagcaaccatggcaacaaggcaggctgctggccatttatccaaattacatagatcaatgttagctggcaatcaccgtcagatttgtacatagtaagcacaaaacctagataaggaaaaataatagggggaaaaaagaatcagaattctggtcacatttctcgttagagagctaaagtacatagacatgccataaatgtaggaatggatatgggccaaatattgatcccttcattcttcaagggctagggtgaggagaagaaaggaacttccaggcaagtcactttgtgtctcaaataatcttttatgaactgaacgttcgtgtccacccaaaactcatatgttgaaattctaaccctaaatgtaatgctatttggaggtagggcctttacaaagtacatagatcaagatatcagtagttacctttggtttgaagcaacaacattgatgcaaaccaaacattagcaacatttagattttacaggaagaaacagaaatcctgaacagaccaataacacacagcgagactgaaccagtaataccttaaaaaaaaatctccctacaaaacaaaaaccaaaatcagatggattcacagccaaattctaccatatattcaaaaagaattggtaccaatcctactgaaactatttcaaaagattgagaaggaggaatcctccctatctcattacaaagctcatatcaaactgatacctaagccaggaaaggaaataacagcaaaagagaaaactataggtcactatccctgatgaacatagatgcaaaaatcctcaacaaaatactagcaagctaaatccaatagcacatcataaaaataattcaccacgatcaagtgggtttcatcctaaggatgcagggatggttcaacaaacacaagtcagtaaatgtgattcactgcatacatagaagtactaacaaaaaccatatgatcatctcaatagatgcagaaaaatattttctaaaatccagcctccctttttggtaaaaatcttcaacaaactaggaatagaaagaacatagctcaaaataataaaagccatctatgacaaacccatagccagcataatactgaatgggcagaagttgaaaggctcacccctaagaactggaacaagatcaggatgcccactttcaccacttctgttcaacagagtgcaggaagtcctagccagagcagtcaggcaaaagaaagaagaaaggtcatccaaataggaaaagaggaactcaaactatttctgtttgctgatgatataattttatatctagaagaccctaaagactctaccaaaagactcccagatttgataaattcactgaagtctcaggttataaaaccaatgtacacaaatcagtagcactgctatacactgataacaaccaaaccaaaaacaaatcaagaacccaatcccatttattatagctacaaagaacaaatgaacctaggaatatacttaaccaagggggtgaaagatctctacaaggagactatcacatgctgctgaaataaatcacacaaacacatggaaaaacatcccatgcttatgaatgagaagaattaatattatgaaaatggccatcctgcccaaagcagtctgcagattcaatgcaattcttatcaaaataccaacataatttttcacagaactaaaaaatatcctaaaattcatgtggaaccaaaaaaagagcctgaatagccaaagaaataccaagcaaaaagaacaaaaccagaggaatcacattacctgacttcaaattatactacaaggctatagtaaccaagacagcatggtactggtataaaagtaaatacatagaacaatggaatagaatagagaactcagaaataaagccaaatacttacaaccaactgatcttctacaaagcggacaaaaacatacactagggaaaggacactctattcaataaatggtgctgggtaaattgaaagccacatgtaaaagaatgaaactggagctctatctctcactacatataaaaattaactcaaagttgattaaatacttaaatgtaacacctgaaaccaaaaagcctctagaagaaaacctaagaaaaactcttctggacattggcctaggcaatgaatttgtggctaagaccccaaaagcgaatgcaataaaaagaaataaatgaggcctaattaaactaaacagcttctgcatagcaaaataatcaacagagtaaacatacaacccacaaaatgcgagaaaatatttgcaaactatacaatgaccaaaggtctaatatccagaatctacaaggaattcaaatcagcaggaaaaaaatgataccattaaaaagtgggacatgaagagacgtttctgaaaagaagatacacaaatgaccaccaaatatatgaagaaatcttcaacatcactaatcatcagggaaatgtaaattaaaaccacaatgagataccacctattcagtcagaatggccattatttaaaaaatcaaaacacaatagatgttggcacagatgtagtgaaagggaacacttacacaccggagattggaatataaactagtacagcctctatagaaaatagcacggaaatttctcaaagaactagaagtaggtcttccattcaatctagcaatcccactactaggggcatccacccaaaaaaaaaaaaaaagccatatcaaaaagacacctgcacgcatatagttatcacagtacaattcacaattacaaagatacggactcaacctaagagcccatcaactgatgagtgtataaataaaacgtcatatatatacaccatggaatactactcagccataaaaaataatgaaataatatcttttgcagcaacttggatggaactataggctattattctaagtaactcacaaacagaaaaccaaataccacgtgttcttatttataaataggagctaagctatgggtacacaaaggcatgcagaatggtataatagacattggaggctcagaaggagttttgaggcggagaatgagggataaaaaaactacctattaggtacaacatatactatttggatgacaggtatcctaaaagccaacttcaccactatacagttcatccatgaaaccaaaaaccatttgtattcgtaaaggtattgaaataacaaattaaaacaaactaactgttcaccaagctcccacagtcgtgtaaggtcaagtccctggaacaactctcatctcctatagcagctctcactgtttcctctgatggaatcccgactgataactaggggcatggaagaggcatcctgggcactgggaacattctacttattaacctgatggtagttatgatggtgttcgcttagtgcagatcaattaagctttaaatcaatgttttgttcaattttctctatgtgtgctcaatttcacaatagatgtttttaaaactcaaaaaaataagattttatatttagtactggagtttgatcatttttctttgtaaacttcttctgaaggttaggatttacgcagatctaaaaaaagacacttccactctttacagtttattttttatatttaagacatacctggtttatgtttaatagttgataagtagatatagactagtgttcttgattcaaagaaaacaaagaataccgtggagtaatctgattctgaagtatctttggtcatgttgtaactgctgagtagctcacgtctttcatccataaaaaagccactgagtgttatatttgtgtgaagttggaaggagaaatgtgttgattctgaaacattcttttggggggcaaggagaggaaaaattacaatgaagcagaattttttaagagaaatatctttatccaaacttaaagcacttttcaaacagcagctctcctctttctgataaactaagagcacttctcagaagtactctgtcaaaaaaaattattttgtaaacagttttccattaagtggtactcagctgcctggaggacccatcttcagtgtgcttgccacttccttctttttgacagatatccaggttgcggtgacagttgcatacagtatcttaatttcaggaagagatggaattttccaaaattgactaacagtgaggagtgggaggttgctccaattaagcactcggtcctctctattgtattaaatttaaatgataaaaatattgtaactggtaatttggaaactgtttttaagtatagaaatgtctttgtctaaaactcttgtaaatcattaataagaaattaaaacatcccacttgagtacctttatctaatcccatttttccttcaagctcctcaggcttctgccaacaaagctttccattgcattgcttatttctattttgccaccattttttttcgcttgacctcccttattaattcagtaaagactgtaggccatcttccagggtatgtgctagaactacagtttaaaagatgagtaagcatagtacctcccttcaagaagcttgtggtccaatggagaatgctctgctagcccatttttaaattattgcagttcatttttacatgtctaaaattattgcatcaaatgtacatactgcaggaaatctttcccacatgtgtattttatctactattatttttggacgcatggacaaacaattcataattaaaagctagaatttcctctgatataagattttaaatgaagatacattaaaacaaaattagtacagaatttaagggctggaagaactctataaagaccttttagtataatgttcttatctaactgatggaaacactaatgcctagagagtgaaacaactttatttactcaacaaatataaatggagcatcaaccatatgccagatagtaaggtagaagctggaaatatagtgttgattaggacccacattactcagctgtaattagcaaataattaaattataataatcaccatacatgagaagtacaagatgctgaaagaacataaaatagggtgatgaaacccaatctgtagatgcaagggctatttttctcagagggtctcattaaagatggaacttaataggctgggtgtggtggctcatgcttgtaatcccagcactttgcaaggatgagatgggcagatcacttgaggtcaggagtttaagaccagcctggccaacatggcaaaaccccatctctactaaaaaatagaaaaatgagccaggccaggtggcaggcacctgtaatcctagctacccaggaggctgaggcaggaaaatcgcttgaacccaggaggtggaggttgcagtgagccaagattgctccagtgcactccagcctggcagcctgggcaagagagcaggactccatctcagaaaaaaaaaaaagatgaagatggaacttaataaataggaggctcaccccagattgcacaatgagtgagatgcgcaaatggaactgaagtcaaagtccttatagcatgagtggcatatctctgctatggcaagctcccaactggtagttatttatggtgcacgaactatgagattatgaatagaaaactgtcaatctcattgacagaagactgtcaagaagaggtgagaatataagctcacctctagtcctgcctgaccagcctgctcaaccttcaataagagtgttgaaatatataacccacatttctttgatcaagaagaattattagcatatgttcaagtttctaaataattgagacttgctttttagttaggtatctttaatgccctttatgcagcaaataaattattattatataaagtttgttttgcaatacatattacagtggaagaagtgcagtatatttctacattaaatgtgtgaatttttccaattatttctttcttattgttaggtcttgcctctcagtggcatacaagacaatccatttaataatgccaagtaaggaaggagagttttagattaataactcctgtaagtaacctatttgtcactaatataaccattttatcattgtctatctgccctggtgcactgctgactaacattattagtagcatgctttgcttaggagaatgtaagaataactaattttgtggttttcccagaaatatttgttttctccagcttttattggtatccagataccactcgttctaataaagcaaagccctcagtgcttttcagaagcccctgaagtgtgtgtttggttactctttacgtgattaattttcccttgttagttgctgttcacacacacgtatgtattcacctgtgtatcactaccgcctttcccctgtccattgtgtgattgctttaaacaagaaaaaccaaaatacatttatttttagagtttaataagaagttattcaggaacatacttataagtactttagaaatatttgaaagaacagtaagtaggtagagaaaataagtggttaggcagccagctctctgactccttaatccctatatttattagaccccattttctgcatactcattcttgccctttctgcattctctttcttgccccatatactgatgcagaatagctagcccactagaactcccccctattattttaggattcctcaataggtatctcatgatttagcaaaagttgttctcttctgctctgtggcagcagcatttcttcaccagctctgacccccttctaagagtggtccatcctccactctccacaatcccctgagagctgccactgttgttggtgtgcgtgagagctaaatctacctaaggtactttcctcatgactccaaagctactggccacctcctggcaatgacattttaacataagattgcaaaccagacagaaaaagtactatccatgcattattatccctggagctattcctcatcagagaaaacaaaagccaggctgaaactcaacaacttggagatttgagggttctccttcagactgaatcaatcaccagtgacagagcagggactttgtctcattcccaagtacacagacttccaggcatcacactgaggtgtatttactttcaattgctagatacatgctttaagaggcagacacaagaaggatccttttcagttgataaattcaagagcacaatagcttcaatgatctcaccttctctaaacacatacttttaattgacaatgattatgtatccaggcaagttttccagaaaaagaaaatccattctttaaactttgaaggctgtttccttcttatttactgtatttattatttacggttaattatcatgggtaattcctcctcctttatgagtatgttttacttgaatttgatgagccatcccaacccaatatatagaaataaattagcaacttctctaaatataaaaagtctcattcaaagccaggaaacttcaaaactaaactagataaatgtatatacccttagtagttcccaaagcatttctgaattatggtacctttcttagcactgattccttaccgtataaatgcttatacacgtttattttcccttctatactatttagtccctttagatcagagatagaaattatgtattattatatccctactgtactaaatatctgacacacaataggcactctctaaatatctgaatgactgaatgcatgaatggagagtgagcaactaataatgacagctgtcctctatttaagacataatacatctcaggcactgtcttgggcaattttcataaaccatctgatttatttctcatgagatcataagggaggctttattatccccaatttggagatgagaaaacagctgcttagagaggttaagttccttggcaaaggttacagatcttgtagatgatagttttaattttaactcagttgtttcctatgtaaagcttacactcttattcactaagacaggggtcagcaaagaatggtcggcactgtttttgcctgccaatattttagcaaagacagttttctggcgactcggcctcacccattcatttacctattgtctatggctgttttgaggctacaacagaaaagttcagtagttgcaactgaaataatctagcctgcaaagcttaacatatttattatatgactccttacagaaaaagtgtgtgggctgggcgcggtggctcacgcctgtaatcccagcactttgggaggtcgaggcaggcggatcacgaggtcaggagtttgagaccagcctggccaatatggtgaaaccctgtctttactaaaaatacaaaaattagctgggcatagtggcacgcccctgtagtcccagatgctctggaggctgaggcaggagaatcgcttgaacctgggaggtggaggtttcagtgaacctagatcgtgccactgcactccagcctgggcgacagagcaagaatctgtctcaaaaaaaacaaaacaaaacaaaaaaaagtgtgtgacccctgtggtaggatatactgaataagcagaccacagcagtcagaaaaatggtgaaggaaaggcagggaaacctgcgcaagtgagaaacttgttctctacatttgctgaacccacaattgtttcctactccccaccctaacataattgaattattgtggcattaaaaagtacccaggcaaggccttagtttaaatctaaccagccttacattaacctggtctgtctgtgctgttgccttagctcattttcttctctgtttggtgctatgactaactcattcccaatgaagcctctgatatttcaagctgagagaagctaaggagctgaaactcttgttaaacaattcattagcttttcacagggcagagataaggtgatcacattcttcaactcacaacataaagtgcaaaagtatttcagacctagtgagcctttctctttttccttaattttcccttatccttttctcctaggtgtttctttctcccctccctccatctctccacttaattgttcacatgtaaaccttactgaaggtcaagtatatattgcattaattaaataaaatccaatgctcttttcttaatattcaatcaggtgtttaaatacattacatataatatatgttacataaacaagatattttgtccagacaggagtctggaaattgattgcttttgttggaaagacttatggtctttggatgatgtgtgggtcttccttcccatagctcttttcatccatgagtgatgagttaatagtagattaaaaggctcccaggagagaatgaatttggactgcactcccttttgtgtgagatagcattaaaacatttctgaggtttttagataaccccaaataaagccaaaaaggcaggcaatagtaacctccatgaaagagggatcatgttgaattttttcactactgtactctacattgcctagcgtaatatctagcatgtaaatatttgtggatgaagggaaggtgagcaggaaggaaagaagtagagaggatggaagacagggaaataaatggaaggaagaacgtgagaaagaaaaaaaatcatacttagggcacgatcactgtatatggagtgggcggtgtaggctgatactctgaacctagcatctgtctgttgaagaggaaggctactgtagtcacagcagactggggctgatgctagaatcctcttgggtccaaggactcagcttcaggaaagtggcccactttgtgtattatcacacccggctcccagtgattcttgctgtaacttgtgtctttgtaacaggactctctggaagagaatatcctccttcacactttgatggaccaaatttcagggggagtggcagagctctgcacttgggacagaggtgtcctcaaggaatgcactaggttagcaagagaaagggccttgattatctaccatagctgtagacctgtaagacttcaatggcaccagggctccatcggaggcagtaagtggcctacccaagagcaccttctgaaaagtctggcttgaaggagtataatggagttgcatctctccagcacagtgtcatagatgtgtagcaagacagacaggctcaggattaaatgtgaccaaaactgcagattctagggattatctgggtaaggaaagcctgggtaaagtctagattttctactagtttaggagatgggagcccgtacatcttgtgttctgtgtattttgtttgtattattttcttagccacaagttgttgaagtctgaaaatatggactttcatgtcatccttcattaccttccacagtgtgatctcagaggcaagcaatgcactagcatctggcctaatgtgttactgatggcagcggtgggccatccagagcagctgttgccattacacctgctacagcaaggaggcacaagtggtagcagcaggagaggctgcagggcagcagtggtggccatgggacccctgtgccctgcgtccccaaggaagctgactgcactgcccccaccttcacgcagccgggcagtacccactccaggccccggccccgcttgccactcttgacagccactgctatggggagttcatggggaagaggcgaatagtccctagagacttcccctgggggaccccctggagcctaccaccctgggggccaccatgatggggccgggccaagttgcctacaggcaggggaacaatgtggttgggcacagaggggtgaccagagaggggactcgaggcggagccgggcctggggtggtaccatgcttcagggagcctgcaagagccctggacaagcgggagacccaccccctctgagttagctgggtgggagctccctgggtgcagctgcagctgctctgccccatctctggacccaggcatctctgtgttcctgggggcccaggaaggcccctctgacccctgcaggcttggaggtgcctgcttccactgcctggcttctccccactgtcagtgtatgctctgatcttggagtaaggttggggccaagcctgagcactgttgcagtttggccaggggcatatgctcagggcagcagtgacccaccaaccccttgctgcctcggctccctctaaactttggctgtggacaagcacaggagggaggcacaaggggtgctgaggacagcggggtactggcctgcaggcgccccttggcatgaacggtctgggtgcgatgaatggtgacaggcggcagacaggctcctgggcagaagggggaaggtcctcagtgatgccctaccttcaagctgaggagggcctgaaccctgggggctgggagccattcccgcataccagaaggtgaactcgtagcgcttttccctgggccctcgtgggtgcccatggactgatcaacatgcacttcctcccctctgaggcccataaaaacccccagactcagccagactcaagcagaggacagacagatgatggggagatgaccagatgacaagctgcagagaggagctgcccaccccagggtctcctctctgctgaaagttgaggagacaatgggatgaccaaatgcagagaggagctaccctctctgctgagagatgaacactcactgggatgccctggctacagagaggagctgcccactgagagtctcttctaagctgttctattgctcagtaaagctcctctttgtcttgctcacgctccacttgtctgcatatttcattcttcctggactcaggacaagaccttggtacctgctgaatggcaaggctaaaagctgtaatagaaacagggctgaaacatgccccttgcttgccacgttgtgggtgaagagaaggagagaaaagctgtggcccttcagggagcccagctctgggagctccctgagccagggcagtgactccctatttggggccctgaagttcctgacatctccaagcttccaggagctactgcattcgctggtgccagctggagaagctgtttgcagtcctcctggtccagctgtagcctcacagagagccagcacccacactggcacctggaactgcctgccccgcagcagcagcagccagtgtgtcttgctgtgcacactggccagaccccacactcactcacactcaccactccacgcctgactcacagtctcccttggaggcataggatccaggccagtagtgtaagccaagtgcaccctgccaggccaagtggacagaatgagcccagcaggcccagtgaaaattcaggcaaaggtgccaccagccatagaggcttccagccagaaaagcgacaccccacggatcctgtaacattactatttccttctatccaaagatatgtgaaaaaccagcccaggaattattgacctgtcttgtccctctcaaggtgcctgtcaccctacaattccagtagcttgcgtctaccagtttttatctttttataatgcttttaaaatataaaatacaatacatacacagaaaactgaataaaaccaaaccacatgtctcagtgaattattacaaaacaagcactgcgtgaccaccacacaggtcaggagatgcaatacggttggcacatctgggggtcactccccaccacacatgtatgtgccccgctataccagctcccaaccacaaatctctcctcttgatagccactctgacttttaagataaactttgtcttgattttttaaaatcattttcacctaacagtgtattcctaaaccttttagtttagtttttgcctgttatttttctaactttacataaaagaaatcactttatctccacttgaactttatctgctaggccacttttgagtttgcttgtgagaagtatctccattgttatggttatctgtaattcacttattttcattgctgaatagcattccattgcatggacacactataacttatgtatctattctagtattaatgaatatatgggttgtttctagctttagctattatgcacattactactacaaatatgcttttatttatgccttgttgtaaatggatgtgtatttccactaagtatgtaaccaagaatggaattggtagatcatctggtatgcctgtcttcaaacatagtagatattgcctatctgttttacagggtggtttaggacactacatgcctcacaacagtgtgcaagaatcctacagcttcagactcttgccaagacctgatattctgtttcctttaaatttagtcatacttatagacagatgttgctatcttatctttaacttgcatttcctagattaatagacctagatttgcatttccatattactggacctaacttgcatttcctagattattaggaccattttaacttttcttctttgtattggtgaagtaagtccatgttcaaatcacaagctcattttttctattgggttgtatttttaatactcattgatttgtaggctttttaaaaaaatagccattctagaccatatacaagcatttcaatcattatgtatattgcaaatatcctatcacattctgtgtctttgtttttcactgtctgaatgcccataaaattctcatatccagtaggagaagatacatgtaaataaaacctttgtgccaggttctctcatatacgtatgttcagggtattaagaaatacagagaaggagttgtcaattaaatgtaggagggatgagaattcaaaaaaatgtcatagatgggtaaagtgaatattggaaacatgcattcatatttttcaggaaattaaaggagcaaggatctctatgcaaaaaagcactctgagtcctctgaagccctatttatgcagctgagtgagagagcagtactcttgactagagaaatttttcaagggaggtcggtgatgaatagagccctaagtataattaaggaaaggtaaaagaggtctctggggtttagagacatagtttcgcttagaataaatattcccagtggtttataaaaagagtgaacagaagtatagttgtcttggggtggagtagagctgagctagatggcaatgagagtgagtttaggaagttgcagatagaaggcaaaaaataccagaagtttggcaagtattataggaaatagataacataccagctttagagtcacagagatcttggtttaaattctgcccctcctttccctattttctctctctctctttctgacacacacacacacacacacacacacacagagacacacagtgtctatggcatgtaatgcagacttttcaaaaagtggctgggaatgctttctctcagttccctggacaataaaataactcacaatgagagctctcgcttttcctctacaaaaaaaaggttcacaccttttttgatggtgttacagtgctttattcacccgcaaaggagcaactgcatctttccattggttccaagcttcccaggttttgagcagctggcttcctcagaaaactctggaaaacagctgacaattatacctgttatacaaatagcctgtctgcagagtctcttcttcttgctctataagaacagagaccaatcacaggcaatgttgctttaatgtaatataaacccactatgtatccagcaagggactggccctggcttacctctctgtgggaggccaagaggcttcaggaatgtgtgcctctcttgctgacaccagcctataaatttcccccaataaagcctgttccttaaccaaatgattctgtggaatttgtcttgagccctgtgcacaatggtaacttgagacaagcaacaaccattcttagcctcggtatcctcatctgtaaaagaggaattatgccaacaacaataagttattgtgaaggctgagcaagataatatatttaaaatgttttagcactgggcctattttacatggctaatagaagaaaatgtacttatggctaaaataatgaaagctgagtagcctcaatttctcaactgaatgataatgttatggcgctgatctcaaaaaaatcattcactagataactgaagactgccagtagagtgtatgtgtgtcaggggtgagaaggttgggatctagggggtggctggaaaggattttccaaaagagatttgcggaatgagagggactggccagaagcagatatactctgccaatttatctcatcaacaattgtagattgcattttcacttgtaataatgacccaatagctattttaattatgtttatatatacatatacagtttatgtatataacaaatatataagcagaagcttctgcatgaccatgggtaaaattgttcttatgctactggactcagagaggctatatgtttctattacagtagttggactgaataaatacgttctggcggggagggtctgttttcctgtgtttaagctgtaaagtgggagattctctatagagcagattataaggaagttggcccgaggatgacataaaagataaactgtgtgtaaataaagtagtcaaagcaaactaaggtttccagggctaaacttcttgtgttggagctgggaattgcttctgattttattcctactgctactagtgtcacaggatccttggagtgttgcttttctggctgaaaacctctgtggctgatggcgcctttgcctgagttttgctcgggcccgctaggctcattatgcccactcggcctggcaggctgcgctcagctcgcgctactggcctggttcccacgcatgccaagggcaaggcaggcacggagtggtgaggggtatgtgagcaagcaagcgtgggatccagcaactgtgcacagccaggcacgctggctgtggcggggtgggcagctccaggcacctgcatgggtgccacctccctgcaaggctgtagctgaaccaggcataccacaagcagtttccacggctggcactggggaacgcagtggtgcccagaagcttgaagacaccaggaaccgcagagccccaagagtgtgtcacatccctggctcagggagttccttggtctgggctccccaaagggccgcagctcttctctgcttctagtagaccacaacatggtgagcaaggggtgtgttttggccctgtgtgtgttacagctctttcagccccaccatttggtgggtctccagttcttgtcccacatccaggaagaatgaggtacgcagacaagtgaagggtgagcaaggcaaagggtgctttactaaacaactcagaggagacctgcagtgggtagcttttctctgcaggcagggcatcccattgtctgctcagctctcagcaaagaggagacccataatgtgtagctcctctctgaccaaatgatggtcagctcatcatttgcctgagtcgcttgaatccagggtttttatgggcttcagaggggaggtagtgaatgctgattggtccatgggcagccatgggtgggcccagaaaaagcacggcaagttctcactcctatctgcagaactggcctgaaggcggggtttcaccggggaactgcccctttccacccaggagcctgtctgcctcccattgtcattaacctgccatttacagtgcccatggcgtccaggctattcatgccaaggggtgcctgcaagccaacactgagctgcccttagccccttcttggcctccctctcatgctggtcagtgcccaaagtccagagggggctaaggtggcagggggctggtgtgttagtgctgccccaagtgtgcatgcatgcacctggccaggttgcgacagtgcctgggctcagccttaactttgctctgaaatcagagcaggcaccgggagtggggagaggccaggcagagggagcaggtacttctgatcctgcaggggcaaaggggcttcccaggcccccaaaagtgcagagatgcctgagtccgcagccgcagctaggtcgctgcagtggtgcctgggggagtgaggttcctgcccctccaacttggaagggggcagggcttccatctgttcctgagagggctcagccctggccacacctcccctactgcagccagtgtcatggcaacagccactccagacaggccgttgctgttatcattagagctggccagaagaaccaacactttagtaatgagttaagacaatattggaggaatgagagtctgtttgggcccacctgaaggcataatactggggcccccacaaggatgaaagtaagcatgcaagcaggagggtaagagtggagcagataaacttcagtgttgcccttaattacaaacgtagctggctgggtgaaagagacaccaacccctaaaatacacctgacagatctgctcactcaaggaattctactcagtgagaatttaatcctggtagactacctagatcttcgggcccttttaaatgcaaatgacacaaagaatgacagaaacctcattgtaaacttacatttaggtctgagcatgaaggactgtatggagttctttctcaatggcaagtttagggtaggatggagggaagatcagagctttggaattctgaaggagagggaaacatgctgaaaagaaagagaactggaggggaaagccaggaatagaaaagaaaatgttgcccattcacaatgggaattaagcttttcctataataaagaccttgacacagaagtgagtgggctaacgaactttctccatccaacagttagttctatgtgtatcactaaagttataaacacattcttgagtaccagaattttaattttgataccacaacctttgaaattctactataattgggtcaaactctggaacagtagcagatatgctgacttgctatagaatgagagtgacaaagaatgatgaggaaatgcctgaggttgagtcccaaagtactctaagtgtcccccaccaaggacagtgatgactaaggccctctccatgtccttgatgtcaacattagatgatgtgtgttaaaaatgttgagaatggaggggactatcttcaggacatggcattactctccacatggaaggtgtgttcaatatgccatcctgggaagattgaattcttgcagcagcacataatggaaaaatactacagcactaagcagtaaactgagaatatatcagaatcccaaagactacatctaatattgcttaactgtagaatgtagttatacactgttctgactggaaaaaaaaataaaacactgcaattttttctcttccctattgaggatgagttccttactaacttggaattcagttaaggtttagtttaaccaaactattccttagggagttgattcctatcaaaggtcaaatcctgaaagagtaaaataatcaccttccaaatatcaatcttgtaaaacagaaggaggatcagaaaattagtaggttatactttatgggcaatttctcttcacagcttaatgctttgtttatataactatccttattaaattattttagcaataagaatggtgttgccttcaccccacttcactctccaaaccctcaataggaaaaagttggctggaagagtgaataacaaactaatcgcctcaaacttcactaagattaactggatatgtcacctcctctaaagatcacagcagtcattcactggaataacaaatggcaagacgggaaaccaaattgtcaacatgggtacaaagaatctactaatttgcttgaggttagtgggtaataggcagtgttatactaacattattattcctttgtgatacatttccaaccaaatttcttttattagaaatgcttttttctgattatgaaaataataaatgctccttatgaaaaatcaaaaatatattttaaaaatacaagaaaacaataataattaacaataagactggcaaccacagatgatcattgtaatgaattagcattcttctttcagtgttttggtgtatataagtacaatacattacagcatgtaggtgctttgcagtttatgtgtattagcatggtctcattttgttaaattattataagcaacaatattaatgcctgtattatattccaatctattgacatttatatatcctttgttttctaacataaaaagcttttaaaataggtacaaatactttttctaaaagttttacattacttcttagggtaaaattcttggaagtagtgtttctgaaccaaagagcaagaagaaaatattttgccgaattattttctagacagttttctttgttttatagtttgtttaatcttttgctgggcatataaaatagtagtctgatctctgtgccttcttatcaatccaaaatatttcttctcaaagtattttctatttcaaaagatgaaaaatatgtctcaagttatgtttcatttattacatctaagtcttaatcattttcataaatgtatcagtcaaatgtagtttctttcataaattgttggaatatgccctttgtaaattgctattttaagattttttaagataggtcattagaaatttgtatgaccattataaatattcaacgtattaaacgtttctcttatatttgaggcaaatatttctcccaactatgtttttcttatttatttataagaaaacaaactaaactatatatagttatatttattaactaaatataaatagttaggtctatttatatttccctatgtgattctgactcaattcctctacatttagaaaaattcctccccctctacagattagacatgcaccatctaaaacatagtacttgctttttaattattattgttagaattaaatgaaactgaaacttgttaatgaaattagctaacaaaattttccactgctgaccagatattataaaaaacattgaacctatcatgtttaatagtgcatagattttcccaagctggataactgtgaaatagagtgtaaccaatgatttgagtgtaactgtgattaaactttccaatgttggaagacacttttaatggaagctattatctatatttatagcagtttcattttttacttcagctgttacttactcaatttttttcttctcttttttgcaattgatttgcaaaatattccattaattgccttataactgttatacatatggaaaattgttagcatgccttaaagtgatcaagaaagctcttgagtgttgaaatatactaagtcttattttagatctacatttctcctctgggttctgcttaggcaaaactagttacatttaatgacgctttcatgcatttgctattaaattatattagtctaggtcagtcagaaccttgagatacgtttgtctcttgaggctccttgtctggactagatgtccatgcaattcttgttcagctccaagtccagccagaggcatttaatgtggccaacaacaatggtctcatgccttgattctaacatgtatctgggggtctgagcttaagaatggagaaacagaatgtaagtggtcctgtcagttgttaaactactctttccctgcatccccagtcttgcctcatagatatcctcggaataaaatatcatgatttttaagcatctcagtttgtactaggattgcattgatgggtggcttttccaacagaggaggaatagagatgggagggactgagatgcctatattcgagaaaaactatttctaggcagatagccaaatcttgatccatcaaaatactaaattagtaatatattaaaacatttttaaagggaattctgttattattatgaagaaaatgagaaaagaataatattccatactgatatcttctatcatttggaaatacctactttcttccaagaactgtataatgtactagagacataagattaaaatatatggtccctgtttccaaatagctcatagcatggagaccaggctgaccaggaaacagtatcagctatgaaacggaagtactgaattacaaggagtagatggaatgactgcctagctgaaactgtaaacatcaagaagaattcctggataatgtgccctatgaattgagttttacaggaagagaatctcaggcagaagaaagcatattagaaggcccaatgctgtgagaaataacctatttacctccctgcaagtatttcagcaaaggtcttaattggtcagtgacaattaagtaaaatgaagggcttaggaggtccagatgattaaggtttttattcggcttgctaaggattttggactttatgctaagccaataaaaaggtattgaaagactttaagtagtcaaggatgtatgatcagatttgcattttagaaaaatttctctggccacaattacgtaaaaaacagagaaggatggggcgggggacacattagcacaaaagaatagttagaggacaattcttggccattcaggaaagaaatgaggagggtcttaagtagagagagtgtttctgaagaaagatattaaagagccataagaggcaacatatgatcactgattataaggttggagagacagggataaagaaaagggtgaaggcaacccagctttctggcttttacaaccaggtaaaatgtgatgacgttcacagaagcagggagtaacagtgtgaaagaaggcttgattgaaggtagaatacaaatagcttgagttacctgtgaaatgcacaagtggatacacagggctgggactagggtgaagtgagtgatgcatggaattggatgcaaaatttaagaaacaaaaactctttgaaaaaatgcattttattttaagtctgggatacataagtaggatgtgcaggtttgttacacaggtaaacgtctgtcatggtggtttgctgcacctatcaacccatcacctaggtattaagccccgcatgtattagctatttgatattgatgctctctctttccctgccccctactcctgacaggccccagtgtgtgttgttcccctccctgtatccatctgttctcatcgttcagctcccacttacaagtgagaacatgcggtctttgattttctgttcctgtgttagtttgctgaggataatgacgcagtggtaacacatggaagcctcctttctttaaggaactattactgagagagaggcagaaggtttaaaggttgtgtttttatttatttatttttacttttctctcatgaaataagaaactggaacatgtttatttgctgaggctaaaaggaactggcaatggagaagggacgtgggaaggaacaaatcagagaagatagatgccaaaacaaagacagacagaggctgaagaaaaggaggctcagatgggattattgtagacagtttactgaatacaggccttcaaaactggggggcttccacccaggaagtgaaaccatatgacccagcaatccctcttctggttatacacccaaaaggaagtgaaatcagcaccttgtagaaatatccgcacgccaatgttcgttgcagcactattcacaatagccaagatatgaaagcaacctaagtgtccctcaagggatgaatggataaagaaaatgcataatatatacaaaagagaatactgttcagcctttaaaaaaaaaaagaaaattctgcaatttgtgacaaaatggacaaacctggaagacattatgctaagtgaaataagccaggcacagaaagacaaatactgtatgttctcacttatgtgtggaattaaaaaaaaaaaaaaaaagtcaagcccatagaaaaagatagtacaacagtggttatcagggacaaggaggggatggggaatggagaaatgcacgtcaatgggtacaaagttgcagttacataaacaactgaaataagtaagtctcaagagctaatgtacagcatgaggactacagctaataattttgtattatatactagaaactggctaagacagcagattttaggtgctgttaccaccaaaaaataaaaaagaaggtaattacgtgacatgatggatatgttaatgtgcttgaccttagtatatttcactaaatatatatgtaatatacatttatcaaagcatcatgttgtatgccttaaatatacacaataaaagaaggaaagtaatgcacttttattgcctggacaacacattaacacatctccccattgtgggtcatttttttttcttttgaaatgtttataacatttactcacatctttccatatttctgcccatccccaaatttaaggaaattagtatgcaatacttatctgcctgtaatcccttctctttggggcattaatcagcagttactaatctgaagatttaacaagggaagaacaaagaagcattaaaaacactatttgctgaaaatatagaaggggtgcctaagtgttgctcacatctcttcaaccttcaggtggaaattatactcaaggctgcaatggctggaaccccaagttcactgaaatctgcatcttgaaggaatttttgcacaaaacagttctttcatttcagaaataaaatatttactaaaaagttgagaaacaatgcaagcaaatgcagtaaatatttgttcttcatggaagcaagttattcctttacatactcctattgtctcagtgaagttctggaggtttatacaaatggaatagattgtggaactacccctgagaactactcttaaacatgctacgtattcaggatgtcaaattaaaggagtctctgaggctgccgcttctctggtcatctttaattagacaatactctggtgaaaccctcacaattaatattaagagttgttcttcttctacagtaagtggaaggggaattatgtagtggcttgttctttgttataattttattgagagggttgtggaggaaggattggaatataatagaattgttctattttctaccatttacagaaaactagatgaatcacaaaattgaagaaaaaatgatgcttatcttttaaatatgtattttataaatatttaacttatattaaaattactttccacatattacaaaatgctctaggcatatcagtgcatgtgtgctactcattaaatgttactatgtctttctaccacagagatttatttaggagggagattgtcatgttatttcctatacctggaatgactcacacttctgtgcctgttaacattttatccatctgatacaatctagaccgtgaaacctttcctaatcaagctattttttcataaatttaacaactgtcataaatgaattgtctgtcatgaatgaatgaagcaacaaaacaatgaatgactcagtgtgggttggttctaagagttgcataccttcgtaaccccaatagagcttgttggggtgcctggaatattaacaagccaaaaaaatacttactttattattaattatgtaggcaatgcataaattgaaatacatttatatttctctcaagaaattctctctaaattatattagcttctgaggagaaagtgtctttctagcaacctggcttttaaaaccatcataggcactttctctgtaaaggtaaataaactttctttggaatgtggtgaaagaagctgttagataatttctgaatgtctggttttataataaggagggtcactgtcctcaaagtttagcaatcactagaccctgagggacttttatctaatcttaaccctgcacctgactgccaggcagagctaatcacttaacctcccagtgaattaatgggttcatctgtaaaacacgattgccatcaaaggcatgaaaggaaaagactaatgatagacggaatgaggttagatttaaagattcaacaaagccatcaaaattcacagcaaagccattttccattatttccctcaattgtaactatactgcttttataagaagtgaattcgacaaaaataagtttataagagttctgttgtgctagtttttatctgctggactgatgcagtatgtaagaaaattctcttgctttcaaaaatgtaaaatttaaagcacattgaaaattcatgatatttcatgagatgcctaaggatttgagactctgacagacaaaaaaatcccctgtgattttgataagactgctaaataaaaaagcagttcatacattatttttatcaccttcctcttctatttcctctttcatttttctattacattttgattttgacttttatgtttctgcatctttacttttctccacccctggagcaatgggaagtatttttttgcaggctacaaggtaccattttcagtgtctgatgaagttctccctttggtgtgtgtcaaacaatcatttccagcctccagataaagagacagagtggcccagaaatgccctaagcccactagaggcatgcttgcctaagctggctgcatctctccagttgcaatgcacattttttgggacaataataaatactggctcaaaagagaatgatggaaagtacatttttaggagatatgagatctaggtctattgatggataaactgatttttttccagtcactataacatctgttcagagtaagtaagcatcactgcacagggagatggaggatgttaactgatattgggactacaattagatagaagaaaaccagaaccaaggcacacacactgttcagatagttcatagggttattttaatcactgattcaactttacagaatgaagtttctccattcaatttcacatcagtaactgcaggttgtattatgtctaagattggtatagaacaacagcaatttcacaatatctagacaatgaatgaatattaaaaatctatttcattaaaaagctctttcagatactggtatctgaaagaaaccatgttggacgcaaaatatatcaagaaatcaagaactcaatataatgaaaataaggctgaagactgcaacagatttgaatacagcatgcctctatattctagttattaatgattgatttttaagaaaacctgtttcagtgaaaagggcaagtaatcttttttaatctcactttaaaatatttcctagaactttctcattcattagctcacttgattctcaaaacaatgattctcattcattagctcacttgattctcatattctcataatcctaaaataaatgttattataatctgtattttaaagtttaatattttgaaagaaataaattacataatttgatgagggtgataaattgggactccagtcccaatttagttcaccctgagcaggtccattctcacatcaacctgttacaccatttaaagaaataaaaaatgtccattacatatatttttaagttacattcagtcaaacaagcagttaccttagcactcagatgtgtaaaaaccagtgcaacaaaatttcagtttttaacaagtcatctgaaacaacagaggacataattttgtcctgttcccaagatactttgtgtttatgttcctaaatcctaaattcctaaaattgcatcctgataaagaacagtaaatttgtttctctactatatttaccatattgcctcattacttgatccctccttccttccctccctctccccttctcttccattccttcttttcttccttccttcttttaataaatgtatatatatatgtgtgtatatatatataaccaataattaccaagcacttacagtacactgggcagagtgctaggctcttcactgaaaacacttcaaagtataataagagaaacaggaagcaatgaaatgagtcagctagttttggaatcaggttagtcacagttgatctcagctgcaggcccggaaggttgggggtgggctgccttgtattgcaaacacatgcatcacatcacacagacatcctgcacgctggagcacagtagcctgtcagttcccactgctgagtcatttacagcttttatcgtagttaatgccaatgattatatatgttaaaagtacttattaatccttgtaccaaatatagaagagggctcagacgcttcttatctcatggttcttaaatctaaccatgcgccatactcactggtagttttacaaggaatggattcttgagctcctctaaagaaatcagtagctccaagagagatgtttttaaaaatctgtttctagtaaactctcccagtgattgctgagtaacctacttaaaatgacattggaaaaccatacactagaaccctgcttttgatttttgttacaagatctagaatcaagttcaaatagtctagatagtaaaatattgtgagaatttttttttagttttagaaatcctacaagaagtataaaactattgttatagtccatgcaaccaaaattcttacccaactactggaaaatgaaggagtaaaaagagttggccagggtagagacatctggatccctcttcggcaacctaagaagataagtctgtcagagaatagtgattataatgagttaatgactatatgcctggtttgctttagacagccccatgtcatgccttctgtcttagtataattattaatcatgctacccatttctttctccgaagtgtccctatttgaacaacaagttatttggtcaccccaactaaaagggaatcttgtcagagaccaatgagtgtcgtttagtgaatatagaaataataagcaggctctatttattcatttattcaactcaattcagcaacacatttgtgctagcattcgcacatgccaagtcctgcataagtgaggaaagccccttgccttgtggagcttacagtccagcagtggaagactcacacagtatacaaatgaaaaacaaattaaaaaggatagagattacaataactgctattatgggaataaagaggatgatataataggatttcatgggatggacaggtgtaatgaggggaggccttctggcagaccatcatctgtttcaacctcattttgcataccttcttgtactccagaaactggaaagctaaaagctatgtttcatatcctcctccgcagctagggatctggatttagacacagacaaccagatatactcatgcgaagcactgattcagaactaaactgtagaaggacgacgcagtggcagagaaggtgtctacttcactggcacagaagtccagtctccttattgtcagacagcacataagatgtgttcctgaaggtaatggttctgaccccacttcctgatcccctactcatggttatagtagtacaaccctgaagccagcagttgggacagcagtcttctaactccccagcttcctgatgaggcagatgtagagggccagttctgtggtggtgttcttggagtctggaatagttccacatcaagagctattcccaagaccttctaaaaaattgtaagcactaacttaccatgttaagttcccttctgattaaaatggagtggtttctgttatctgtcacagaatgctaagtgataaagacctaaagaatgaaaaggagtcatgtggcaaataaggggaagagaattccagaccgagaaaatagcaagcgtacagggtcaaggctgggaaaagacttggcacgttcaagccacaagaataaagtcactgttgctggaggaatgaagaggtgggaatgcggaaaatgagacactgtgggagtctgattagggccatgtcagtgagagacaagttcagatttttcctagtatattgggaattcattgaggagtttcaatcaggcatgatctagttttaagaatattagactagatgccttgcagaaaaggaattaaagcaggaagattagtataggactatgtcagtagtactagcaggggtgaggaaaaggaggaattaaattcttggctttcagctagatcagaaggtagatgtgctgtaattcattaaaacagagacgaataggatagaataaacatatgtttgaagcatcaagagtttgttttcgttttgtttttgggtatctttggttgcacaagtcaaagttgagatgcaaaccagacaaaagactttgacaaggagagttttataaataagaatctgcaaaggaacagtcagttttccatggaaatcctcatctaaaccaggtcctagggtcaagacgttttaacataagagtcagaaacaaaacctcagagcacagtgcatccaagcacctttttcgttttttatacgaggtctcgtctttatcactcaggctgaagtgcagtggtatgatcacagctcactgcagcctcaaactcctggccttgagcgaccctcttgcctcaatctttcaagtgtctaggactacaggtgtgctctgccatacctggctaatttttaaaatttttttcttgagacagagtcttgctatgttgcccagtctggtctcaaactcttgggctcaagcaatcctccagccttggccccccagcgtgctgagattataggcttaagccaccacacctggccaccaaagcacctctttcttatgttggctgttaccaaagcctatcagacattccctctattaaccctacaaccacagaccctgtccttacctgcaaattcacgaacacttcctcaggcccaggaagaactggacgacttctgtctacctatactaccagcaaatgattaagtcagactgtcaggacgtctacaaccctcttattatatgtttcctatattctttcaactctgatcagttgttgggggaagtcagggaccccgaatggagggactggttgaagccatggcagaagaatgtgaattgtgaagatttcatggacatttattagttccccaaattaatacttttataatttcttatgcctgtctttactgcaatctctaaacataaattgtgaagatttcatggacacttatcacttccccaatcaatatccttgtgatttcctatgcctgtctttactttaatctcttaatcccatcattttcataaattgaggaggatgtatgtcacctcagtaccctgtgatgattgtgttaactgcacaaattgtagagcatgtgtgtttgaacaatatgaaatctgggcacctcgataaaagaacaggataacagcaatgttcagggaataaaagagataaccttaaactctgaccaccagtgagccgggcggaacagagccctatttctcttctttcaaaagcaaatgggagaaatatcactgaattctttttctcagcaaggaacatccctgagaaagagaatgcgcccctgaggataggtctctgaaatggacccttgggtctggctgtcttctatggtcgagctgtagggatgaaataagccccagtctcccatagcactcccaggcttattaggaagaggaaattcccgcccaataaatttttaacagactggttgctctcaaaccctgtctcctgataagatgttatcaatgacaatggtgcccgaaacttcattagcaattttaatttcaccccgtcctgtcctgtggtcctgtgatctcgccctgcctccatttgccttgtgatagtctattaccttgtgaagtacgtgatctctgtgacccacaccctatttgtacgctccctccccttttgaaaatccctaataaaaacttgctggttttgcagcttgaggggcatcacggaacctactgacatgtgatgtctcccctggacgcccagctttaaaatttctctcttttgtactctgtccctttatttctcaatccggccgatgcttagggaaaatagaaaagaacctacatgactatcgggggcaggttccccaataatcagtagccctgagactataagttgaagtctgcttactttgctataattactatctggaaagctgacttgctattcttataaatataatcctagcattgcaggataccatgggccatcttgccaatctccttgctgcacaaacttgctaagcccattacatatgcaagttttatcattataatcataatcatcaataccattgtggctgaggttgatgttatgattgccatacattgaaaagtagctatgtaagtcactaaacaaacattttatctccacttaaatatatttgtttgtctgaaataattacagagagaatatacatagatctatgtgtggacaagcctatctgtgtacgtgtgtgtacatatatttgtgcacaggcctaaacaaatatatatgtatggacgtatatgaaactaatatgtaatcagttaaaaagttaggttaatatacataggttaacatgtatgtatattaaactaacaggttatcatgaatgtgttatttgaactcatagtcattaagagatgtaaaactgttaagatttttcactgttggaaaacattggagagcctcaaaatatttaaacatctaatctttaagttgaaatgattcacactaaaagaaaataaaaatatctgagcatatttattcaggagcagcagtaaattaagaaaccaagagtttttttaatgagttttcactatattaatttcaagctatttattatgttatgggctgtctggtttgttaaagcctaattaatgtaagtaaagaagacccaagtaatcattaaatatatcactatgaaatgaattttagataaaagtaccattactttaagagaggaaagaacacataattgccatggttgatattaattttaatgtcatggaaaatttatttagtaggaagatgcttgcaagtaacatctgaatttttctctttgtttcaatatccatgtaaacctgagagaaattgcctagtagattttaaaaatctatagtataggtgttttaatcaggggtctccagagaaacagaaccaataagccaattccttataataaatacaatttgatataaagaatggctcacattattatggtgactgacaaatcccaaggtctacagggtgagttggccagctggagacccaggagtgctaatggtctagttcctgtccaaaggtcagtaagtttgagtctcaggaagagcttatttttcagttcaaatcagaaggcagagaaaagccaatgtcccagtttgaagtcagtaaggtggggggaaatctttccttggagaaggtcagccattttgtcttattcaggctgtcaaccgtatgaatgaggcccataacattaggaagagtagtctgccttactcagtctaccaatttaaaggtaaatctcaacctaaaacaccctcatagaaatgctgagaatgatgtttaacctgggcactttgtggtccagtcaagttaacacataaaatgatcaccacattaggtcaactctcagaatgcagaatgttttgcctttactaataattcatgctaaaggaaaaagtgaacatgagtagttacagccacagataatataagatactgtaagtctggtttcaaaaagcattatgtgaattcttcacatgttattttcaatggtcctccttattcaatagttttaatatatacctggtatctgccatgtctaccacaaaggtagacaaaatgctcactggggtcctagtcctttttacctcatgcctacctggccaccttatagctgctctctcttcaagacaatctactttctacatatttactacataaatattcctggctgggtatcgcagctcatgcctgtaatcctagcaatttgagagggaaaggtgggcagatcgcttgagtccaggaattcaagactagcctgggcaacatggcaaaaccctatctctatttttttttaaatgtctaatgaaaaaagaaatcctaaaacactgttattattacaatgctcccctggctcaggaacctaccatggctcaccagagaaacaaaggtagattaactttcacctccacaaaaagactatagctattattgtgtacaagtatttttttttaaataaggctaaagtttctacactgactttcagaatttcagagaggagtccaagttgtaagccagctggaaacaagatgactactataatggcatgagagtgttcattaagcaaattgtatcttgccttaaggtatgtatgtggggaagggggtgtatagtattagacaatgcttcatttaactagactttcttttcttcatcagatttgtttacttctcctatactctaggtctacgctaggctctagagtttcaacgcattaaaggtacagccccctgatggaactaaatagagaacccagaaataaacccattcatatatggtcaactgatactcaacaataaggaaagaaagtctcttttataaattacatttgaaacactatctacatgagaaagacatttgccctttatcttacaccatacacaaaaatcaactcaaaatggattgaagatctaaatgtaagacttgaaaccattaaaagcctaggaaaaaaacatggagaaaatctccttgacattggtcttgacaatggttttttggctagaacaccaagagcacaggcaagaagagcaaacaataccaagtgggactgtatcaaactaaaaagcttctacacagcaaaggaaagagtcaacaaaatgaaaaggcaacatgtaatgagagaaaacatctgcaaaccacatatctaatattcaaattatatgagaaattcatacaactaaatagtaagaaaatgaagaatccaattaaaaaatggacaaaagacctgaataggcatttccaaaagaagatatacagatgttcaataggtatatgaaaaaatgttcaacatcactaatcctcagagaaatacaaattaaaatcataatgaggtatcactacacaccttttagaatatctattatcaaaaatgaaagataaatgctgtcagaaatgtggaaaaatgaaacttttgtacatagttcgtgggaatgtaaattagtgtaaccattacagaaaacagtagggaggtttctcaaaaaattaaaaatagaactaccatatgatccaacaaatcactactaggtgtatttccaaaggaatgaaatcagtttattaaatagatatctgcactgtcatgttcattgcagcattattcacaatagtgaagatatggaatcagcctaagtgtctgtcaatggatgaaatggatgaagaaaatgtgatatgtatatatctatatatatgattctatatatataaaatatcatatatagattatatatcacatagagagagctccatatatatatatggaggctgaatagtacatacagtagagtactattctaaggaaattctgtcatttgcaataacatggatgaacatggaggacattaagtgaaataaggcaggcacaaaaaaaatacctcataaactcagttatatgtggaatctacaagagttgaactcatggaggtagagagtacaatggtggttacaccaggggctggaatacttgggaaacgaaggatgtggggagcagttggggagatgttggtgaggggattcaaaattttagacaggaagattaaattttaagatgtttattgtaaaacatggtgatatagttaataaaatgtattctacccttgaaaactccataaaaagtagaatttgtgttctcactgcaaaatatgtgaagtaatgcatatgttaattagctcaatttaaccattccatgatgtatgtgtattacaaacaatatgttatacaaaataaatatataaaattttttgtcaaataaaaagttttgaaaaaacaaggaaaggctctgaatagacgtatttccaaagaaaatagacaaatgtctaacaggtacatgaaaagatgctcaacattaataatcattagagaaatgcaaattaaaactgcaatgaaatatcacctcacacctattaagatagctgctatgaaaaagacaagaagctaggtgagtagctcatgcctgtaatcccagctatgcagaaggctgaagtgggaggattgtgtcagcccaggagtttcagaccagcctaggcaatatagcaagatctcatctctgtttaagaaaaaagaaaaagaagaaaaagaagaggaggaggaggaggaggaagaagaggaagaagaggacgaaaaagaggaagaggaagaagaagaaggaggagggaggaggaggagaaataatagaagacataagtgttgcaaagggtgtggagaaaatgaatccttgtacactgttggtgggaatgtactagaacagctattactgaaaacagtacagaggttcctttaaaaatttaaaacagagctaccatatgaaccagcaatcccactttgggtatatatctaaaaaataaaataaatattttggggagatatctattcctccttttccattgtagcattatttacaatagggaagctatgaaaacaacctaagtgtccatggacagaagaataagtaaagaaattgaggtacatatatacaatggaatattattcaaacattaaaaaaagaaaactcgtcacttgcaacaacgcggatgaactcaggggacataatgctatgtaaaataagtcaggcacagaaagacaaataccattatgttctcacttacacaggcataccttgtaaacattgcaggtccagttccaaatcaccacaatacactgaatatcacaatacagtgagtcacacaaatattctggtttcccacataaaagttagttttatactctataatagtctactaagtgtatagcagcattatgtctaagaaagtgcataatttattttaaaaatattttattgcttaaaatgctaattatcatctgaggcttcagcaaatcataatcttttggctagtggagggtcttgcctcaatgttgatggctgctgactgatcagagtggcggttgctgaaggttggaattgtgtggcaatttcataaacgagacaacaataaagtacggcattgattgacatatccttttatgaaagatttctctgtaacatgttatgctgtttaatagcattttgcccagaatagaacttctttcaaaattggagtcaatcctttcaagccctgctgctgccttattaactaagtttatataatattctaaatcctttgttgtcatttcaataatgttcacagcaccttcaacagaagtagattctatctcaagaaaccactttctttgatcatccataagaaggtactcttcctccattcaaatttgattatggaattacagcaattcagtcacatcctcaggctctactttctaattctagatctcttgctatttttaccacatttacagttacttcctccactgaagtcttgaaccctttaaattcatccatgagggttggaatcaatttctgccaaacttctgttaatgtttatattttgggctccttccattaatcgtgaatgttcttaatggcatctagaatggtgaatttttttcagaaggtgttcaatttcctttgcctggatccataagaagaatcacaatctatggcagctatagccttataaaatacatttcttggctgggtacatggctcatgcctgtaatcccagtattttgggaggccaaggcaggtggatcacttgaggccaggagtttgagacaggcctggccaacacagtgaaaccctgtctctactaaaaatagaaaaaaattacctgggcatggtggtgcatacctgcaatcccagctactcaggaggctgaggcatgagaatcgcttgaacccaggaggtggaggttgtggtgagcccagattgtgccactgcactccagcctggatatcacagtgagactgtctcaaaaacataaagtaaaataaaatatatttcttaaatagtaagacttgaaagtcaaaatactgcttgatccatgggctgaagaacagatgttatgttagcagtcaagaaaacaacattaaagtccttgtatatcttcatcagatcttttgggtgaccaggtatattttcaatgagcattaatgttttgaaaactatcttcttttctgagcagtaggtctcaacactgggctgaaaatattcagtaaatcatgctataaacaaatatgatatcaactaggcattgtttgcactgacagactagatttagcataattcttaagagccctagggttttcagaatagtcaatgagcattggcttcaatttaaagtcactagctgcattagcccctaacaagagagtcagactgtcttttgaagctttgaggccaggcattgacttctttctggctatgaatttctagatgacatcctcttccaagagaaggctgattgacctacactgaaaatctgttatttagcatggccaccttcatcaatgatcttagttagatctttgggataacttgctgaagcttctatatcagcatttgctgctcaccttgcacttttatgttatggagatggccttttttcttaaacctcatgaaccaacctctgcagcttcctctccactatcagccttcatagaattgaagagagcagggcttcgctctggattaggctttggtataaaggaatgttgtgactggtttgatcttctatacagatgaatcaaaactttataagcaataagactgtttcactttctcatcatttgtgtgttcactggagtagcacttttaattttctttaagaacttttcctttgctttcacaagttggctagctggcacaagaggcttagctttcgccctgtctcagctttcaacatggcttccttactaagcttttgacttaaagtgattcttcctttcaattgaacacttagaagtcattgtagggttattaattaaccttatttcaatattgtgatggcttacagaatacggaggcccaaagagagaaagagagatgggagaatagcaggttggtggagaagtcagaacacacacaaaatttattaagtttcccatcttatatagatgaggtttataatgctccaaaacaattataataataatatcaaagatcactgatcacaggtcaccataagagatgtaataataaaaacttttgaaatattgtgagaattaccaaaatgttaaacagagatacaaagtaaacacatgatgttggaaaaacagcacccaccgacttgaaatagagttctcacaaaaatgcaatttgtaagaaacacagtacctgtgaggcgcaataaaacatggtacaccaaaagcaactgcaacaaaagccaaaactgacaaatgggatctaattaaactaaagagcttctgctcagcaaaggaaactatcatcagagtgaacaggcaacctacagaatgggagaaaaattttgcaatctatccatctgacaaaggtctaatatccagaatctacaaggaatttaaacaaatttacaagaaaaaaaccccatcaaaaagtgggcaaaggatatgaatagacacttctcaaaagaagacatttatgcggctaagaaacatgtgggaaaaaaaagctcatcatcacttgttgatagagaaatgcaaatcaaaaccacaacgagacaccatctcacgccagttagaatggtgatcattaaaaagtcaggaaaacagacgctggtgaggatgtggaaaaataggaacacttttacactgttttggtgggagtgtaaattaattcaactattgtggaaggcagtgtggtggttcctcaaggatctagaaccagaaataccatttgacccagtaatcccattactgagtatatacccaaaggattataaatcattctgctataaagacacatgcacgtgaatgtttattacagtactattcacaataacaaagacttggaaccaaatcaaatgcccatcaatgatagactacataaagaaaatgtggcacgtacacaccatggaatactatgcagtcataaaaaagaatgagttcatatcctctgcagggacagggatgaagctgggtaccatcattctcagcaaactaacacaagaacagaaaaccaaataccacatgttctcactcataagtgggagttgagcagtgagaacacatggacacagggaggggaacattacacaccaggcctgttggcaggtagggaacaaggggagggagagcattaggacaaacacctaatgcatgcagggtttaaaacctagctgattgggttgatgggtgcagcaaaccaccatggcacatgtatacttatgtaacaaacatgcacattctgcacatgtatccaagaacttaaagtaaaaaaaaaaaaaaaaaaggtatgcctgtatgtgaaatctaaaaatgctgagctcatagaagcagataatacagtggcattcttcaaaggctagtgggtggggaaaatgagtaggtgttagtcaaaggatataaactttcagttataatgaatatgtttgatgatctagggtacagcatgggtggggatggatgtgttagtttaattgtggtaaccactacacactgtatatgtatatctaatcatcacattgtacacattgtacaccttgaatatattcaatctttcttaattaaacatttttaaattaaataaataaatgcatagcctctttcatgaagctcagaaacaagcagaaggtaattcaataatgatagtattggctgggcacggtggctcacacctgtaatcccagcactttgggaggtcgaggcgggcggatcacttgaggtaaggagtccaagtacagcctggccaacattgtgaaacctcatctttactaaaaaaaaaaatacaaaaattagctgggtgtggtgatgtatgcctgtagttccagctacttgggaggctgaggcagggggattgcttgaagccaggaggcagaggttgtggtgagcctagatcgtgccactctactcccgtctgggtgacagagcaagactccatctcaaataataataataataataataataataataataataataataataaatagtatctacctacaaagtgcttactttgtgccagatgttgtgcttggcactttacacatttaagtcatttaatttccacaatagtcctatcaaggaggttctcttattatctccattttacacatggaaaaaacctaagttacagaaaagctgaataatttgcttaatgtcattcactaagtggtgtaaccagaatttgaaccagacagtctggcttcaaatcctgtgcttttaaccatgagattctactgtaaaatttatcaaagaaaggtttcctagaagtgtaatgggagcccagatgaaatgcaatataggcagtggcttcacggaaaagatcatcccctttttcatatatacagttgacactcaaacaatgcagaaatctgcatataacttttggctccccaaaaagttaactacttatagcctgctgttgaccagaagccttactggtaacatatacaatcgattaacacatattttatatgatatatatgtgtatatatatatataaacacactctattcttacaataaagtaagctagagaaaaaatggtattaagaaaatcataaggaagagaaaattcattcatagaactgtattgtatttatcgatatcataagtgtatgtcatctgttgtcaaggtgaaacttctatctgaaatggtaggcaaccacggctgcagatctcaatctatggtacatatcaagcaagccaactttttcctgtaatgtcgtgacttttctctgtttcttgggagcacttcaagcattactactggcactttgtatgggtcccatggtgctttcaaggtttacagtattgcactaaatgcaatgaaaaatgcaagaacgttgacacatcactttttattgctatacacaatttactggagagatgaaattgctcatgtggagatgattagcatcacaaggcattttaagcagatactcacaacacttgagctcaccacaatagcagcagcaggtggttacaaaattattacagtagtacatatgtattactgttcatttcatgcagttatgatttaatgctgcacccttaagtttgtttacatttctctcaactgtaaacggcaccatgtatggtctgaaagtgtgtaagttttgatgaactttaacttttataatagattcatgtatattttatggcagtaaataataaaataggctagaatctacattttttacatttgtggtatacctacctttctgattttttgctacttctaagctacataatttatctgtgaattatctcaaattgtcacaaatctccaaaaaaatttccaatacatttattgaaaaaaattcgtggataaatggatccatgcagctcaaatccatgttgtttaaggatctactgtatttgtttgcacccatctctatctctccaacaccaatattcaaatatagctaggccatgtttctatagctaaaattttgcttttgtaggctgaggtaaccttactcctatcttttcaaataccctttctatcactgccaatggcttttctgtcccatttcctttatggataattccaaccaaaactgattttattttttctgaccaccatgataggttattaactgagcatgtattttcacagttgcttataattgaactctgttctctaattttttttcacatgcataagtcctttcacctaaaatagattttatatcacctaggcataaatatatttgcatcctctagagcagacagacatatagtaagtgcttaataatactcagtttgacacaatttaattgaattaagaagcatttaaatttaggcaggaaaactgaataaacattgaataaacacttttttttctctctctaaaatgctcatctggcttctttttcaaaacagtttttttttttccttacatatagtcagggtcttagactcctgaattgtagtctaattggcctaatttgagactcatgttggcagcaacaatttctgtaactatctggagttgtgaagcagttagccagagaagtatatttgacagctaagttatttctctacagaaaaaaaaaaaagtgttgaaattcagaaagggatcagttaggcttgtaatagttactgtttttctataacaccctttgctccccgtggcatctgcctatgtcattctccttgggtgctgagggtgggtgctgctagaacgtatgacttcatgatgcatcactcaggattccttccctaaattcccctatgaaatgttggttttcacctccatcatcctgatgcatgctctcttttgtccaaaacttctactctgttgtgtattctatgtgtgcctgtgcccagaaacttcaagagccaaggactttcattctccctgaggatgtttctaaggatctctctactctcatgtatgattttttacaatgtttgtaggtagaaaataaattatcggtgaggagagagaaaatgaagaaatgggagtgattgagaggaaagcatgagggagaagaggaagaatcatgaacatgagtggaggggttattctctaagaggccagcatgctcttcttccaccagtagggaggaataataaacatgtcaagaggagcagaaaaaagataagagttccttaaaatcttttgaggtggagaaaaggaactacatgaaagatgatggtaaagagcctaaaacttttccctgaagaaatagggagtaagatcatttgcctgagagatgcagcagattatgaaaatgacttgggaccatctttgtgagatttgggcatctattagagggtcatgattgtggtgagcacctgaatgaaagtggctggcacaaatgtattatggtatagtcactgaaatctatggccctcaggcaactctggatagggaagagagagaaagtatggacaatggagctgatccctgaggcaaataattctagaagggtggagatggaaagcactggtgtgactgacaggaaggtcgaggcttgtggggtggagggtgaaataagagttgtggagatttcatgtagcatgcatgtgagccatccagggacacgagtgctgggagtaagcgggctcaccagacacagccatccttcaccctccttcacaccaggagggcagctcaaacatgtttgggacatacaactatggactttgggacatacaactatggacaaagcttccccaaaaagagacaattaggaaaagtaatacaggccaataaccatgctttctctacatactatttcaaataagtagactttgtagtgtaacctgcatttctacttcaaataattgtggaatctaacattttaaaatacattccctttatattacatattaccaatttacatacttgtaaaaacataaaaatttaggaggcaataatttatttactcaaaattataacaggacttaaattaccaattattttggttaatatcggaataattttatggacaaaaaatcatttacttagaaaccgtgctaagaacataaatttaacatcatctaaactctttgcttatttctaggagtaactctttcataagtacatagttagataggttccttagtttgaatggtgatgtctttaataacttcggtgttggccgggcgtggtggctcacacctgtaatctcagcactttgggaggccaaggccggcggatcacaaggtcaggagatcgagaccaccctggccaacacggtgaaaccccgtctctactaaaaaaaaaatacaaaaaattagcagggcgtggtggcaggcgcctgtagccccagctactcgggaggctgaggcaggagaatggcgtgaatccaggagtgggagcttgcagtgagccgagatcacgccactgcactcagtgtgacagagtgagactctgtctcaaaaataataataataataataacttcagtgtttttttctctatttactcagttttccagagggaaggctaagcttgttccatattaggaggttaaaaaaatgcgtacttcagtgaccaagagtgtttatacctgactattttaggctcaagctctagggtgggggtatagttgattcacagattttttggattttgattctgaaatttcatatcctggggtgagttatttgcaagaatttgtagtgatgagcttttgtctccctgtgctagtgagttgttttgctgctgtgtggtggaggccaggacttttcagggtgatgcctccactagctactttgcagggcatcatagccaactgagagtcaaaggtagatgtaaccacatgtgaacttcagactttccatttgacttgcatctccagccctctagaattattcactgcagggatcagctccattgttcatgctttctatctcttccatgtccagaacggcctgagtgccacgaggttccagttactgcactattatatgttcgtgtcagccactttcacttgggctctcaccatgattatgaactccttagagatactcaaatacatttctcatgagggtagctccaaatcattttcataatctgccatactttccagctaaataaccttactatctacttctttaaggaaaaatattagggtctgtaccattatctttcatatagttacttttatatactttggaaataatttaatgtaaaatcaatactgcatattgtgggacaatggaattacctgggttttggagtcaaacacatgtgagttcaattcttagattagctactgaaaaggtgggagggtttagaaaaattattaaagctctgtgaactccagatctttttttacctaagtgtgtattataataatagacactttgcaaagttatcataaaatataaattaataaatgagataatattgatgggataaaagtattttgcataatttttggcacacaataaattatcacagtatgcattaatcgttttaacttactgagtgatataaaaggatattttgaaagtagttgttattaacacaaacatagatttcactttctaaactacattaagtggtcaaaataaaatgtttactcaataaagtattcatcagcatgtttttaaacctataggaattctgctgcaatcatattccagtaactgggtaggtctggttcaggtattgtactaaaaggagtcatgaactaggttgtaaatgattttgtcaaggtgtcagtcatgtcatacatgaaagtatgctgttgtaagtctgtgagagtcaacatgtgtgaaaaataacaatgaagggccaaggaaccaccacgacaccttacagaggtgtattattggacagccctgtgatagctgtgatagctgaagtttgcccaggctgtgatccactagtttttagcagggtaatctttctgtgcaaaaatgccacacaattcaccaggcctccagggagctgggaaatcacaaatagacagagacttgaagagtgggtggatttttttttttttctttaaagcagcagctgttagtttaaaagatagtctttagtcttgaaaaaaaaaaaaaagaaatacaaggtatttactgatttctatagcaagttctatattttttcttttcccttacttcttctaattccaatgttatgttttttaaagtaatagtgataattttatcagtgtctctaatttataatgtctctagtaagagtagctgttatatcaatatactataaacataccctttcttacttgtcactccctcctctccttctgcttcttaccttcctttcttgtctctctcttcctgttcttcctttattatgtatatttaactcatgttattctcacaattttttttttttttttgagatgggatctggctctgtcacccagaccggagtacagtggcataatcattgcagcctcaacttcctgggctcaagtaatcctccttcttcggccttctgagtagctgggactacaggcatgtgccaccaaacctggataattttttaaatttttttttgtagagacagggtctatgtggcccaggctgttctcaaagtcccaggctcaagcgatcctcctgcctcagctgggattacaggtgtgagcaactgtgcctgaccacaagttgcctcttaaatgaataagtggttattagagcagtcatcattcttctgacagaaaaccttcctgacaagggtttcatatgtgaatataatgaaagcaaaatttaacttttaaccaaaaatgttgcagtatattcatttgaaaaggatgacacagaaaggataagtagattatttctgagaccccatacacactgtctttacaattccaagattcataattctaatatactaataaaatataaaacttttagtgtttataaatagacaaaaatacatgtggatctcttataccaactgaattttatatattaatacttcctcgaccaaaggtatttctttgtaatttttgtcttacttttacaaaacaggaaaatgagaaaaaagtaaactttcactagacagaggtagaattttcattggcatctctaagaagagtatggggagactcagagctttcagatggcttttgaggaaactgctttgtgtttattttgctgccttccttcactttttccctctagcaaacacagagattaaagatcagtgtgttggccattctactgtcatcacaacataaaatgttttctgctctcttgagctgacatctcatcagcactaacagcttgaccctacaccccaatggtatataggatatacctgtctttaaaatgtgtgaacagaatgttatctgcagtgatttttctttttatcctttgatctgtcactatttcttcacaatgtcaaaagcctcagggcttggcttgaatggtgatcaaacccaaaggcacacaattttgggtctaatcctgaatctacacaatcaaaaatcttttcaattcagacccaaacaccatactttgtcttacaatactgaagtgcagccatcactaaagcactgctttcccctttgagctttttaaagaatgaatataatgaggttataaagaaatgaaacatttcttttaccaactgtactataataatacatgcatctaaagaaatgcatgcttccatgacctttcagaagattaaactctttcttggtgttgttgccattgcccacaacacttattgtgaaatttctttgaaatctacttcaaagatattttcccaggttcatcaaaaaaatcaaagtgatcaatttattttcacagaacattcaatttacctaatactttcttcctttcattctttctttacctccttctacttagacttgacctctcctgcactcctctgattgttgattcgctttcatttaacaaatgttaattgaaaatcaagctctgtctgtgaagatgacttccctctacctgtattaaactgtactgtcgaaaacttcctctaagtctctctaccccattctccaactttgcaaggaacaacactcctgatggtgcctcttttaataggcctaatcctcacctcattttgtagaccctctagctgttctgatttttttgttgttgtttgcttttttgaagattaggctaggacaagacctcctaatcccaggatttgaaagacaaagttgtaccaatgaacacttaagcagagggacatcaggaggtgactaatttatatgcatgtttctaataaaattatgaactatgactgggtatcatgaataactagaagatactgttccatcaaatctgcacggacactctattctttaactttcctcctgggcgtcataaaaatttttaatcttatttccaactggacctctccagaaccctgcatgaggaactcaacccaacatgtttaaaactaagtgtattttctctctacagagtgcccttcctcttatatttattttaattagcaacacttccatcacctaaaggaaagtgagttagcctagattctattttgttatccctttcatctagccaagtatcaccaagtgtcatacaatctatctcctacatacttcttgaatcagcctcaggttctgcatctagtaccacagctctcatcatcatccactagatgaatgtcatagccttttagatctttctgcctcaggatcatctctctccaatcagcccttcatgggactatgaagatgatctttctaaaaaacaaactatttatgtcactgtgtagcttaaaaagtctttcttgtttcctatagccttgaagataattttccaactctctgctactgcttatattttgagcagctaatgctacccttttctcactaaagaaaccaagcacaagcaagaatgcatccatgataacatgttctcccttctcatcttctgttttgagcagtcttcttacgtatcacaataataattgtgggtcatttctatcacagcactgtcacattataacttgttctcttgaatgaacttcataatctttaaggagaggggctatcacccaatatttggcacagtgcttgtgataggcagaatcatgcctaatcctgagagcctgtgaaaaaaaatatatataattatatatataatatgttatatataatatatatgttatagataatatataatatatgtaaatatataatttacatatattatatataatttatatatataatttacatatatataaattatatatataaatcaaatcagacaaggctgtgcatttgcaggttttctttggagggtgcttttccctttattaataaagaacagatcaccttatttcctcaggaagaggtagaaattgaagggctgtaataacgcccctttctctgcctcttcatctagatgaaagcagatctaactgcgggtggcattaaaaaacatgatgtgaagaggtataagaaatatcttcttcacaattatgcctccttcatgagacctcttacatttctttatttcacctatatttagaaattatgtcaattaagaatccccatttgctgttagctgttggcttcatttgagaagttactacagatgtagacctgcggccaacggaacaggcctgggtggaggaaatagaggcccgcaaactgatctggaataaagaatgaataagccaagaattaaagacccccatggatgctagaattcagaacatgacagaatcagaacaatggctcaagaatttgtaattattaatgctcagaggcgaaccaaaaaaaaaaaaagtttcactttaggcaacaggacacccactgccaaagatatcaagggaatcagtgttcttgttaacagcaatactttgggaagctttgcactcataggtgtgggcaaatgaaagtgtagttatactgaaaacaatgatctgtagagaactttgaaactccaagagaattttacaattagctacatctttgtgtgaatcatctaagcaaactctatgtctcctaacatctacttaagttcggccactctgggcagtgggtgaaaagtaagaatgttgaagaattttaggtcaaggtaaaaaacacaagtgatcagaaataacaagaaggaaaaaatcagaaactgttaattttagtaaaggcagcacctatgcatatgatgcactcctggcctccaggagtttacatttgttagtttcccttcaaaacctaacaacatttacatagagggcatacatttttaaacaggtgtctgtgtgaggtgattaagtgattatgtttttatgttttctctgcttggagatatcgtgattcacttgagtcctcctctcaaggcttagaggaaggaagccgactcagctactactgtgagttctcttcaatgagatatggaagattagctaattgttcaccaaactgtacctcttttcctcctgagcaggcagctgtatttcccagcatcccctgtagttaagcgcaggcctgagttctgccaataaaatgcaagaagtgttgcatgacaattccaaatctggctctgaaaggcttcctgctgagtctcccatgcttattatcttccctcaattgactagtgaggtgcaaatatacagcaggaaaactcgaggccctagaggatggccaagtcactgtgtgaaaggaaccttagttccctgaatgattgcctggaggaaaagtccctctcagcctcacttacctgcactggactgtgataattataaagcaatcagcctttttcatgtcaatccactgagagtctggcattgcttattacaactggttaacctaacaaatatgtatgggtatctcaggaatgcttcatagtgatccatttatcttctttatggttgtggaaagtgtgtaacttaagaacacttttatgtaaagcacattttaaaatatgtgcctgaaaagggacagctgaaaacatgtacatatgtataataaactatttgcaaaaaaaaaaaaaaattggggggctttgactgttttaatacatctcctgttatcttcaaaactgattttaagcagtactttaaaaagaagtgaaaaatcactggcttggggaagagaagaaaatgaaataaacaagacatccaaagttacttgaatggatgcacattcttatatatagctggaaacaaatagtactttgtgtcaggttttacagtctgtgggatctctcagatgaggttcatgctgtgaaaatgaattgcaaaggagatgacaagaacagatgtttgctcaagatgactgaagatgtttctgaaagcatcaaagtgtacagtctacaagttatcagcagacaggtagattgtagccaacttttagatttgtattttcagacaaaattggcttctctaagggtagttttattatacttggtaatgaaagaaagtgatctgtgtgtcacttttaacttagattgtgaataatcacgtacataaatacatgtgacgcatgtttatttcaacccaaggcatccctctttacaactgagcaaagaacatgcccttgtcaggccccagattgtgatgctcaagacctcacaaatagaagcaggaggccctatctgttctttccaagacttacactgcctaggacgaaggtccacaatccctatgttgactaatagtaaggctaaaagtggaaggaatacagaataatccaatctggtccactcctactctaaagccctgactgtaacagaatgtcttctggcttccaatagaaacaaggaatgacctagaagctaagaatataagcttatgaggccgacttaaccaattatcaggttggacatttaaatgtacctgtgttatataatggctgttcttgcactgcaataaataaatatctgggactgggtaatttaaaaagaaaaggggtttcattggctcacagttatgcaggttgtataagaagcacggcgttggcatctgctcagcttctagagagacctcaggaagcttacaattatggcagaaggcaaagcgggaacaagcatatcacacggccagactaggagtaaaggagattgggttggaggtgccacacacttttacacaaccagatatcctgtgaactcaagagcgagagctcacgtgttatcaaggggatggcctaagccattcatgagggatctgcccccaggatgaaaacaccacccaccaggccccatctctaacactagagattacatttcaacatcagatttgggtagggacaaatatccaagctacagtatttctctgtgtttcattttgaagaaaatgttaaatggaagtaataatattttctcacagcattttttgagaagtaatataattaatacatgttaaactcttttaagagtgtctgatgaatagtaaactccatgccatccactatatcatggttatcattcatggatcaggttaaaaaaaaaacgtagaggatagggaagtccccattctagtggcagtcacagaccccttgttctgtgattcttggagagcaggcaagcccctacttcagtggcttgcctgctagatggaccaggagacttggagtcaatagttctttgatacactaatccagacccttcacaagcatgtggatccagactcctaaggggtgatacacctctgtgcctgtgctgatgagcgggtccctgctctggccactgctttgggataaaaagcttctcccaggcaaggtggtcccaatcctccaagtggtcaacaatttctgtcacttactccccatcctggcccagaacagggctggggccctggtcctattgccattatcttccccaaaatcctccagaatctgatggcccttttctactagtgagacagagtccattataattcagaaaacaaaagaggaattggaaagtatctgcccctatctcccagaaaaatcttcagatttttataaaaattggtatatcttactgcagagctatacaaagtgaaacaagtgttttttaaaaatctgaaactgtaagcccagcaaaccttccaatctaaagaaaattctgacaaaaccaagataggccacccaagatttgctccaagaaaaaaaaaccatttctggtttgcatgagtaatgtgttattatttataaaaatattgtcaagcacttaatataaatttacatattcttgatatatcattttcctctttaataaaataaaattcacccaaagtatatcatagttctcaattagctatgttccaattactgcataactttttcataaattctatacatacttacgtgtatttaatcataaaaataaaataattttaactattatctaaatatatttaaaccaaatatttaagtaggtaaatgacataaatatagaatatttacatacaatattaatatatatcaatatataggttcaacaagactgcatttagaatattctatataattctgtgggttgggtatgacacatttgagtgcattaagaacatactttttaaaaaatgctgatcattgacattcatatattaatacatgaaatctgtatatatttagaaaaaatatttgattccaactttaattgcctcagaataatgtaagatttttaaatatagtatatgactacatgggaatttaattaaaaacctatgcttaatgaattggtacaatgaagatcttaacaactcaatgggatcagtttccatataggtagatgtcccagatacaaacttttctaacttccccctaaaataactataaacactaaggaaaacataaaaggaaatacctcatttaaagcaggtacttacagtaagcctaattccaggatctggaaagaatttcaaaatggcttaaagtggattttaaagcatacctggtggattgcccagaacagaaaacacttgctcatctgaaatcatacacacacacacacacacacacacacacacacacacccctaaaaaaacaaaactataggtcctcccctgctgtttgcctctccacactcaatatctatctcccacaacctttaagacataatagaattttaacaacctgaaaacttgagtagctgggcattacagccagctgggatgtgtatagcaagtagttttttactagtattattgtatgtacacatgagcacaattaatataagattacattattgatgcttacattctgatatgattgacatgctgaaaggggcggagctactaagccctatagacacaaaaggaagtgagtcatgcatgtgaacctcattttaagaaatgccaggaagaaaattgttgagaacttgtctactccacagccactgctttaaaggcagcatgagtaatctatctgccactatccgccacgcaccctccccactgccattagtgctctcttcacagatccagtaggggactgcagcacatgggtagcaaatcaaggaagggagaaacacgtgaactaaggccattctcacagtgctgtgccacacaaagctcctcctgtctgtgcccttgctgacagcgctgcttggaatgctatctgtgcagaaccactaatttccctttgcttcctgaagaaatatggaccccagctggctggctcacagcgggagtagaagaaaagatcccattgcagagcagtaatgatgcagaaaaggaaagcctcctagatactaggaactgggcttggagctttgtgttccaattgtcttctcaatctgtgaaagaccaaacaaaggagcagagaaagaatctcagaaaagcagcatacccacactggctctggagaggtgggccgtccacacaaatgcacaaataagaaaataaaaacatacagtaactttgaaaaacactcgaagacaaggaaaacttgattctgaaaagtcataggaagagaagacctttgaaaacacttcaatacaggagctagatgaacaactcagaaaactgatcagctcaacaggtgacaaggagggacaccatccatggtccaggggaggcttcctgctggcttctgggccctatgtgaggtgctcccagctgcctgcccttattccctgttctgcccaccctgttctccttgctgtaccttaaacatgtcagacactcttctagccagaaagttctttcctgagataatcgctagcctcaccacttcatttccttcaggtctctgttcacacaggaccttttcagaaaggctttttctctgaccacactgcttaagtagcagcttccttcactctttttctcctcaccctgccataaaggcttcacagcccttgagtgcaatggcaagctatcatagtgattaaagacctgattccgtcccctcccacctgtatgaagttcagctagctattcaccctccctttgcttcattttctcacgtggcaccaattgtagcccacatgattgctgccccaccctctcctcagtcaccattccagagtgctctgatggcttcacactgctagtacctgcaatctgtagccagaaaatgtcatctggccccaggagcatgttcaacctatgtgctaagcaggacagaagagccaaggagtcaaaactccagggaatggccttcacactatggtgagggggaagataactatctcagcttccttaccccttgggtggaaaaattaaggccatgtcgattccagaagtctgcagccaaactaagacccagttgcccatatcctatatgccgtgtaatatatttcttctcctttctctccctgtcttagttctccactcttttaccagtccagcactggggaagtagcaagcaggtaacttcactaagttccaaaacattaattgtgttttccagtttagaagttctgcatttggcagatactgggtaactgactagccctaaatgaagtgacttttgtatgtgattaccttgtgtcacctatgatttctttttcctcatctaagatctcagagagaggatctcgagctctgaaatcccactgaagccttaactcaaaattatttttgggtttgtaagaataagtaaatgtctctcaagtattgaggcaaaagtaaagaccttaactaaagaggaatggacatcagattgtcctaagctacctctactacattaactgctggatgacaatgtcacaaatctaaagagttctggagcaaaagtctgtgttccaagctaagataatagaaatatagtatcagatatgcaagagtttagaaagacgatcttttactgagaaagttcaattggaaaaacaaaacacatcgatcaaataagaggagaatcaaaagtaacaacttaggaataaagaagtaatgtaagagtaatgtttgagtgtcttctattcagatcagactatgatgtaagactcatggaactaggaagattagcaacagttccacacataaaccataaattgtgtcaaagaaatagtactagcaatgcactgatttagaagttgaaataatttgggatcataatgaaggctatgaagcttgatcaaagatttgaaagaaaagatgtgtatttgtatggataggaaaaaaaataaaataagagcacttttgaagttggaaaatgcctgagcaaagatccaagattagagatgctcaaggtcaatttttgccacagtgaatacaccagctggactggaaatacagaaatcactgtagcatatcaggatgtaaatttggaaaagtgaatttggggtagactgtggggggacctggatgtcagaccaggaaattaagaatattttattttgtaaacaatgtggaactgttgagaactttgtgaaaaatcaagtagctaaggggcactaacctgtatctgtggaagaatgaggcaggatagaagcctgtcacaaacatttgaaaagagagaagggaacgtgaaagatatagtgcgataaacaaaacagcaatagttggtaactgcttaaatatgaggctcaatatggagaaagttactactttgatatatcaaagttaagataatgttgaggaattaaattaaaaattagggaaacaggtagtttagatacacagcatagaaggaataatgttatttactatctacatttagggataatagttggcatttacttaatttagttatcaaattctcttttcgataaatctgtataacatctcttttctcgaatataattgtttggtaaacattacagcattttattaacaaaccttgttaaaagttataacaaattatacatgttttaagaattaatttggaatacaattatatgcttaaagggacctcaaagaatgaagactttagatgaatttttcatattaagccaaatttgtcaattggaaagaaatgtatataaaagattttttccatcatttgtcttctcctggtgtcccaatggtaaagctataatattgattaattagaaagagatctcatagagaagccattttattcactctgataccctggccactctcaggaggacgtgagagaaccactcaatatcctgagcacttcctgtgtaactgacttgcctctagacccaactttgaattaaatatttgccctggaacttgaatcatgccagaaatttgaagaatcaccttttgcgtttcctgatttctatttccacctattccctttcctatatttatctttaatttctaaattttctagaaggagaaattgaagtaatattggccgaatattcccaatggtagtaaacaaaagagaaacaaagtacctaccagaaactgaccatcttaacttgtgcattctgtgacattttattaccaaaatgaactatttctacgcatcccaaatctcctactgacttctacaattaatatattcccatattccacaataccaccaggaataagtcaatatttagattagaatatttctccagcacatgcacaattattacaatgatcatggtattatcaatacatatatgtattcatataatttctatcataaatatttttccagagacaatgagactatatcattttattatttcctcattttctatgatgtctaataaatatccataaataaaaaataaatctaagtaatcaattaagtatattatttgtattattaaggagtattttcccctttttaaatgagatgttcttaaagcaatactgtaaagaattctaacagataatatatattttctattttgagggtataacatcatttgatattggaagaattgccatggggtaaaaactggaatatggaaagctaccatattgacaatccctcagcatgcaagtatcaccaaaactcttacttaaatgtgctagtagttatttcttgtatacagtcattaaatttagtttgtagccagaacaaacattatcataatatattttttcaccatattaaatgtttaatataatttcaataaactaatttatactatacgactgaaaaactacaggcagattattaatgatgataaaagaccagttgtaaaagaacatctgttataaaagttaaaaggcccattaagaaattatgtaattaagtcttctatatccattcggagcaacagcaaatatctctaagtcatttaagaaaaatccaaagtccccaattaacacattctttttattcttttgaattttgcatcttgtgtgaattgtgccttaagagttattagtagaatctattcatatcccaaattagaggaagacatattagtgaggtcaacctctctagctgtaatcacttagcatatgaaagaagaaaacatatttttcctgtttcattaaaaatgtgaatatggcgtatagagagctttataaagcagatcaaaaaattcacttatccttatttgtgcagtccatttgagctagtaatttctgcttaggtgaaggtctgctcaactatgttacagcatatcacaaaacccacataaggaaaataccttcatttatcattgttaaattttttcaagtgtagaatactttccattgaatcactgtcctctgtaccaaaatttcaagatatggaaaatctgaattttcttaagaatagtttaggaataaaaaaatcctgtttagtttaaaggcatattcaagctaaatcagttatgtttaggtcacggttgcccaaccatggcctatgggctacatgcacgtgtcccaggacagcttggaatgcagcccaacacaaatctgtaaactttcttaaaacattaggaaaattgtctgcaattttttttttaagctcatcagctatcattagtgttagtgtgttttacatgtggcccatgacaattattcttcttccaatgtggcccagggaagccaaatgactgggcacccctgatttacatcatgttagtcatcacttttttttcttcttcactaactcacctataaagagcaatgtccttcctgataaagtgataaagtgaaaacaatgttagaactattaaaggacattttaacactaattgatccaacctaatggaaactgtaataaaagaaagattagcaaagcacaaatttttcttgcttttactttgtgaaagtatttgtttactttattatatataatatacattaaattgataatataataatgtattatgtcaggctatatgtttggaaatgaacagtgtctctttcttcctaattaaaaaaataagtggcttgcttggaaaaaaaagaggaaaaaaaaataaagccctgtaactaagtctcatttataaatattaatgcaaaaagttctcaataaaatactaaatattaagtaaaattaaatctaatattatattaaaaacaatatacagtatcaaagaagcatttattccacaaaaaacagtgtagttagacatttggaaaaaattgataaacgcattaataacggacaaaaatacatcatcatgttgataggtgacaaggcatttgacaaaatttatagtgtatctatatttagtaaaactttaaattagaaatcatttttaggatggtcaacagtgacatcagagatcagcaggcattatttaaaaattgcagtattagaggattagggtcaaaacaggaatgcccagcatcacaatcagtattccatgtcattccagatgtgctaaccaatgcaattagacatgtaaaagaaataagaataaaaataactgataatctgaaattccactggaagcagttagtaaataaaagtgctacttaaaaattattattttaagcatatcaataacttcttaatatacctacaattacctgaaataatgagaaaaatttaattagcagtcataacacattaataacatcagcaaatatcaaatctccataaacttagtgggaatttcccagaactacattaaaaattataatatactactgagagataatatgagttgaatacaaaatgtacacattgctcccctgtacagatatagtattttctcgaagttgatctgtaagtttatcctattcctaaaaaaattccagttaagtggataaattttaaaacatgtatttatatgttcaaaaacaaagccagcaaaattttgaaacccattctaatggcagtggcttgccctattagatattaacatatatcatggcaatattttaaataatgatatactagcacaaaaaaagatagccagattaataaaatagacaattcatagcagatctagaaaatataatattgtatagtaatatattcttaatatttcatattattacattttaataatatattaaaatggccttccacatcactaaaaaaatttgatgagttttttgagaaataactttggatactggctatcaaaaactcaaaaaattagatgtctatttcataacttacaacacaaaatgaagatgaattcaatgtttcattattaaaatgacatcatgaaaaagctacaagaaaatacgtatttttaaaagtcctgaaagcttactatggctattttagtttaaaacgaatttcccagttcaaagattgacctgtgaacaagatataatagtaaacatgaacttatcaggtaagagtaaaacaaaatattttattgacatctgcactctgggagcagtggtgagaaaagagaaaggtgtttagcaccaggaaagagagacatttggtagtcagtaatcaagggagggtttgcttatttatattactcttatttagtagagagttggtagtacaaaagaagagaaacctttttgaaagttaatatttttggccaatccaggcctttcacaggagatcttccataggactgttacacatttctaggcataacatgacagaaagtgcagaggagaatcttgatggatgggccctcacaatttgtttaaattgctgtagggcaagtaacaccaaatatgaatagatgaattacagaaatacaattgtaaaatatatgtcagacaacagattaatgtatgtattctcaaagagattttgacaatcaaaaggaaacagaggaatattccaaaagaaaaataggcaaagtaatgaacaggcaatttgcaaaagaataaatacaatggctaattagtatacaaaaactctaaatctcattaggaatcaatgatattcaaatttaaataataataaaattaagttcaccactgatgtatataaagatgaaaaataataacacccagttttggtgaatgtgtgggaagatagataaattgatctgttactattatgtatatgactatgaacagcaatttgagagtagctatcaagaatcttaaaggcagggattacatgcctaagaatttttccatgaaaataattgaacaagtaaattgttgtcatcttcttcatacacaaaggacgccatgttgttaccgagattaagataaattatttattttttcagaatgaaaagctatttactattgtaaagactctgtcctcgcagtagactaaaatcaagaaaacacaaagactcttttttagacggcacccacaattcaaaagctctaatcacaagaacaaagagagacacagaataaaagagacagatggagacaatgtgagtcccatttgagcacctgcagggaatgggttctctgaacagtaaaaagctggaagccgaagcagggacacctgggcattacccatctttctttccctggatgagaatgaagccttgctaatgctaacttcaattcaagaaccagaagagcccaatatttttatacaataccttaaatagaagtgcacagattgttaatgttaagttcttccagaaggctgatgtaagctctgggtacaaaagactcatggctcagcacaaatggggccttttcctacaccactctagttagtatgggcaacaccaacagcaattctgtgatctattccagaaccaggggccaggaaatcctccgacagaatgtgccatgctaaaccagaaatataacctaacttaacacatacacatgtacggtctcttctcactaattggaaatgtgcaacacctttacaactatgtacctatttaaattcttaagccatttttatttttaatttcttaagccatgtgcaaacataaccccctgaaagagggatcaaacctgctctagagtttataaacacaatctgctgaaacaagcaaaagcatttccatttgtcatgcttgatatactcagcccatcctgtaatttgaacaaggttattcattaattaccttggtaattaatgttatgtcaatgttatgacataatgggtgtcaatgttatgagtttataactgcaaactggatgtttttgtgtccctctccttacatttaggcaaaaaactgctttaaatatttctaacctttgctactgtatttcctctgaggctacacgatgccaagacagcttaatagaaatggaaaagtgcagtcagtactactgtaaatagctttttcatatgaaaccaaatatgcttatgtttgtaaatatccaaagagtcatctcattggaaaatctttaagtcaatgttgttggcatcacagtaatactgttgagtttctagagattcaaaatcatctctccacttactaccatttcaataaaatacagtctttctcattctccccctaatgataaccttgaaaccaccattgcaaaattataactgagacagtgaaagagatctgacctaacgaactccatcttgcttctaaccttcaagctgtcctgtccctttgggaggaactttgtttatagtttaaatcaaagatgataatagccctttctgaaaacaaacctccttcctgcctggggactagactgcctttgtaggactaacaaattagccacaagattagaaattatggtttaggaatcatgcagctggagactacaagattccgaccctccccaaattgctcctgagggtaacatcactattgtaaagcctaagaccagtgcttcagacattttccagaccctgtacttgatagatcagctggcaccacccaagatggataagctggttcatctgatcttgtgatctccaccaaggaactgactcagtgcaagaagacagcttcgactccttacgatttcatctctgacctgaccaatcagcacttccaacttactggcacccccacccaccaaattatccttaaaaactctgatccccgaatgctcagagagactgatttgggtggtaataaaactccagtctcccgcacagccagctctgcatgaattactctttaattactctttctctatcgtaattcccccgtcttgataaatcggctctgtctaggcagcgggcaaggtggttacaacctctctcatgatattaaatttaatactagactgaaaattcactagtatgtaatttttccattcccttcctgagcaatgtccagacgtacaaaaagccatttcaaatgaccattaagtttttcattcattcagcaaacatctattgaacacctcttagctatgcactaaactaagtcctgagaatgtaaggtcaagtaagtcatgactcccaccctcaaaaagctgtagtctagggtggaggcagacaagtaactttgcaattcaattgcagtatggtaagtgctacctactgataaaggagcatgtaggtggaacatcgaaatcagactaacactaacgagggtgatctcaagccagagaagcctttctagaggtgacttttgacctcagttttgaaagataaagagtaaaaggtgaaatggggttttgaaaaataaagagtaaaaggtgacatgtcaaaaacagaagagagaattattcaggaaaaggaacaacatatgtgctatcataaaggtgggcatgacccatttccagaatcacaaagtccagcatagccagagaaaagggcacatacagtacaaagacaataagaaccttttcaggacaggtatgatgtgttaagccaaggagttgaggcaggatgctgaaagctgcagggagctatttcatgactgtaagcaagaggaaagtatgatgatagaagtgttttgaaaacaagccctctggctgctgcacgtagcccactagagagaggggaataaaatgttactgaaataattaagataggagcaatctagtggggaagaacaggtttgcaagatatttcattaccggtgaaatactgaaagcaagtttagtagtttaaactggttcaagtttgctgacttggaagaccaggttggatgctgtttaactcactaagatgagaaactcaagagaagaaataggtgtgaagtgagagttaatacacctaattttgaacttgatgagttgaacatccaagtgaaggatacagttggagaagtgaaaggtctagatctttctagagagatgagaatcatctgtatagaagagaaggctgaagccataggagtggtcaagattaccagtgtggggggtgagtggggggttgggggatgcagaaagaagaacagaggaaccagcatagagccctgggaaattctacgttgaggaaagcatgagtggtagatagactacaaatatttaattgctagaagaggagaaggaaaagaaggaaaaaaaggaggagggggaggaagaggagtaggggaggaaagaaggagagatccacagatgttgatgaaaaactccaagaaggttaagtgtctcagatgctttaacaacataacttaggatgagcagcacaaatgtttggagccttcagcaacgtgcaaatcagatctgaaggaaatattggtacagggaggaagaaaaggagaaggaaccagattccagaaggctgaagagggaaatgggcagtgtggctgtagtgtagggcagttttccaaacagtttattaaagaagagaaagaagaatgcagacatcctcatatcaaccactacatttaaaaggactaattattattatccaattctttcacaaggcatatgttggcaacatccttttcaagcagaaataaggtctttttaaatcaattttaatggaagaaaagatatactccctttccccattctaatctgatgacaaaagttctaataaagtagcagtgagaacaggagcagtagctgggaattagagtgaatcaccttgagattccatccaaagttactcaaaattgtgtttgcacacacacacacacacacacacaccacatacaaaacatagtttatattagtaaagtataaataaatatgttatattcacctcttagcatcttacatctttgataagaccacggtgttacgtttagttacctaatatttaatagcagtgttttatatcacttctttccaagagatttaaatcactgttctcaattttcctaatgcaatcttctctcattattcctttttgagattggtggtgatcctcccacaacccctttgtataattattttcagttattactaatgcttgtttataactctgatttaacatcagctataaattacagtcatgcaccacacacatttcggtcaataacagactacatatacataatactgaatttttactgtaattttctatgtttagataggtttggatacacaaataccattgtgtatctaatactaatacaattgcctacagtgttcagtacagtaacatgctgtacaggtatatagcctaggagcaatatgtaccatatagcctaggtgtgtagcagactataccatctaggtttgtataaatacttctatgatgtttgcacagtgacaaaatcacctaagaacacatttctcagaacatgcccccaacgttaagtgacacatgactgtatcaataactataatggtctacatttatatagtattggtctgagagatcccaaaggacctttccaaacaatacatttttcacataaataaatgccaggcaacattgagaatgataaaagcaaccagtcacacaattaacatactgtttacctagctcctgaacaataaaaatgcttctcaagactcaagctgatatcaatcacaataggtactccactgaacaatatgccacaagctaatatcacctctgattattaatatggggcaattttttattccctaggagataacttgtatcaagtcaaattgaattggtttgtacaaacagtacgaagacagaaaataagaaccttttcaggacaggtatgaaaaggatcagtggcattttttaaagtcttgactaaaatggtactttatgcataatttatataaaatctttcttatactgagctttttctgctaaacagggaaatctgtgctgataactgaaacaaaaggtggtcccaagtcacaaattgagactcaagtaagcactccttccctgaccttgaacaaatcatttatattgtttacctcagtttcactgctttggaaagaaaactctatcatttctgacatgaactcagcaattcttgatttgaaaggtcatgaaaatgtgctgagagattcctctttccacaggtggttttggcagcagagtcttgtcttaaagattcacgttattcaggtatttttgttaacctgccataataagtagtaatgtagaatttcaagaaaataccgaagcatagacatttcccaacggagaaactctaacaacttcctgcagtaaaccacataagatattaacaatagaataacccaaaatacatcttcctatctaaaactgatattactatgaaaatgagaagttgaaagtgggggaacttaagaattagtgataaataaaatcaatatgggcaattaactatcctctatatagaaaacaattgcaagtataaaactaatacttgcttatatggctgtgaataaaaccagtgagacgtggctacagagagtaggctttcaccattacactcttctggtctgactccaccaaaaagcttttagaaaatagattactggcagtactcgggatccactgaatcagaattccgtaaatctgtgtgcgtacgtgtgtgtgtgtgtgtgttcagtgttcccgagttgattctaatgaggctgtttccaatacacagaagtcactaaccttgcttacctgcagaaaaccaccaccaccaaaaataaaacactgttttcaaacagaggaaaggaatcatattctccaagcatttggttttccactgggaggactgtcacacaatagcttttaattcagagatgcacatgatatgtctgcaagggtagagaattttgtaagcatcagttgctctcctctctgcttaccctgggaacaggccaggatttttccttgtaactctggtcctgaatgtggcagaagaactgaaatgtcctcaagaagaccggtctaacacgagctgacagcatgatgtcatgacaagaacaaaagttctgaggagcaccacaaatagagactaaaatcctagctttgttatttacgatagtataataataaggggaaattatttcccttattaatctccctgagccttcgtttccttctttgtaaaatggaaataataggagccactttcacaagattgtgggaagcagtacagcatgatgtttaagagtggatgcaaatcccaatgctgtcacctacttttaaaagactaagttccttgtctgtaaaatggggatcccaagagtaccaccttcagagagtgatgaggaggaggattaaatgagacaacacatccattacagtcatccatccctctgtataagcttggaattggttccaggacacctaccccccacaccaaaatccgagatattaaacttccacacttggccctgcaaagccacccacaggaaaagttggtcttcagtacaggcgcgtttcatacctgcaaaccctgtattttccatctgcatttgggtgaaaaaaaatccatttgggtgaaaaaaaatccattagatccatacagtttaaatctgtgttgttccagggtcaactgtattattattatgattgttgcagtaattaaattaaaatattgtaacaaaattgggccaatgtttaaaccttattctcacattttttaactttatataggtagaaagacatactggctatgctcaaaagtctatgtaccaccagagaggctgaaaaggcaagggaaaaggcagcttgaaggcaagttttaggactgcaaagcagtcctacaacagtatcctatttcctttaatttgggactttaaaaaagatctgggtaagcatttcaaggattaacctcacagcccccaccccaccacacttaccacttctccaaggccagcccgcacagccacctctcctacggagcatggtggccaactcaccattaatcaaccacgccaaatattttaccctcagtgcccagactcttagcctgccttctgcctggaatataaccgacaaaccaagtccccatccagcaaaatctcacttactcccgtaagacctgacaaaatactccttcctctttctctaagtttctcagtcagaatacattattccttccactggactcccataaagcaatcatgtgtatacctaattctagtcactagttaattactaattctggtcactagttaattactaattctggtcactagttaattctgatgtattttaataattgcctatttataaggctggctttcctttagatttcaagttttctgcgggaagggactctatcttacatatcttcatttccaccacttccccaacagaggctgacccgctgtctggcatattgtaggtattcaacacaaatttgttgaaatcatatttatgcactggggactgcaatgaatggagcccaaagctcacctcaatcacttggtacctcccctaatggctttaactcattgtatggtatatactaaatgaaagtgtgctttgaaaaataaagcataaagccattcatatctgaaaagtagactagtgcataactgagcctaggacatatgtagtacgatttcagtgaaaggatacaactgattggcagtttaaaaagtcatgttcccatataaaggtattatagcttaatgtgctataatgcagatccagtaaaatccccaccactcatttttaaatatttgaagacatataaggtaatgtctcaggaacacagattgattttcagtggatgtgctattaaaatgatccacttttcatatcataccctatgctgaccctttagacaagtgtcttaaactatactaaattatatttcaatcacaatcctatagcaataaaaaataaataaaaagaatatgcacctggagcgaaaatggaacagaaacatagccattgctaaacataacattttctctattttggtattacttttaaaaatttagtattacttttaaaaaattataccaagtggaggtattaaaattttcaatcaaagtaatatttgagttgcttctctaacagtatacgttgtttacatgtttttgtaagccagtctgtttcttcttacttcatacaatagtacttacagagagaaattatttagaatagtggctctcaatgtagtccacagatccctagggggcccccagaccctttccagtgatctgccaggtgaaaaacattttcatagcaatattaaaattgtatgtgcctcttccattgtgttgacatttgcacttatggtaaaaaaaaataagaaaaagaaaaagcaacaatggtaaaatcactgatattttacaatgaggcagacagtggtgccgaactacactagtagtcatcatattcctcactgctacacacttgcaatggaaaaaataaaaaattgctagtttcacttaagaatggccaagataaagaagtaaaatttattgattaaaaccttgatgtgtgagtaaaaaaacagtgaaatgtaaaactaaagcacttctgttccagaccaaagcatgacgcttgactcaggaggggtgggggagcatttatatgattgagttgtgatctgaattagccatctttttaatggcatgttttttcttgaagaaacgactgacatataaaccatggttattaagacttgggtgtttggaagatttttcttaaaaatgaataaacttaaactattagctcaagaaaaactgacagaattttctgccaatgataaaatttgggccttcgtataaaaatattttggaaaacttgcatactcctcaaatcaagtccaggttttctgatcagagttttctgattacactggtggtgatatcaactagcgtaatgttttgttattatacaataaaatgttccaacatttaaaagagatacataactcagtgaaccaatattttgcaaatatttcaaagcttctatgattaaaatatctatttaaagcacaacatagaccaatgaattttaagtttattgaactgtctcagaaaactgaaattaatctttatcaaacaatatttgtcagattttggtgtaataccaaagattatctgaaaatgttatgaaaatactcttatgttacaactagatatgtgtcagaccagatttctttacattcctcacccagaacttaacatggcaacagattgaatgcagtggaagatataagaatgcaagctgtcttctagtaatccagacattaaagggatttttaaaattgtcaaacaatatcactcttctcacaattttttattcttttgcaatggctatttttcattaaaatatgttatttattaacatgtaattgatttattattatttttagaatgtaacttattattttaaaatgaatcaaacacattttaaatgtttctcacttttaatatctgagataaataatcaatgataatgcacacaagagcttcctggaatccttaataatttttaagtgtaaaggtttgctaggaccaaaatgtttgagaactgccgatttagaatttatatgttaggattctctacaatttaatagaaaaaaaagatcatttctctggcaatgctatttttcattctgttgagtttgattcttatctgtatagattcaatgatcttcatgtcatttattcaacatttttcagtccttgctatacgccagatatagtggaagaaaccaggacacagtttctgttgtcagggtacttacaatttccattgttattcatattaagacatagtcatatattatattatattatattatacttgtttctcttctgtgtgtgtgtgacgtgtgtgtctgcatctgtgtgtatatgtccaactgcttcctaaatatcttcacttgaatattccacagagagctctcataggtccaaaactaaaattattcaatcgcatctgctcaattaatgaaaatgtattaccttgtactttgcttttgggtttttttccccctaatattaacactaggcataaaatgtgaatagtttgtctttttcttttgtgatgataaatcacagctgtgaagcttcattcttttctattctgttccacggtacaacctctgcttgtaaacatattctccctaagtcatgcttattgaatttcttcttgcacactggattttcacaagattattcctcttaccttgtgtttctctccttccgaatattaaataccaccctcacaataaaaagctatttagaattacgtgtacctgtattccatttatggcatctctataattcataagcaactcagatatataataaatttatatgtacaatagatatataacaaatttatatcttctgaaaattctcttttgatttggatatatttatttgccctaaagaaagctaagagaatactgcttattaaagtcacaaaggggccattataaaatattacaactagagttttaatgtgatgatttaaaacaaatgaagtacattcattttttcagctcaccagggaaaatatcaaaataaaaatttagaagattcatatgtatttaaatatcacatttcctgtgaattagacaaaaattatacaaataaaccttcaatgtatggccatggcaatggagacatttctgtgttatgccatagtactcatattactgaaattatattcataaactacatgagtcattgtatgttccctaacattacaaatctttaatagtggaagactctaaatttatgaataaccaggaaattcatccatggttatctagaatatagaaatgaaattttctgattcagatattattattgctttattgagaccaccatcataacagtaccctaaaagttaaaaatttttataattagtaacaaaaagcaaaatttaaactttttaaatttaatttttagatagtattaaaacgcattcaccagttttacacatttatgttacctgtttgactagtccctctaagaacatcaaattccctggttttgataatttgtaatcaagaccaaacaatccatttgatgatgacttactagaatataagcctagtaacacatcaagaaactacaatgactcccttttgcctacactaccaaatttaaattattctatttggttttaattaaatattaaatttaaatttttagatatttaaatatctaaaattgctcaataaagcgcgaaatgtcttgataacaatgatctttcatacaaggaatatgcaatataaattatacttcaatttttcagtttcatacttctatgtagtttataatgactgaatataaaagaaagaacacagtaaaccactgtgtagttactgtgttgttaatggtttcatgctaatatgttttgcttattatatttaaatgtatgtatcttaactcctaattgaaatatatttttttcatgtttagggcaaagcgttagtcaaatgtatcattggtgccctcccaacactatattacactattttcaacataacatatattcagtaccattaaatgtcaaatcacacttcaatttaccttggaatgcctggttacaagaggatagccgtatacatagacgttactttctcaaagacagactacttgtctgtagtttgctattactgtttcatgcttcataacttcaactacaaaaatattttgttggacaaaaaaaccacatttacatttgattttcaggcatttaaaggtatgcattcctagccacttgccctattatgctctgtggtcatgcattctgccagttttacacattcatgttacctgtttgactagtccctctaagaagatcaaattccctggtttggataaagattttataatcaagaccaaacaatccatttgatggtgacttactagaatataagcctagtaacacatcaagaaactacaatgactctcttttgcctacactatcaaatctaaattattctatttggttttaatactattcatattctgatgctaacatattaaccaaccttattctcattactaacaaaaatatatacagtattcactgtattttctttatgcttacctttctcaggatgctaataatattcttcctattttctccactttcataaatactatggatactttttctttcagttttgctttgagtaataaaaccatacaaatacaactgaagaattataaattttccttcagtccaattcttctccatcgcctccttgctttccagagataaacactacctcggtatttattattcctgtgtatatttgtattcactttgcatataagtttctatctacaaaaacatatagtatgtattaatgttcatatattttatattattttattgtgtcatattatcacactattctacaactagcttatatcactcatgttttctagatttacctatattggtacatcatacttaatagtaaaaaatgtaattatttctgtctatgataagaaaaaagacaaggatgtcttagtttgtgtttttccagtacaattcaacattgtaatggaagacctaaccagtagcataaattaggaagaagaattaaacatcaggcatattggaaaggaagtaataaaactatcttcatttgtagataatatgattaagttgaaaggcctaaggtgtctaccaaaaagcagctgaaaaaatatgagttaataaagattgctggacacaaagtgaacatacaaaaataagtttttccattaccaaactagaaatggttattttttaaataattgcactcacaagaccatcaaaaatatgaaataaagagaaatttaacaaaatatatggaatacctacatgctgcaaatttaaaacattgtggagataaattttaaaacatctaaatagtggaaagataatgttcatagatgggaagactgaaccgtaagatgtcaattctctccaaatctatagattcaatgcaataccaactaaaatcagagcaggtcgggtttttttttttttttttttttgtaaaaattgacaaacggattataaaattcatacatagatgcaaaaggcatagaataccaaagtaatttttaaaaagaaaaacaaagagaatttacactatttgatttcaattcctaatataaaactataataatctagtcagtggggtattagaatatgcatacacatatagacctttagaacaagacagcaaatccaaacatagacttacacatatgtattcaactgatttacaacaaaagtataaatataatacaatgggagacagtcttttcaaatactggtagtagaacaattaatattgatatttttaagataaacctcaagcttcacctcttatcatattttaaaattacccttcactggctaggtaccacagtacctcacacctgtaatcccagtactttgggaggccaaggcgggtggatcacttgaggtcaggagttcgagaccagcctggccaacatgatgaaacctcgtctctaaccaaaaaatgtttaaaaattagccagacatcctggtgcctgcctgtaatcccagctactccagaggctgaggcaggagaatcgcttgaaccgggagggagaggttgcagtgggccaagatcatgccactgcactccagcctaggtgacagagtgagactccatctcaaaaaaataaaaataatgaaataaaatcacctttctaaggatcacagacttaaatataagagctaaaactataaaacttcgagaagaaacaatgaaaaaaaaattcataagcttgagttaggcacaaatttcttagctatgaaagacaagtaagattcatttttagaaagttgacaaattagccttcatcagaattgaaaatgtttctcaaaagataccattatgaaagtgaaaagaaaaatatttgttaaatatataaacaaatattacatatttttatataaaatatatataatcatatatttaattaataaaggtctgattttcagaatgaatgaagatttttacagttcaaggggaagctgtaaataattcagtttttaaaaatagacaaaagatttgaagatacttgatcagagaagatataggaatggctaataagcttatagaaagatacacaagataactagtgaccagagaaaggcaaattagagccacagtgagtaatgactatacactcacgaaaatagctaaaattaaaatgactgacaatatgacaatatcaagtgttggagaggagtacagcaactgaaactgtcatatattgctgttagtgatgcaaaatggtatggtcactttagaaaacagtttgtcagtctctcgtacagttaaatgtcttcttaccatagaatcttgaacttctattcccaagtatttagccaagagaaacaaaagcatatatcctcacaaagagctgtacttgaactttcataaaagctttattcttcacggggaaaactggaaacaatccaaatgtccatcaactaatgaatgaatacacaaattgtgatatgcaaaaagggaggtgggcaatgaatgaactaccaatagacacaacacaggtaaattttaaaaacttcgtgctaagtgggagaaagaacacaaaatctgcaaaagatataactccattcatattaccttttttaaattaaaaaaatctactgatagaaagcaaatcagtgatttctaagaaatgggattcaggacatgacactgcagagagacaggagagaacacttgaggtaataaacatgttctaaatcataactgcagtggtggttacaccactgcatatatttgttaaaaaaatgaaacctcaaattgtacacttgaaattgatgggttttaccgtgtctatattttacctcaattaagccgacgaagaaaaaaataatgggctggaaagaaccttaatgtccactcctcagcctcaaaaaagtcatgaatgttaatatccaagcctcaaatatgactgtaataaactttcaaaagatttaccttgacttcatatttgttttagccactgtcttccaattctttaaaacgactctttttttggcttttgctcctcagttcctgttttcacttttcttcacataatctcacacttagagagaactagtctgactctattagtcccagtgttctgtctaaattataaaggttctttgctttctcttttagacacatatttttttcactaataagttttcccctgcttctacaaaagcagttatcattagaggtggtataccttaattaccatagtaattaccttaatcaccctgtaattaggactacaactaagggtgaagtgattcttcaaagtcacaaatcctggcttcaccacttaacttgtatgggtactagatgtatgcttcagtttcctcatctgcagaaataaggataaaaattatccctactttatattattttgaggattaaataatatagaaataatgcctagaaatctacctgacacatcataaggactcaataaatgttagcacttgtatcagtctcacattttccattggaaattccagaaagaatgaaagaaaaccaatgtgactaaataaggccacaaaatgagattttaaatctaggaattttacttaacatcaatagtcaacagaagagtcattttctgtgcctcttttttgtatggcttcttttttgaaaaaaaagaaaatattgttgcattcttaagtttctgctctgtattacaatggagagaacaatttaaacattatttctcagaaggatatttcttatacctattactaccttttctattgtgtgtgtgtttgccttgtgcatgttatgtatgtacatgtagttaaatttaccttgtcttaaagttaatttggggctcttcagaggacttgcattaattggagctgtgtaagcaacttgcattatttagacagaaaaactaggaatacccaagtccttccttggcttagccaatcctcctcctgtggaggtctccaaggaaacatacacacaaaagaggcaaaggaaggcaccattgcactttattactagctatgactttggcctgaaactccatagtgaaaattcataaactagaacagacaatagggagggctccttgcccctatttcagttagaaaagtgactcagttatataagcagggcctaattttgagttgaactggaccaatctgccccaggccttctcaggccagaagagtgatctttggtcagccactgtatgtgagaaagcacatccttagaagaaaagctaggaggcctgaactgcttagagagagcatctcactacctcattatcactggtcctttagggaatcctccaacaagagccttgctcacttgtttttagccaggtgatgactccacccagcagcaaagagttaaacctcaaatctaacccatccaattcaacctcttcctccttgcatggagtgggaggaattcaatgatgagatcaagtggagagcatttactttccattaaaagcttacagcagtcattaaaatggctatattggtggtcacagtggcatgtgcctgtattctcagttactcagaaggctgaggcagaagaatcacatgaagtcttgagttcaaggcagtagtgcactatagtatgcctgtgaaaagccaccacactccagtctggtcaacaaagcaagaccaagtctctaaaaaaaaatgactatgaaaattaattaacatttgactagttgttatccgatgtagtttgctatgctatactttccagaagcttcaattaaaatctaggaggtatttgcaagacaaaatattttcagtgttcagtagtgtcatgttcacagtgtgaacttcaaggaaacactttaaaaatcagtacttcctaactacagtagggtatagtacagactcatgtagaagacatgcctggaccctaaacactgtgagaatagccataaggatttccatgggtttctacaaagtgtttactagatgatgtgtcattttaactctaaagagcaaatcatactttgagaacttcaggaaataatatactttttagcacaaagggctctgactcccatgacagaagagaatttactatgatggttacacaaatctcttttctgtctaaaagtttttgtaccagcttttcctaggctcttatccttctcacaaatcaggactcagttcaaatatctctatcttggtgacactttccttgacttccctacctaattagtcccactctcctcctctgacaatatcctgtttctgcatggaaatactttacattttgtagttgcttgttaagtatatgtgttactaaactgcatcctcctgaggacagggattgtggtttgctcattcagctcctaacaatgcctagtatacagtaagcactgattaataatctgttcaatgactagcttgaggaatggatgcagatttagcaattttaattggctatcgtcagagcaatgtcctcttttagctcctttgatacttggagcattgaacatagaattgaaaattttggatctagtcccaattccttgactatctgtgagtcttaaatatagtgaagcatatatctagttcacctacctagttaagtggtagagccaggatttgagaccttgaagaattacttagtctatatttaaattttatatatatatgtctgttgtcaaatggcataataacactcttagttgctctactacacaggacaattagggctaatgacagaatatacgcacgcacacacaggcatatatatatatagatagatagacacacgtatatacgtatatatacacacacatatatacacacatatatgtacacacaaatgtatatacacacatacacacacatattaaaactaaaagcattaagatttctgaaatttttattgtaatttgaaaaaattcaagatgattaacagttaaaatgatttaatatggttaaattttaaatttatcatcaaagaaattttccactgagtattgaaataagaaaacctgaggtacttattaggagcttatcatctttatatatatacatacattagtttgaatataaatcccaaatgatgagattattttccacctcaaatactgaaagaatgtttattattcaaacatgggatagggaaaaaatacaaaataggcaggcagtttaaagcaatttattatttttctaagtgccatatagtgtattttattctacccctccgaatctacattttaagtgatctgaatccacactggaatgcatcaatctttatgtatttgtgatatcattgcctttgccaggaaactatgcaaagacttttcaatcacggtgattaagtattcatattcccttgtctacaaagagaaatacttaaaatcttagggaaccaccgccggataatgatatggcatttaacagttttttttcctaattcaaaccaaacattagaaatggataggctaatcaggtattattatttcaaggaacgcttgaaatgcacagggttaattttttatgttagattgaatctgttggcatagtcccttgtgttatcaaatagaatacctaaacttgtatatgtcaattaaacacctttcccatggggccattcagaatgcagtatttaaaaacctgcaataaatcgctaaagttttaaaatagctcattacattaatctgcaacagtatcatgcctaaattatgatgctcttaaaatgtagtaaagtagatagatgttgtccacagtactctgagcatatttgattcttgttcaattcttaagattaaaaacaataataacaatataggtagtgaactggctctggaaacattttcggtaaatgccagccaaaagctaacacaagctcaaatgtcatttggtttatcccagtcactgttcaaagatatgaagcaattcaaaatctacttttactcaatatctctatgaagttagaaaaatttatcttgacattggcaagaaaacatatcctttctttacatatatcattttattctttttatttatttcttctatttctatataaagagaggtagctgtgtgtttatgtgcacacactccattgtaaacttaaaagctgttgttattataaattcactttctagttagacctgtggtaggacttaaagctattcagctgaaaccattctggagtttgcaaaatatgctattttattttcataaacattttgtgtctggaggctgctagaaaatttatggactggttattttctgcttcagtaccagtaaagcacattgctatcatgctcaaaagccaaaagatggtttcaataatgctaaaaagaaaaaaaaaatccaacacaaaatggtgtttgtttattcatatattagcatatcattgtccaaagtagtatcatttaaactttgtagctcatttgaaaggttcacatagtgcaaaactgatgaagcacataacccgtaaaggtataaaaagaaagtattatgcatacattgcaataaaaatctcatttttttaaacaatatctgatagtttgtgcctatgcacatagactgtttaagatgaaaagaaaaactttctcatttaaatctactagttaattgcagtctttaacagtgaaaatgcctttcctctccctcaccccaagatagtttctgtgtataagaagtgtcaattctctttatggttttggctgaagtttatctagaaggatcagagagatatacccaagtaattcttatttaaatactacctggaaaaaatgtctgaaatgtcagtcaaaagcttttttttgcagacggctgatgtcatttcagaataaatacggggacagaaaaatcagaaagcacttatttttagaaaaaggagcaatgtacaatcaagaacactgcagttttctcaaatgtctctttagcactctagaatttattgactctagtatgtgtgacaactctgacagctgtcgttaacaactaagtgaagaaaagcaaatgtgttttcctccctggtaaaatgaaacaattacatgctaagagaaagaaaaagttggtaaccttatactgatgtttttagtactttggaactaccctagagaattagctgggagagtatgattttcttctttctcctcagtgcctaggacagagactgacgggattagattattttctgatggtgtcaattgaaactgaaacagatgtaagaatgctgtttcctagaagatgaaatatttcaggaattacatttaatattcatatggattaatcaggtgctcaacagccagccaataaatcctatgcagtaatattttccatgggtaattcttcaattcaaccttattagtttttatttatttcatcatttagacaatatttatgttccttcagtcccaacaatcacaaaaataacaacaacaatgatacatacacacacaattctgactacaaagaacacttgacttcacttttcatgacatttgaacaattgagtatgggcaaaagtttcatcctcaaatctctaagtgaaaaaaaaggatgggttcaacaaatagtgctggaacaactggacaaccccatgcaaaaaaaatataaataaatctaggcacagaccttattctctttaaacaaacaaactcaaaatgaatcatatagacctaaatgtaaaagggaaaactattaaaactattagacgataataacatagaagaaagtctaaatcacactgggtatggggatgctttttagctacagtaccaaaggcactatttataagagaaagaattgataagctgggcttcattaaaatgaaaaacttctgctctagaaaagatacattcaagagaaggagaagacaagccacagactgggagaaaatatttgcaaaagacacaactgataaaggacaactatatcaaaatatacaaagagcccttaaaactcaataatagtaagatgaaatgaactatcaggccataaaaagacatggaggaaacccaaacgtatatcagtaactgaaagaggcaaatctgaaaaagctatgtactgtataattccaactataagacatctggaaaaggcaaaactgtggagatagttaaaagatcaatggttcccagagatgaggtgggaagaaaatatagataggtggaggatagaggacttttaggtcagagaatgaacctcaacatagaactatggatactcctatacattccactcaattttgctgtgagattaaaactgctctacaaaatgaagtttattatttaaaagaatgacgataacaaaaccaagacgagaaggttcatgaaggtaatattttctttaccagtttcaaaaaaattatgggtattgtactaaaatgtaaacctttataaatttaaacctcattaatagatattaaatgttatttcataaaataatttcttcagctttaaaaattaaatattgaatgtctaacaaagtaaatttaaataattgaatctaacattaatagagacagataatggtagaaatatattttatctttattaaaaattgctgtgaaatgaagccggacatttaaaagtacagattatacaattttatttatataaagtttaaaagcaagaacccctagtctgtgctatcaaaagttaggagagcgacttcttggcgagggtgtaatgaggaatagagaacccaggaggattttgaggtgccagctgaggatttgggggtttgttttggtgttctggattctgtgtggggtgctttcaatttatgaaaattcactaagctatagatttactgcactcttctgtatgtattttatactttctctaaagttaacaacaacgaaaagccgaacaagacctggggaaaattagagctttcttaagcaggattgagtataaattgtacttgccaaaatgttcatttctatttgaattacttttttaaataaatagggcatatgacttttaagtagttctgtcatgcagaatccacttatctctgttctgtgagcatggacaactgagtcagctgggcagtgctacaaggacttttctctgattgagttgcgtgtgatcaaagggcaacagtttaactctgcaaaggaaagagggtctctttcccaggcaacgactaagtttctgaagagactcttaagctaggaggtgtattatattctagtacacattccctgaacaccttttcaaccaacaacctccaccttcttatctatcctatccttttacttgaggccagatatattcatataggttttaggtcattttactcccatatcttaccctaaggttctaataagaaatcaagggttcaggaggtgactgcaagagaaaaaagaaagggcaaactaaaaagtctaaaccttttgggaatagatgaataacaccttgaagaaataagaaattaaattcagatagcacaatattactgattacaggagatttatcagatgctttgaaatctaaggcatgtaaaggaatttgtgtggatgggcatgtatttggtgagtttttatgtgtgtatgcttgaaattcagtaaatatatactgagggtttattgtcaggagcagaaaaaaataatagttaccatttattgcatatttacactgtgccaggcatcgtgttaagttcttaagcacgaattatctcattaaatgctcacaataaagctatgagctaggtattattattttttccatccaaagatgaggccataaaggcttataaaatataaataacttatccaagatcttacaacattagtagaagagctaggatatgagctcatgtctgtctctgaaaagttcacgatcctagcctcttactactctctcggttactgagtgatcacaagggcaaacagagaaatactggggagaaagaggacaagaggagagaaaaagaattttaagatataaaggaagatgaagtaaaagaagtgagagaacagagaaaaaatacaaatggcacagtttgggcacacaatagacatttaatgaatgttaaatgaatgtttttgacatatgcacattaaataccataaatacatacttacagattttttaaattaaaattgagtaattgttcacttagcttagctagagacaaggtgtttatatgagtcaaaagttattttataatcattttaaacacatccaaaagactgggaaaatcaaaatcccttaagcatagtaattaggcacaataatttaaaggaattttttcattaatgtccctcactttttctttcttttccttttttctttttctttttgagacagagtctccctctgtcacccaggctgaagtgcagtggcgggatcctggctcactgcaacctccacctcctgggttcaagagattctcctgcctcagcctccctagcagctgggattacaggtgcgcatcaccacgccgggctaatttttgtatttttagtagagatggggtttcaccatgttggccaggctggtctcaaactcctgacttcaagtgatccacccacctcggcctcccaaattctgggattacaagcataagccacagcgcccagcccctgtccctcactttcaaactaattttgtgtttaaaccttaatgtaattataaaagttaacagatttaaagagaaaaaataatcaagtctccattataatttttgagtagattctttctgaagcaaaatactgctactgctaagaaaataattatccctaataacatgggcgcaattccattaaatacgttccatcaataaaaaaagtaatatataattttgaagaaacaagaagaaataatgaaagaatgaaccccacctggtccattctagattcattagatgcccatctcagcagtaaagtactttcctatttaccttaagaatgtcataaaaacattcacatttctgttcctatatccaaggacctggcactgctgaaaataccctgttggttggtgctgtggcagaagcatcctttccaactcctgccttgttttcacctcccaaactaatccttatatgtagtactttctaagtctgcatctttctaaagattctcaagttctcagtcccaacccactcatctcatcatttttgtaagatgacccaagcagtctaaatattctccatatattgtacagtttatatatttttaagtattgtctatgtatcatcaccttacatttaaacttcataggaaaccaaaatagattagtatatatatccttatcagctttttttataaatgaggaaacaaaaatgtatagaggttttgttgcttggccactattacaaggtgttgaatgttgtaaagctagattcaaactgagtataaaatttgtgtttctgatcgctagaaaaaatacaaactattagacataaactccttcagaaatttttcccaccacctcaaatcttctctgttcctacatctgtttcctcatttttcattcaaggctcattactgcatcccagtttagacccaaggtcagccctcaattattaagcccatggtactccacctctctccaggatttatcattcatcctgctttttttcaaatgtgatgaagaagaccaggaattacaaaaataaagaatgagtaaaagaagcccaacacaatggatgaagttgagtaggactctaggaagagctagagtaaaaactgatttgcttcaagcttttcttcaatgctggctcagtcttggcccacatgtaagtccttatattttaaaggagaaataagagattgataaaccttgtccttcaaaactataaaagaaatcagactttgaaaaccccacagtttaacacctcactcggttagaaaacagaggcaggtagaattacagtgctaaatttcatggtgatttaatgggtaagattaatactttacagctagcttgatgtttccttcatcagaaacaaaaaaattacttgtgaattgacctattcatttctaaaaatatttataaatttttaaaaagtgaatgtatatacagtaatattgattatatagcaataagcagagacttcaagaattacatatttccaaattattaatttcctcaattgtatttctaatgagacaattattaaaggatattatttttagatcaacagataatcaatcatatttgactttatttcatttactagacaagtaaatttaatcataaggaaattatgcaccataacttcaagagatgatgttttatgtcaatttttccatataatgaatttctgtctcattttctacttataaaagtagatgagggcgggctcgatgattcacgcctgcaatcctagcactttggtaggccaaggtgggcagattgcctgagctcaggagtttgagaccagcctaggcaacgtggtgaaaccccgtctctactaaaatacaaaaaaaattagccggcttggcggcatgcacctgtagtcccagccactggggacgctgaggaaagagaattgcttgaactcaggaggcggaggttgcagtgagcggagatcgcaccactgcactccagcctgggtgacaaagcgagactctatctcttaaaaaattaaaaaaaaaaaaagtagatgaaatagaaagtagtgtcaagttgatatatcaatagtatatatactaaaatactgaattatctccagtaatgaggttgtcacaaacagttataaagagagatcattggggaagttaagatacttctttggtttctagtcaaagcacagtacctagaacagagtcatcattcaaataattctgtatttccttcctctatctttgacttctttccatttcacatgtacctttactttcctattttagatactattttctcattgtgactactggaactatctcttaaacataccatcgctgcctttaatctcagttgcttcagttttcaaattgctgccatagtttcttttctaaaacacttaccctagcacttcactgtcctgctcaaaaagctccattcctttttccctgctgtgtcaaattcaaagccaaactcggcacaggtttctaaccaggaccaagctcatcttactgtctcatcacctgactgcccccacaaccactgtgttacattcttccacagtggatgctcaactttcttagaatgtgaatgctcttccctgtcttcaagctattattaaactgccttctctgtcatgaataccttttccacatctcgaccaccagaagaaatgtcactttctatttgtaacttaaattagatgtcacttgctctctgtgttgtaatctttaagcttcccttatgtagtttcttaatctcaaccttatactgtgtttgtaaatgctcatgcctctatcatatcacttatcaaattgaattattgttagtaacaggtttctgtacctccactgttaagctatgaaatttgacaactcacagaaccacattgtcttaatctgtgtattctcaattttaaaagacacagcactcttgtaaaaattaggtaccttagaagagaatcaataaaatatatgtaaaataaataaatgatttatgaaagataaacatgaacataaactaaagaaagacaataagaacactgataggcatctattttttttttcttgtaaagaacgcctttgactttaaaagattatgtagagaattcagacctggaagagaactcaaatattagatcattttagtataatctttccatttaaaagatgaagttgagaggcttggatgggctcgcaacacagaaaaatggcagaactaggggaaaaaaacctaggatcccaaatacacagtcaacaccattatatagtgttatgccaactttactgagagtcatacagcatatttgaaaaaacaaagacatttcttgtttatggacagaagagctaagtatgggaaaaacgttaattctttctgaataaatctgtattcaggcatgttataatcccagtagaaataactaggcagtattttctggaattttaatagtattttaaattttaattatgagagtaaatgagcaaaaataactagagtgattttatactatacaatatattgttggtgggttttagttaaaaacaaagtgaaattgtgatttgtttttttcaatgaattactgtaaatataattactgttaataattttcttagaatacctttctagaaataagaaaataagaatttgatatgtaccaagcaaatgatctccaaaaaaacaatgctgatcaatataatacattttagtaactataaatgtttaagtcttcataaatttgataaggggaaaacagtctctcattgatgaattggactttctttgattataagtgagacttaacatttttttcaaatgtttattaacatttacaagttttgtcaattgacctcttagagattgcatagtttatatcaattcatgtggctcttttaatgtttaggatattcatgttttgacacaacacccccccaatgaatccttataatttccgtttttgaattatgttcatgataatttgtaatatccaagtgttacatttttaaagaatcaaacatggcattttttaaaataatttcttttactgattttaaactttcccattcaaatcaaataaaccttcgcctacattttcttttattcttttgcttctttttcacataattctaaaataaatttcaaatggataatactttcttatgtggaaaaatcatctcagttgaatctactgtaaactcttaatcaataaaatgttatttcccagtgagttctaaaagccaccattatcatatgataaattcatatatatatatatatatatatatatatatacacacacacacacacacacacacaattgtagaattatttacttatttatcatcattctatgtttctgactatttctatttggtttcatttatcacatgtctattttggtactagtttcatactggattgattattgtagtttatcacatgtctattctggtattagtttcatactggattgattattgtagtttaacattatgcttaagtgttaaatgtttggtaggaatatttttccttaaaatcactctagttatttttgctcatttactctcataattaaaatttaaaatactattaaaattccagaaaatactccctagttattctactggaattataacatgcctgaatacagatttattcagaaagaattaatgtttttcccatacttagctcttctgtccataaacaagaaatgtctctccgttttttcaaatatgttgtatgtctctcagtaaagttgtcttcaaacaggttcaatttattccaaaatattttaaataatttttgccaaagaaaaaaagcgttccagttcccatgtattaacaatgacttcttaatactatgtagaaaagtcttaatgttctaatattaatgttacattttatctttctaatataattattgtcgagatcaaataatttgaaaatcatcatgaagtaatttttcccttatagtaataatctttgtcatttttgtttcatgtttatcacactggttaaaactgatagaatattaataatagtggcaataggtttgatccatctcttgataagagtaactataaatataaaatgttatagactgagaaagatgtgctttatcatgttaaatatttgttcgatttctagtttttttgttttgtatttgtaacataaattaggctaatatttttatcatatgactttacacaatcttatgaaatgtttattattgtcttatttgacctattagcatgattgtagtatattttctaatgttaaactataattattcctttcagatagcttaaaggtattttatgctaacaaatttccttcaaaatcagactatagtgttcagagactctcaaattgtatatttggaaattttgcattaactctttgaaatcaataaggtttctaaaggaaagaagatgctgataacttctatctatgtactggtctctacaatctaacaaacgtttccatattattcttggaatattgagcactgaaatatttagatcacaactcactgctgagtttagggaagctgctttcttcctcttggtgtcagataattcaaccccaatacaagggtttgcattacaaaattctgaagttgactcttctctccaattatcacagatccttcctgattcctgtctccctcaggctaacacaaactcatccacctaaagaagcaatgagattcagatacctagacatcacccctctctcaggtttccaactccctgcttaagctttccccataaggcacttacagaaactttctaaatgtcacctttttctatagggagtggtctgtgacaaccaagtttgtactacttcctcctgtacactgataatctggaacagatctgacatacaacctaagtttggctaatgagattcaagcttccaagaagctgacattgagacttaaaaaaaaaagttagttttaacaagtgtcttaaagaatagctaaaccctggaaatggagatcctctgctatcctgtgaacctagaagaagagaaaaccaatataaagagaaacagataaagcagacagacagaaagacagagatgctttttttttcttataggtttttatttcttaggaccagttctttctttagactcgtttctattcccgctatgcggtttcctgatgcacattcacaaattcttaatttcagcttaattaagcaagttttagttggtttctcaagttggttggttacatacaatcaaacaattcagattaatatgccactgtgcttgacctgccctgatatgagctcagctatagggcaagggagtagggaggtagctctgaaattctatccaacactttctttatgataaataaggttctcatagcaacagaaaaatctttgattctatacaagatgtacagaattaatattttattgcctatagatcagtctggagtaaggaattgacaagttcctaaaatatctaacctccttttctctatatttgttgataaatcttagggtttaaaaattatagaaataacattttgttcagatagcagcaataaaagtaaccctaaaaggaaagtctttgtttccttctggcttcccaagtagacagaagatgttaagaaaacttgtaaggaaaacatgagtaattctggatacactgtgattcagaatgtgcttaaaatacagatgcagaagatggttcaggtacctttttttcagtgattttaaaaaatcagtttcagtgattacattcaattaaaccaccattgtagcttatgtctttgatgccaattagtactctacagttcagcagtttgactgaatattccagctttagttagttattttttaatgaaataattctggcctgaaatactagtcatttatcactctaaattctaacatattctttgctttgtcaattaaatgatacactggaagaagcacaatcttttacatatctttaaaccattgcttaagtaagcataccacatacctggttacaatgtgagaaagattaaattttaagaaacaaacagttctctttatttttgtaccaactgtctgatgagcttccagtgctctggctacttcaccttctgctcctataaactggaagcagaatcttcctccacaccgataacgtggttttactatcccaaactaaaaaggagcatacaaagaaatgtatcctgatatctaattatgtcaaaaagaactaatttaacaacaattttatctatacaaaaattaaacattgggatagccactattcaattttaaatgggcattactaagtaattccatctaatgggtcaatttttttaattccttgagagtaccttttgtagctcactgatcctggcagacaatctagaaggccacactgtacaaacttggcagttgccttataaagctcattctttgacaactggcaatagctaggctaaaaaccttctaatatataatgttttttgttgtcgtgtatagtaagcagctctggttctagtcaagcacatctgggttcttcagaaaattaaaaattggtcctgagcaaaccttgttttggccaatggcctccttgcacttttggtgttagggaggtgggtcagctgtcccaccaggtgagaacactggctatcaccaacataatcaactcaactggtttccaattaacaacataacatagctgttttctaggttcctaacagctaacacaagctccaaaagtctacttccagctgctattaaatccctgcgaagagcaatgatatgtgtgtaagtctgcagattgtatgtgtgcttcatagagccactgggactcttcaaggtacttccgagaccagtaagcaggactaaggaagtggaccagccagggctatgccaatcccttaacagttcttgttttttaacagattgaaatgttagatttctgagtaggatatttttgaagatagagtcttaaaactagagtataagggagatgttcttcatttattcttcagagtatggtacatccccgtatcatcagggctcaaaagagttatacatctaaatcaaggatgattatcttcctcctccttggaaacatctttaatgaaatatactatactttcagtgttataagagttacatcatttcttaactttgattgtgggtacaaatgcaaaacagccagagaagacttctgcttttgctgtaaaattttgtaaaataacattgctcatttggctgtcaaagtcgcatatgacacctttcttttggaaataatttccaagaaaatgtgttctctcttgaaaaataggtaagcttgcttctatcatataatgaaaattataaatcacattgtcggtccctttatgctttgactgcttaagaagctcaaaagttaatgatttcatcctttattctgcttaccatatttgtttcttcctcctttagtagttttgatggtgtacttttatttgaacagctttgtgtgtcatttttatcataaacagaatgaacatgaatacataagtcaataataaaattaaaatgtgatgaatatcctggaaatcactgaaaatcaacagaattatgtattctatgatcatttgcttatcttcaggtctcttatcctgtattatcagctactggaacacaaccaagactcaagcccagcaaaatcaatctccaaagagctcaaagagattgtcttttaagttcatatactaagatttatttattttccataaccctcatctgagctatatgttgccttatatcagacacagcacagttctattatgctccaataggttcttgttgctttcgagatgaagaacaaaccttaataatggcctataagacctcacatggtattcatggcctggcctattgccctacccttatctcagacacctactcccttcagatttcatctgttcctaaatccctatattagggaaatgtccactattataaactctaaatccagaatatctcccttttcagcactcattgcagattacataattatatttttgtgtgcttatttgattaatacctaagttctccaggaaactcgaagtgccatgaatgttttgtctatgttccccagtaaagtatcgtcagcacctgtcctaaaaacaagcacagcaacagcagcagcaacactttgataatgtaaaaaaaaaaaaaaaaaaaaaaaagtggacagaactcaaagattattggagtctagaggcaaatccttttaatagccattacattaagatattctttaacagtctttaatagtatcattatattacaggatggtataataattataataattgaagtcatcaaggaagggttaggttttgatcatggttaagatgaaagacaaattagtaatttgcctttaaaatgctttctttagtgcttctttaaaagacttccctgtcttctggaggtgagcttcagttctatggaaacttcactcatctgcattattcttcccacttcttaactagcaatattagataaaggaagtgttccccaacctcaggttatggtaaacaaccttgtattgcaacattcctcttttgatcaatttcataattgcataaaaattattttcaaactcctgttagtgttcatattcccaacaaaaagattaatgttatgtaatgtttcacaaatattctgccacagacgatgtgtgttgaatttaaaccaaattctgtcttaggttgcctttaaaggaaaaatgcaaaaaaaaaaaaaataaagaagaagtttccacttgaattctaaattgaagatgacctcgtgcttttctgagaaacgctggcaactgaggtcactggagtgtgttatgatagacggtgcagtgctgtgcgtgtctcaaggcatgtccattgtatggattaaagccaaaccaaaagtattagacagctcagagcattctatcatttcatttgaaaataatgatcaaagtcatgggcaacaaccattgcaactctcatgaaagaacagcagcattcaataattccatcacttcagacaggcagttgggctattttcaatcaaatactgtgaatccagtatattctgtatcagtttctcgtggcagtcacagaaacaacatttctgcttttacagtataaaaatcctgcctacattgtgtgcatccctttgcttccgaaggactgagtcattgagaaaaatataaggaaacagaaaacacagaaacttaacactcgttgagtataaatatacagcaactccaagtcatccattttcttcaagtcaacctactgtttcaaaagcttaaaatcagtttcaaaacaaaatgtctacaatctcttctctaataatgacatgaacaaaacattttcaaagaaatctaatgtcaatggtttcaaataagccttctaagtgatctcttcaatagtgatatttaagtaaaacattttgattgacagaggcttattttaaacttttgcctccttcacgcatagattaatggtagcataaaaaatatgtttgagattcaaaagcaggtggaaaaactcacacttctaatcaaagaagagaactgcttctaatcctgtgttttccactctgcctgggtatcttctatatataggaggaaaaacacaccctgtcgcttttaatgtatttagacacacacacgttgtaacttaccattaaaatttacagcccgaatataaccaagtagctctttcccatcaatggtactcattcgtggacaaaggccaatgtatccagggcagagatctttgtgcatattgtgcagggcgtaagccatggaatatacagcatcaattacaaattggacctttccttcctgttcataagatgaatcccgagcaattcgctccagccctgcaaaataaaaaagtaaaaaccatcagttgatgttagattccaataaaagacagcattagagctaagatttccatcatttgaggaacacttaatgagacacgactatttgatttcacttctgattaattctatacttactgagtcaggtttttaaactggatattaagtttatttggaaagagtaaaactatttcattagcaacaaaaagatataaagtaaataaaagatgtatagtttcattatcttttttccaccttattgagtcctattatattgtgcattctagtaattacataacattttggtagtggcttgatcttttaagtaaaatgtgcagtgtgtgattcttgccatctgtctcagctccaggagtgtcatttattagtggcccaaagtaaggtctttcaccacctaccaaatcagttctaattttgaatgtgctccatttgggagcctttttgtaacttttatatgacaatactcccttaagtgaccctggttatctttataataatcattcaatttgttttctttttgaactcaattttctatttagaatttctgttaaaaagatgtagatacctcaaaatgaatgtcattcagaataaatgtacctgtgtttgggcatatttagggctgctcattggcactggagattacttttaggttggtgtttataatttaatatggaaaagaaatatattttaaatgaaatataaatgagagatcaactatgatccaacattatcattttgaaagcgaggaaactaagactcatggagattataattacatggggtacatggggtacatagggcaggtgtgggaagcattcgtaggtctcagactgcaagcccaatattctctcaatccccagaaaaatttggtagatggcaagaatgttgggcatacaagaaaaaattatgaaagggacatcaagagtttattaagggaacaaaaaatgatctcctgtcacttctacatccctcaccaacccttacacaactggtaacacttagacaaaagcaagtattttaaactttccatggatgttactaaccttgaataaattgtatttaaattcaacaaatatttgttttctgaacatcaatgcatataacctacatatttagagagtcgaattaacgtggtttatatttgtatatttacactctgaaaaactagtttttttctaaacaaaaatagtggtcagtttatttatttttattcatcgaattattgtttttgttcttcctctggtcttaatcacttgtgacactctgtgcttttagatgctcttggttggtattctggtctctgtggtctgtcatgatgctgaattctgctcctccctgtttggcataggttttccgattttctcatgtctcaacttttcattctccaaggctgagtttcttcatccccaacctcagaatctgctaattgtcaattttgtcaactactaaaatttctacagtctagaaatataaatcggactataaaatgttgactacagaatccagaacattagatcaatttataataatcagtttacttcattttggaagttagctttttggaaaattagttttctaaacctttcttgccatctaactgctatcgtcccatatttccaatggcctaccatatctctacgtagtctgctgcttccatatcaaacaatatatgtaaaacaaggctatctctgcaggggattccctaaaatatcctactgaaagttttgcaagtttgcgagcacaaagagacagggaagattacttctcaaaagttatattgtctccttcaacctaccccttagctgcatgatctaagctaagatccacaagacatggggactatgttctctccctatccctaggttatacttttgtctcctgagtcttagaacaacactgcttgttcccagaatcattcatcaagtttcctgtgaaaacaaccctttccacttctgcctaaaatttctctcccatggctttaaccacaaagtagatcattcataagtaaatactgaaggatggttacagcaaccaaatagacgctgttatttccgtatagattctagtctggtaactatcccctcttgtttagtccaggactgaagggcttctcaggacctaggaccaaaacctgaagagcccccggaaaaccaggatggttgcttatgaacaaagaggcaagtgacgaggaaatttcagagagaagactgaataacaactttgaggatcagtccctaggtctggatggatatccctgtgtttcatttattttgcatcgctgaacttgataacggaaaataaagacagtgaggttcagggcagttgtttccacacttgggtctctccttaagtacagatttctcagcaccaccccagacttgctgggtcagaatctccctacttgggacatgaaggatctgtcatttcaacaactcgccaagagattctggtgcaaccagctgagtctgtgggccagctttaggaaatttctgctcttccatacagcaatcctcaaaaataccactatagatctattgtttagagaattttatggtattgaagtatgaaaataaaaataattctttcatgatatgcacaccccgaagaaaatctaatcaaattcttccccttttctcactagatgaagagtcaaagaacacaattcccaatatttacgcatttcaaagcttccaccatgtccttagacacacagggaggcctggagctgatgacaagggtagaagccagaaagacacgaaagatctgcaaataagaaagaatttcccatttctcaggatagagttcagttttctaagttaaaatgtcagagggctaatttaattgtcctgaaattaggcatataaaacttctaacatcaatgcaatgatggcccaataagcaggaattgaatgtgttcctcctgagagggtggaaacagaaaatagaaagcagtaggaagaaaaagatacagagaggagggaaaggaggatgcagcaacacagagaaaggcttgagcccaaggtacaataatggcagagggaaatctaacgttccaggttgtttgtattgctgctctctaaacaactctgctgcagacacatacaaacacacacacacacccctcacatacctcttctgtaaatattatttgtttttaatctaattattttttattttgtgggctttaaagaaaagggaggacttccatgtttccattactgcagggtggtgaagggtggagagtggacacagaactggcagaaaatgcctaagccaaatggcttcaaatgaagcaatgaccacaagagcattaaggaatttggaaattttttacaacccatggaattcatgtaacagctagacatgtgtgaatgttttatagtttcaaacttactctatcctaaaatgttcttgatttaatatattatcattttagtgccagtgcaacctcaatttaatatattatcattttattttatatattatcattgtattttaatgccagtgcaaactccctgtcaatttataaagatactcctcagcattcaataatttcctgataaattataatcgacatgctccaatttaatacatatactcttcctcagcatttcttaaaaaataaacagcctggtgtggtggctcacagctgtaatcccaacatttcgaaaggctgaggtgggaggattgcttgatgtcaggagttcaagaccagcctgggcagcagagtgagaccctgtccctaccaaaaaataaaactaaaaattcaactttatatccaataggtctaaatgaacaatcaaatacacataatcttattaaagaaacatatttaaaattgtactattcaaattattcattttcttttctagttataaactccaattattttgactgttgattaaacatattcaactttgtacatttttgttcttttaaagagttcagaagtctgcctagtaactggtgccacatgtgaatcaatgaacactgtaagaatctccccataaatcaacataagcatatggtgacaaactgaaagactgaatactattaccatttctaaacttaaaagtggatcatttgatttcttttcaggctgtttagacaatgtatttttctgttccttaacacttcaacctcatgatgacacttaagattttacagcagctagaatttgctcctcacttcctatatttgattctctcattcatctaaaagaggagtttaggaagctgacagtgactcatcaacctaattggctgtaaaatttcattatgctatagtttctaaagttagtgttaacgtattgctataaagtgctaaatatcgtcaaaggctttatgtcagctaaccattttaaatatcaccgattgtaaagttgtgatgtgttttagtgtatagcttaaaattaacaacatatagcaaagtgttttcatggtgagagaggaagtcagcctcctaaattttatgggaagattgttttacatcttcattaatgaaatctaaatcttgtgactggatctcaagttcctggaaaataataaattcttactggtctaagaaatatcacacatactttagttaaggtctttcacactttgtggtatatattcttgggttttgttccttttcagtaaaaaaggcaaattgacttaagttggcaaaacattgtatatgttacaatgtaagttcctaaggtgagcctaagagaaatttcagactttgatgcattgtggttgcaaagcattgctttctaagaatttcccatttctcaggataaagttcagttttttaagttaaaatgtcagaggactaatttaattgtcctgaaattaggcatataaaacttctaatatcaatgcaatgatggtccaataagcagttggtcaattcaagtaaaaaacaaatggaagtcataccagttgcttaattctggggaaatcaaacatccaattggttgcctttttcttacaaccatctcagcttggagtataaataatcccacaatctaaatttgtagattaagaagtattttttaaagtttctccctgaatttttctgaattatgaagcaactattttaaataattaagtcagtttcttggagttgctctggagagaatggtagaggaagaagggaatttgtgaacctgctatgaataaatacatttatgcatctaggcccagatttagaagtcattctgaatttcacaggagcttctctgcctattgataaccaggaataagactgtcatgctttacattgtgcttttcccaatgtgacacagatatattgttactgcatagtgcagtgacttttaaatccatgagaaccatgccaagaaccacatcacacactaaagagtgagcgctatcaagctgacaaataggtttttttttttttttttttttttttttttactaaatttaaactgatttgggttccaggatacaatagggggaacataaggtagaaatacaagcatgttcaattatacaggaatatctccagagcactaggatccacacatgaaagtgtgcacctcccatactgaagacagatgaaaatatgaaccctgagatgagacagaaaggcaaactgactgatagaagcagctggctaggggagagagaggatcagtcaggtagatctggatccaggtcccagctggacagcttagaaggcgagtggccttggacaccttcctgaaccatgtcactaatcctgggccttcagctggcattgccactcttagggacctctgtaatggggttcctcatccctccagcttcatctgctgcaccacacacctctctgctccactcttaggtccttgaatattacataagatctccaaatgcaggcctttattcagctgttcactctcttcattccttgcctagatgtttccaagcctcaggggagatgtcacctcaaatttgttaatatttaatgattttcttcccaaacttcgcctagattagatcatcgagcatcttaaatactaggcttaaatactgaatattgttcacttgaaatggagaactatgatcaatatttaaaattattgctgagaataatgtgtaaaatcaattgaagcaagcataggttgaaggtagagataagttgggaggcaggttatgcagaaagtggaaacaggataacccagggaagtgaaaacaaaggaatgagagaaaatatgttttagaggccaaattgacagaatctaactatctgattaaatatggcagtaaatgtcaggaggcaatgaacaactcagggttctgatgctaggtagtagaaaattggcaccatgaacagtttgaaaaatcaggtgaagatttggttaatgatatctccccaagggcatcaagacctcaattaaaaggactgatttttaatgttctgtgctatttattatatcctctaacagagtatagactttatatagatgtttaattattaaaagaataaaaggcccaaatgtttagagtaatcacataccaataacgtggttgatcatttatttgcaacactggcataatcaaagaagctacgttggagtagagcaccttatgcaatgttgcagtaaaaccaacggcctgagaagccagacttgcattctggttctaacaccacaaccaattaactttgtggccttgggcaaaacatgatctctctggcttttggttacttctcagtaaaaattagagaactgaacaagatgctctgtcagggcccctccagctctgaaattctggattctaaggcatgttctcttatttctaactgcttcctccttatactttctaagatcccttgaagattatttaagtaatcttcaagtaagtgtgacagaacaaataccactaaacccaattctccacaacagtatgaagtatcctgtaactgggctactgctgagacctggaaattctgcactaacaaaaataccaaatgtcaacctggattaattttttcccgcattcagagttttggttcactgtgtcaccatatttccattattcttagacttagagccattgaacaaatctggttcctcaaaaaagagaagattttaggtctcttctttttctgatatgctggctaaatgaatcaattatggaaaataaggtcagagaagtgaaagggaagagggaggatacaaataattaaaatggtaagagtacttcacaaatagtatccctttaattctaaattattactactcctcttgtacaaatagaagaactgagattcaaaaagtcaaataacttacccaacattgcaaagtaatggcagtaaacggcaatttaaaatcaggtctacgtgactcaaaacctctgccattaccgctattccttctcctctgtgaaatttcctttgattcttccagttcaggtttatcttttgcttctccaaattccccttttacttacacccaccagaccaatgattagcttgtctcttaaattaactgtaaatgcaggttctctacatgtaatgtgttcatgcacttgtgttaatctttaaagacaatagtgtagtaggagtcaaaaaatattataaaatataaacttttacagaaatactgacaataagtattaacaaatactaacagaaatgccaatacttatattgaactacacttaaaaaggaaaaaagtttctataacattttaagcatttttctgaactgttaaacaaacaaaaaaaacttcttatgaatttcagccatccacttatggaaaagttgtcataaaatggctgaaattcccaagcaaaaggactggacatttgtgataaagaccaacgctaataaagcttatacatttatctttataaaaatgactaaagtattttagtcttggaaggtggtgtgtctgagtctatgcctttatatgatttttcttaaaatataacatcaaactcaaaagagaatttcacacccaaggttctgctttgtggattcttcagctggctctgtcaaggacctgtagagacagatgtattggactaatgaagtaatttgagccactaccttatctatttacaaagggcagagaaaattagaagacaagggtcctttgctgaaaatcacctgctatcttcttctgtaatttaaatgtagcagcaagaactgaaggctcttagctgcctgaggacacatgaggagacacttgtaaatcaaccactgaagagctctagatcagttcacaataacatctctcctttgtgcctggcaggaaatagaaagtgcttcaggcaggtgccaggtgtccccttcaggtattaaaaatttccatgcaatgccctagagtttcgaaaacactgaaaaacctaaggtaagtggcaaataagattaagagtgtatcttcaggcaaaacaaccagtttaaaagaaagactttcagaaaagcaaattatttcatagatatatccctaagtccctgaacaaagaaaagcctgtttgattaaattcaattatttgcatttttctacataattatcttagatcatacacatgagagacaaattttgatttaaaataatttataaaacttgatatatcatagttaatgtttctcttttttaaggcatattaaagacactcctcctcatacaattcaaatttgggcctggaaattcccacttcagcagaaaggacttctaatgctacccccacccccaatatgttacagtcatttcagaccctatgacttggctcaggatttaccttttaaaaatacagtctattttttaaattacaaaagtaatacatattaatactagaaatatggaaaataaaagtgtagaaagaagaaaataaaaaaaaatctattagcctcccagcttaatgaccatttgtatattggtgtggcgtcttacatttctttctttgcctctttatttttaaacattaaagtgatatactctttttaatatgctctattcacttcatctataatgagaattcccctatattatagaaaagcatggttttttatcttgtccttaatctttcattaagattcttatctaatatttaatcattcaacagattaatatttttgcaattaattcttttgttatattcaatgtgatatttgggttgagataaggatcataagtttttcattttccaaattgtgaaccaattctcccagtgttatttattacatgtatattcatttcccaaataatttatataacattatttttaacatatcagatttttatatattcttgaacacctctctggattttctgccctaggccatttttctcttaatatgccaatgctacatttttatgattattatgtgtttatgttataccattggttcattctgtactctatcatactcttttgaaaaatttctgattagtctaatagtctttataactaattaaaccagttcaaaaagttagaacttttattagtcatatcaatttttaaaattaattatgaaagacataacatagctacaatactaagcctccatttgctaacatagagtctgtttattcaaatcttctttaggaatccttaataaagatatgtcacttgcacatttatttttaagttaattcttcaatattttatgttttgtagctttataaaatgatttattttcattaactggtataatttataaatttctatttatttttaatactcaacgtttttctctcatttaaattctacacatcctagcaagcccagattaagtcctacctcttctacacaacacggaaaaatataaaatagcatgggttttgagaccagattaagattttaggctctgcctccaagtctctgaattcttcactcataaaataggaatttatgacctatgttgcatggctgctgtgaggattaaatgagacaatgtaaggcatctggcaccttatgtagtaaataaatgaacatcactatttgatatgtgaggctataaaatacttaaccttctataacatacaacactttttcaattatacaaatgaaagagattacaacagaaagttaaactcagtatatattcatatattcaattactaagcatgagaaaggtaatttagttctgtgattgagaccaaccaccctgcttccgatctgcctaggttcaaatctcaataccaccatttactagttatgagctttgagtaagccctttaacctcctatgcaccttatctgtaaaatggggataacaataatatctcccccatagggttgttgtcataattaaatgagttagtatatatattagacaattaaatgagttagtatatacattaggcagtcagaagagtgttgaaaagaataggcactacataagatgatattattattatctttattattatcattcactgagcttgtgtgatatactaagcagtgaggaggatacaatggtaaacaaaaactgacctactccttgctgtcacagagtgacactgggactacgatctgaaagataaatgggagtgaattaggtgggcaagggaagtagaggggagcacaggatgacagcagtggcaaaagcccattgatgggggcagcagaagagtacaaggagtgaggctcagccagtgaggcttagcaggggaagaaggagggaggcacaggtgaggcctgacgggggcagggccagattatggaacaatgcaaatgaccgggagtctatctgtcttctttctgtaaaagcagagggaagccatcaaaaggtaacataaccagatttccagttctaaaagagcactgagtcaagagaacagataggaaggaggaaagagtaaatggagtaggcagattgggaggtgattttatagttcagaaaggagcatacggtgtcatgggctaaggtggtgatgaaagtgaagaaatgtgattgcactagagacaaaacaggattaaaaacaacaggatttggatatgggcaccatagcaaagagtggtacccaagggtgacttctaggttctcggcttaagtatctggacagatgccagtgctgctcaattagatgggcaacagtgtctaggacagaaatagcatgtcctgccagccagataactgcacatttacctaatgcatggtcaacatagtgagtttgttcctgttatgacaggtcaggggaatcccactagcctgcacctcctaaaaattgtatactcacttgccactctgagaatgtaacctgccttatttgtaggatatgtccaagttcaaggttccaacactgcgttatcattatttttattacttacaatctccctaggttataaattccaacccaggaacagagaaagagatggcatcagaattgttttcaagaatgtgtcatcattcaacactgacttcaatcattctatttgcaagttactaatagtactctctcaggtattcccttttaaacaaaaagctgaatagtcaatgtgatgacctgctttaaatataaacatagaaaagtaaaacatttcccctttccattatctttttaagattttgtcaacaatgaagtattatcacgggaacacatgttataacaccttaaacctgtaattaatagaaatgcttatgttaaaataatctcatcctatctgctttttctaaaaaattttatttatttatttgtttattttgagacagggtctcactctgtcacccagactggagtgcagtggtgtgatcaaggctcactgtagccttgacctcctgggctcaggacatcatcctatttcagcctcccaagtagaatggaccatgggcatgagccaccacgaccagctaatttttaaattttttgtagagatggggtctcctcatatttcccaggctggttttaaactcctggcctcaagcaatcttcccatcttggcctctcagtgttggaattataggcatgagccactgcacccagccatatctgcttttttctaagctatcatgacctattagtgataataaaatcaatgtagttggtcacacacagcgtatttccaaaataaagaaaacatgtagaaatcaagttcattgcaaatagtaacaggaagtattgtttcttgagtctttatttcagttgagaggtgggtttgtatactgtattgccataaacaatatattattaatctggagtgaagtaaaaaaaaatttgaaactcattaacctagtccaattctagtattccacaaaggtgaaactgagacagaggaactgagtgatttttttccaggtctgataacctgtgaagaggcacagccaggaatagaaccctaatcacttaattccatgactcttgttttatatcatgtctcttttcagcttcattttctctcccattgtaattaagttctattgaggataactaaaacttaaggaaatcactgaatgagtttgcccatgaggaattaaaagcattgaaggaataatgaagtatgaaaataaatgaataacaagaaagtatgagtaatgggcaggttctctcttactccaaagggaaactatcagtgaaaaccaacaacaaagaaccacagcttttggttttgaaaaccaaaaaaatctaaacacaaacgattttataacagaaacttaaatttgtaaataaaggcccataagtgcctgaagtttatgatgcatatcctttaagtgaaaattttagggtgtctgtgtgtattattggaccacccaaatgaaaaatgaaaacaattcttgcctctgtacaatgcagtcaatcctctggatgactgactaggtctttcacttttcttcccaattttaggggtcacagcacaggcataggtatagtgccagtggctgattaaagcaggtcgcaatctgtctgggagagtttctgtgccattcttcatagggacagggaccagacaagatgacctcccttgctgccttccaattaattcaatcagcctctgcttctatcagacatcttcagggatgcaaactgtatactcgctccaagtcctcaccaggaatcagtaaacacagaggctgcagactgtgtttaatgaataagcaggattcatcttccagtcatcatttttatttacagcttgtttccaggtattattttctcccccaatgatctaaaatccctatggaagactggggccggatctaacttctctgagctcctgctggggctaatctggtacccaaatacatcttaggttaatatcaatgttgttaaaccaacctaacctgaatttctttctcaagaaggatgtataagtaagataatcccaattagctctccataaatctttttgctttaatattctgtgaagagccactctaggaaactattatgagatacagtaaagtacagtaaggaaaacattgtcaaacaaactaaatctataccttctatttctgaaggcatatatttagtgagccactgcacctagccctacctgcttttttctaagcttcatataggccatggcctattagtgataataaaatcaatgtggttggtcacaaacagtgtatttccaaaataaagaaaacatgtagaaatcaagttcattgcaaatagtaacaaattgaacactgcaaatgttcaaataaatatacataaaaggtagagttggtatggggtgtctgctttttgtttctcttcacatggactggcaggataatttccataatagaggaaatagatcatctgagactaactatattagacaatgttggtacaacagatccaagatgaggtaagtgctcacatgacagctcatttcaaacccctcataaatcaggaacctgtggctatatttcaacacttcctatacaatcaataaaacatcagtgttcattaggcagacctcatctatagcctcagatcaaaaactgtggcttttgactacaaacctaccttacaataagaagggagtgaatttaacacatctttcctttaaaagaaaataatctaatataaaatgtgatgtccttcaacattacatataagctaattatagcacatggtttgtgtgagctttagtgggctgcatcaggacctggaaaacattccaaaactgaagtggaattttggcccagtaagaactgaatcactaaggaacaaaccctggtttcaccttgagagataatgcatgacctattaaatctctcattattacccttgtgtacaaaaacaaaaaaaaattgaaaacagtttcatctttaaactttcaatgcatgcacatgcaaaaaaagaattaaaaatattttcatctttaaactttcgttgcatgctttgaatatcaaaacatattttgtgagaaaaattataaatagaaatttgataaatttagaaccaatgtgaaaatcatagcctgagatgcactttaaacttatttctaacaaatctgcttttctcagtgatttatttttgctccccaaattatggtactggcaccaaggacttggagagaaaacaggtatgataaagagaacatttaaacataatggcacaaatgtacacacgttcctaaatagccttcttcacagaagctgaaaggggaagacctaaccatttattgggatctattatgagcctaccaccatgctagacaagttggacagattgttacataatgcttgtaatcactctatgaggcaagtattattattaccgttttttaggaaaactgaagctcaggttaaataacctgcccattattatagatttagtaagtgataagccaagaatcccaactctgcctgtctattcaaagtgatctaactctttttattacagctcaggtctaaacaataaagaacatgcccacgtacagtgtaatgaatttagatgaagatataaacgtgttaccagatcctaggaaagaccagtttcaactaacactagtactgtaagcacatagtaaccatttggcctttgactttttatcacaagcttgcgttcagcttctatatgaggtgacttttccaggctggagtgtagtagctactcacaggcatgatcatagcacaccacagccgtggactcctgggctcaagcaatcctcttgcctcagcctctcaagtaactaagactataggtgaatgccactgtgcctggcttaatgtgtcattttctaatatgtgagttttctaatagtcttccaatacttttaggaacaagacagactcgggtattggagtaatctggtaaaacaccctctttcggtcaagctctttagaagagcctttatgcttctacttccttattgcaatgcacatcttggctgctgcaatttgacttctatcccaaccacacaccaatgctacctaggcagacaccattagttgtacttcataccaattcaccacttcttacatggtattagaacccacgatttttaggaaggcatgacttggtcagaataaagactttatttttccagcctcctttgcagccaaatttagctgctgccaataggatgtaggcaaatgtacagtatggtaatttttaggaacctttcttaaaagacccgggtcttttaagacccaggtctttcgcttctttatcctttttcatcctgttctccatcctgccacctaaatggcagatgaaatcactggagctctacctgtcacctggaaccaggaggaattagagccacaacgtggagatagcagagtaataaactagaaggagcctaggtcactacagcctgggtaaagcagtgccgctgcacccttcctgcaccacctcctctagattttaccagacacaaaaatgaggttttatctcatttaaacaaatgttatttccactctctgttacttttagctggacacaatcttatatgatatataactatgatctccttgtgtctaaacccaaggacactaaacatactccaccacattttgacttttaattttaccagtcttttgaggttttctggagcactaggaaaaccataaaatttataagagaaatctctcctcttataactctgttatctatggcaaataacaacctcttttgctttcactgtctccatctgttgtgaaagagagaataatgacctcctacttcaaagtgttgtaaggaatcaatcaaataaaaactacaatttctagttttcttgtgccccttttcacaggacacaagtcacttaagattcaaaatttttacatttgactttaaaatacctatttacctgagtacctcttttctagtttcacctactcaccaaattaacgaactttttaatgaaccaattactgtttacaaaataaacaaggaaaaaataaaagcctttaaaggtattctgttatttgttgtttctaaattcatcttgctttcctatctaattttaagacaattttgttaatggttcacaagggcagggatcatgtttattttcattcatcattttatttccagtgcacatggtaacatctcaaaaaatgtgagtgtcctctatcccaaccttctatgtctgccattcctgcagtgaggggtcatttccactgccatgttacaaaaagttataagtagatttatgtcctacctgtacaggccacctcatggcatccccttgtcctttatttttagtacaattctataacctatcatgttccttaataagaactagttgttctactctatattcttatactccaataatattataaattaataagacaaattcaaaagttctcaaaagttattatagttaccatgtatgaactttttgtccatcagctggatgtgccaatctaatttagaagatctgattaatctgacaaagcgtttctgaactgtatgactgttttactcttagttaagttcacagagttattttcagcatcatattgttttcattttgcaaatgtttttctgggtcacaatgctggctcttttctgcacccatgtgtagtacacatctaacctagtaatgagggaggctaaattagtctccagtgcttcttgcttttgcagttctagatcattatctcctctaaatagccatccttctttctccacatctctgcccaacaagtgcccaataccatcaaaagaaactgcttcacacagaaatattaatgactgataatgcccgggtgtgaccactctgagtgcattttgtcaacatgttatcacttctggaatttatgtcaccaacaagtttcatgtgtgtgacaatcaacaaatttagatggccatttatttcaactatcccaaagtcccctttctcagatttctgggagtcaacaaaaagaggggagggagtaataataattccaactaaatcctatagtgttacttttgttatcaaagtagcaaaggcctactttccttttgatactagtcatttgaaattaaatatgaaaactcatttacccttaaaacaacttgctatgtattactctattaatgaaaagtctttcttcaaaagtacaaatcttctattataaaatacatgtgaaaaatattattaaatcaattctttctcaacctatgagaaaacattctcaaacttcctcttttcctattatatttacaaagtattttctattctccttgatcacttttccaaatagcatcccattttatttatttatttgctgttatgtttctgttctttcttacttcttcataaccttctcttgccctgacttgctgtggtcgatatcttttttttatttctatttctggatattcaatatcatcttacatatttgtagatcatcatgcctcaatatgaaaattcattaactagggtaaattctactgaaatgtaatttttagttaatttcactaatattcagagaaattcctaaaactttccgtttgtgatccgtttcattctcttagacaaaaaatatcacctaaaaattaaatatatcacaaatggctaaaggggaaaatctccatctaattatttctatttgaaagtaccacattaaaaaatgcaactcctttattttcctcagtgaatctttgatgaaatccaacaaaaatgatgagttacctgaaaaatgtagatttctatcattaaaacaatctggccggtgcgatggctcatgcttgtaatcccagcactttgggaggccaaggagggaggattacctgaggtcaggattttgagaccagtctagccaacatgtcaaaaccccatctctaataaaaatacaaaaattagctgggcctggtggtgggcacctgtaaacccagctactcgagaggctgagacaggagaattgcttgaacccagcaagtgaaggttgcagtgagccgagagtataccactgcactttagcctgggtatcagagcaagactccatctcaaaaaaaaaaaaaaccctttcagatatctttaacatttatgccttgttcactcaaaattgtatgtgctttttaacacctcccatcctacttatactacatcttctttatattttctttttttcagagtcactcaaatatctcctatgccctagaatgtgattcttcccccatcttttgaaatggtaaaataaaatacaattgtgttaaatgacatgaagaatgaattctgtttcctctacaaatggactctatcataactttatagttgaacatacaattagcagcaaaccacgagagcgtttaattagacctagactctaggagttgagttcacagattgtgcctatgagaaagcaattagaggtagatctggtcagttaaaaaaaaaaaaacctcagagacagaaaaaaaaaaaggtccattgttttgtcttcagctgatgtaaattcagccttaatgaaagataagctattttcacagagaatagatttttcatattgctcagagtgtatttgaaatcttataacatatggcattctaactttgatatgactttttctgagctacctctatattatcaaggaagagaaaggagaaatagagcaaatagcaaagaccatatcaaacatatcacaaatgactatagacaggaaagcaagatggtttttcttagcatagacttaatttgtctacagtatgatacataacatgcaataagataatcactataaacatcttatgtatattacacttattttgcatttcctgcttgccagaagccatactgaaatccaagatacactaataatgttcaaaagactaaccaaaaaaaaacacacaatgaagcacaatacagagtaattactattctgtggaaagaacaacaaaggcatttttttttcctgtagctgtaatcagtttataattatggcccagcaaacaaggcaacacataaagaaacagtaagaaactcctcctcagcttccatgttataaatttatggtatcttaaagctttttatctttgctgccccgacagacgacagggactccacaattcttaggtgactgttgccttcatcagtaccagcatccataggtacaggttaatgttccacagccgctaatttatttttttaaatgttaaaaccccatagagcatgacaaataacacaggtttaaaatataaacatctaaaactcagcaacaggagaaagtagcttcttatttgccagtgacaaataacaagcctgcagaaatacgaaaaatgctctccaaaaaatatatggatattatctgataatggtgacttggtaaaaattatttcattctagtaaaatagaaagtgcaagttgctttttgctactccatccatttatgttttccattaagttcctttctatagaaggtttgctatataagttatgtcgtatattctcaggtatagatatatctggaaaaggagaacaacaaagactctcttaattttttcagagttgaatccctaaactgttttccaactggcatgttgtactatgaaatccaactattttatttgcttaattccagaactggtctctatgtgagaacacattctctctctcttttttttttttggacagagtttcgctcttgtcgcccaggctggagtgcaatggcacaatctcggctcactgcaacctctgccccacaggttcaaatgattctcctgcctcagcctcctgaggagctgggattacaggcgtgcaccacaatgctcagctaatttttgtatttttagtagaaacagggtttcaccatgttgcccaggctggtctcaaagttctgggctcaagtggtccacccgcctcagcctcccgaagtgctggaattacaggcatgagccaccacaagtggccaagaacacattcttaatgacattgttaaagatattctgctttttaaaaaatgcataatactagcataagtttgtattgcaattttctgtcatttgataaatatagagataactctactgcccaagaagtttaccttcatgtagcttcataaagatgcaatagataatacacccatccacaccaacattttaaattaaatgtcaggaattttgttttgtatttgtaattattcatgtcactgcattagccattgtattagcattttatttaaaagtttactttttttcattaaggattatgattgtaagtcctagaggtgaatccgctttgttttcttacggtcgtgccaaggcagtcagagggtgaagaagtttttgccaagtcagagaccagccctggagccagggctgcacttatgatagcaggaacatatgataaaatcaatccagagtccaaacaagtgaaggtgaatgaggaagggcagcagcgatgctccgtaaagtgtggatgcagacagtaatgcctggtgactgggtcggtgagaatccagggctctgggtaggatgacttggcatgaatgtcagaaggtgccaactgctctactagactgaagaatgggagtcagatgtctttcctgcggggcagttggtaggaaatttcagatcctcattaactctttgataccaccagggggccatttgataaatgacagtgccagtgttctaaatggagtctaagcatctgttggaataaatgtacatcctaaagtgcctagcttatgaatagagtgtcactcccacccagacaatgtgcaataatgacttgtacatctcatacatgcagttattacaccagggagagagacagggacctattcaggcatagcacacagttcttaagaatattacattactacatttttttaaaaaacacttaatttgagatgtcatgcttagataattgatatatcttctcttgctactagcattctttgcctttattttgtgacttgctttcacaacacagaccttctttcagagttactataatctttctaccttctgcactattttcatattttaaatgcaaagcattgtctacattgtcttatatgaggcagctttcccagactggattttctgtaaagtcctgctgtaaccaggtaggctgccaacttgaggtagtgactcacactctgggttctgcacacattcaaccacagagtagagaaggaggcattctctctttcccttgcttaggaaatctgaaggggaaactgacttgtaatgtctattgcaagtgcaacaggactgtgttcaaaagcataggccttaaatgatctttcaaagtaatttgctcatagtcattattttgttgccatcaggtgaagaaatagctcttggtcacagcttgtgggtaaaagaaccatagaggtggttaactggattccattttttaaaaatgcaaccctaaaacagataaacatcaattttaatcaggctattaatctctatactgaaactggacatgtacttgcagtgaaacaggtttctcggaaagatggagaaatggagacagatacaccaaacaggcacacctgagcactctgtgttcctcagtgagaacgtgggcttactgatgctgagtttgcttctgaaatcaggagtgcctggtatttggaaacatcctttcaatggaaggtcacagattataagtgatatggtttcagagtggtgattttaaatgcttgtggtacatgcaaaatgctgctgttatcccagtacctggagagcaaggcccatggtcccaggatgcccctcagcaaaaaatgctagaagaggtcagcaagaggatctgagcttgctccagtcctgggtggcctctccatatctggtcactctttgtattcttgatggatatttaaaagaacatcacggtgaatgcttgtgctctcttttaaccaatagctattgctcctggaaacctaaagtaatcaaagcagtatttaaaccaaaagttagcaatgtgtggtctctgtactagcaacagcagcatcaccttgtcaggaaacttattagaaaagtaaattctccagtctctccccagccctgcttaagtagaacctcttggctagggcccaacagtctatactcttaacaaagtgattctgatttctcctaaagtttgagggcccactggcttaaactgtaagcaattaggtactgttactctaaattactctcagctttaatcatgaattaatctgaacttggttgtctcccctgacttcactaccacagccctgcaattcaagcagtttcaatctgcaacacatctacagttccagaaaataaagccattgtttttccaatgaaagagaaaaaggcctctgtgtaggttacggggtgctttttttccatcccaggcatgaatagtgtattcactttgtcgaagctgtttctgtgactatgggaaacagaagtagctgcactttctaacagttttgaacacttgcaaaccatcagtatggtgactggccacagcaggatcccatttcttctttggctccttctgcactgcccctcggctacaaaagatacatgttccttcaacattctttcattttctccttctctactgaagtccactgtaaagattgtacatcagattcttccctgcaatacaacttaaactgcagaacactcttttatgtttgtgctaagcccctgtaccttcttttccctgccagaaacagaaaagagttggaagaatgtgttgaacatgatcatgctgcttgaagatttttcatgagttttcctatcagcttgtttacaaatctttacttcattatgtgtcttctttttctacttgtgataaagtctcctctttttctacctcctttctgatcaatactttaaaaaaattaagtaatcattgccgtgtgaaccaatatctaccaattgcattttattgttttgcttagttcggtttgctgtaataagagaaggttatgatagagtggaaagggcactgcggtcagaaggtccacatttaaggaaaaattccagcacttccagacttatcagcacaggccacttaaaattcaaagctggagtcccctgatttgaaaagtgggattcatgattactcctgccctgcagaccccacacaactcctgagaggaccaaattttaaaaatgcatgtgaagtcattgtgaaaactgtaaagagttatataaacctgatttcctagtttctctgcgaggatttactagactcaaagttaacaaaacaaacagaactaggacttgaaagcaatcacaagtctccttagaataatagtagccttttaacctatagagtcacaatgccacaaagaatttagacaggttgatccaattgagtagctagtaaatgtttgtaataacaagcaaatagtaattgttcagttttgctaaagcagagaaacttagaaaatatatcctaagttatttccatatttgaaggaaattggaacaaaaggagtaaatacaccaaagactacactaactaaaagaaccatgtgaggtcaatgatggcatatggaaatgtctactaatataaaatgggctttgtggttaatcaataatgccttaatagattatgggaaataatcacaccagtaaggaattactctggatcattaatagcagtagagatttccatcaatttaaatggcccttgaaaataacacataatatttacttgcctgggttttctttaagaaaaatatcgatttgaaactcagaaatcacaaaaacaaagaggctaaaatcagacagaatgtctttgctctattactgaaaccacataaaaaataaaataaaaaaaaaagcccttagcactagcagtgtcaattatccacattatttatcctgatatacaatcttgaaaaaaatctgcctattaaccttgtggaatgcattctcacagccattttgctcagcaggagcttacaaccagtcctaaattgttagtggcaattcccaggtttagtgtctccaaaggtaattttctccagttaccaaagattagagtcctcagaaaaatggggtccttaaagttaacatactgtcatcacagacccattttccaattcagaagataaatgtattttatttgctacctaagaaatgatagcaaacaacaggacacaattcatattgatttttcttccgaaaaacatcttcctaatcaatatcatttattctaatatataaaaatagtgttcatacttaaccagtgcattatgctgtaccctggtattttattattctgagttttaaaaaataacaagaccacaacactaatttaaaaataaaagaaatagcagtgcttgttaatatgccctaaaacggtgtttgtcaaagtgtggtggttcacacacctgtaactagaattaaccaggatgcttgttaacgttctgtaactccatcttagtgaattaactggaggggaatttggaaattgcattttcacaaagatttctggtgattcctgcgcacactacagtttgtgaaacactgccaagctagccagtggttcccaagtcggctgtacattatactcacctggaaaatttataaaaacaccaatggtcagacctcagcccagagcaattaagccagaatctatcggccatgggcagtgttgccaaataaaatacagaaggtatttctttaacatgcttatagtaacaaaataattcttgtttatctgaaatttaaatctaactaaacatcccatgttcttatttattacatttggcagcccaagttataaagctcaggcacagcaagatttttaaaaagctttcctttttgagtcaactggacagttgagattgaaaacaactgatactaaacctaggctctaaagatatcgaaagatatgactatacacaaactctcaggcattaggcgcagagttgaaacaatctagctcagaagcaaagtgaagtacccatcacagctccactatctcatatactcatttgttttccccaaaattttacaggtgttgactgatttttaggtaagtttataataaatgaaaagtatcaacataagactcatctttttaaaataaaacatcatttttaggaaatacttagaaaatactaaataaaatgagagtttccaaaaagttggtgtccatgatcagctaaattcttttataattggaaaattggcttctacagtcacaaatccctctttttggatcaccagaattcccattaggagaggagtcatgagtaacaaccacctctctcaatgccattcagtctgccttgaagcgttcacctggcagcagaaaattaacagcatttcctccttgcgaaaaagttaggagcctttagacattatccaattgtccaatgaatggggatccatgtggataaacgcaggcacaaaatcatccacagttttacacagtaagggagaagattaagtttactggatgtatgttgctgcagccagtgaagttagaataaaataagactggaaaaaaaaaaagcccaaaatttttggaaaggcagagtttccccattatggtcaccccacatttaaaacatcaacatagtctacacataaaaataatttacaataaaataaaacatcaatatatgaaccttaaaataacattttctcaagaagaatttcagcttctaattttccttaatatacatgagttaagattttaaagatgaaatttaaacaaagctgaattctaatcagataactgatttcaggagttactaaataaattttaacaagaatatatcttcataacgtacctttgtaaatgaagaaagaacacaaattaattaatatgagaaaagtacacgcccatttaagccttttttatataatttatctctgttgtccatgatttcagatttcctgaaatttccttaaaaggtatattcccagtatcacatcaacatatcatatcatatcaaacacttagccatcatcttgcttctgaaaaaaaagtgaaattctaaaactaccttgatatctattagcatatagctctagattttgatgataattaatccacttctttaaaatgtggtgtttaccaaagagggaaacataaatgaccagtggatgacttaaatgaccttcactgagttaacatggcactcctaatgaccatttgtcatggctcctggcaaactatttctcactaatataatgataggggagtggctcataggaacctggtgatttagtgtttacacactaaatccctttaaattaaaaataaactaagcacaagatgccacctcatttgaggttcacagtgtgcccattcctccctttttggtctaggagaacactagccctctgtgaatgcatgacatagactcctctggctaagatcctctagttaaagcaccctccaaaaagaagagccctcctctcatggatattatattcattattagcaaataaatatcattattcccagaaacaattttggaggacccactggggcttgtctcaattctaggcattataaaattcagtcctacactgagctcatcatcttatctctctttaggataaataaatgtgggttgcgagatttaataaataaatatacacgatgcccagttaaattcaaatttcaggatcagaagtgcgctgttctctccttttgaatgggagagtctaattggacattttacaattataatccatttactgaaaataaaaataaaagttcaaactgaactctagactacagaaatggtcattaaatgtgaaagcttcctatccccaccctatgagttattatcagacttgcagttcattaattcttgagatattcatggcttataattatcctagcttttctgtcaatataaaggttacaacttaataagagttaccacgctaaacctcttaatttttataaatacttcatctgtgttgtgaatagcattagtaaaagtggcttaaactgaatggcctaagaacatcatttgtggtttatcatctattatttacatttttaacatttaatctggaattacaagcaaaatagcatatattcttgttattttttaaaatattaaatcaccaataacatttccaactctattttttttaaaaaatcatattttggatttctctaaataccatgccatgctccatggtccatgaatatattcattaggactgcagccagcagtgtgcaaatttatcaataactctcaagtaacagaagtgaaaggctgctccaatttgaagtctactgacaattctctgaagccaaaaccttttagtctatcaagcatggatttattcatgatttttgaccttaaaaactttagggggagagtgttgaaaaatttaaaggtctaatcattgtataaaaactactcttagaacatgaaatactattctaaaatctgtacctaggactaagattgtgtaaaacaacaaaggaactcaaaattgactgctctctctcttctccctcatagcaacatgaacttttgtctggctcaagcccaatactatctaaagatatattttgatgttcccattaaaagtaagatggagacaacaaatattgaactgatagtatttgaaaaatgatttgagattgtcttatttggggataagtttacaaccccaggaaaactgcaagaagagaacgcctctaagagaagggccaaatgacatcaagatgctctgaattctgcactaaagaaagtctcagaattctttcccatatttacacgttgccaagtccagtgtcttcaacttgtcttccattatattgggattaataccttagagcattttttttttccattgtgtagtgtgcattaccttcataggggcaaagagaatgccccaaagcagattcaaagtgtataactcaggattaagaaaaaaggcttcaacgtttgcattttaccaagatagaacaaagacatcaaggagagtcctgatgggcaaaaattacagatccagatgaaatagtccagaagtctaaggcaaagaaaaactaggtaaaaatacaaatatttttctttacatttagagaagggaggaagacatggccatggccacctcatagtgataggggtgcttcaacatgtccttaaggccacacccaggatcattctgaatcatcagcacatatctgagataatgacagggatgggccagtgagagcatcctgtgcatccagtgggatagtaaagagagtttcagcttttgaaatagggctgagctgtctccatgtcagccttggctcttgcctagtagcgggcctttgtagaaaatcaaaagggaaaatgggacagtttccttcaacaagacgttttactaaactaaacttctcatacgtccaagagtgaagttctgggacttgctgctcctgacacatcactgaggacagatgactggcatttgcacaggaggtcagagagcaggaaccattagagggctggggctgttggaaaaagccttacctatgagatgagactgggaaagtctcccaagaagtgtctgtgttcaacgaatgtggatcagaaagaacaacagtgataataacttggagcaaaagttccaaggcagaacctaggtagcactattggagaacactccagagcctggtttgactgcctcagagacattatataaggagcttggagaagtcatttggggagttgaaaatgggccaaagacatagagggactaaaatgccatagtaactagtgtagacactctcatctcttgctgcccgaagtgtgatctatggaccagcagcatcaacatcatctgggaaaagatagaaatgcagattctcagggcccactccaacctcttgaatcagattctgcattttgacaagatccccataggattcttgaacacactgataattggagaagtaccactccagcatttagtggaaacacctggtactaaaactgaaggcacgctcaggaatctccattttcaacaaacatcccacgtgagacaaataagaagatggcaaataccaatcagtagtgaggagcatgttggtctgatgaagattagtaggatggatgtaagagacaagcagcaatcatttaaaatacactaacaataatgtagacatgatgatatttatgagtaaggtcagacaaccgattttaaacaacctctttgattctcagcttggcacacaggaacacaggatagattaagtatcaagaatccctccttgtacctagaaaattcattccaaagatagtacctccattccttcttcctccatccctggactgtagaaagcagattccccagctggggcactcagctattagtaaccgaagtactgctcatagagtacaagaaatagtggctgaagtgtggcaggcattctataaatgtggttcatgttgttgctataataacagcaattattactaatacctttgctatgcctcctcacctgtccagtttgctccctctaagttgggtttacttagctcattgagacttctaagaacctggatgagacaggcctggatttgaggcaaatcagcacaaaacttcagaatccagtaatctcctccttctcatcccaaggagactgaagccaggaaaaggagctgatgagttccaattaccttttcagaagatagttagaataggaataatcaacttactttacaaaatcagaaagtgtatacatcctcttttttcaagtatgatgacatggttatcctccaacacaagctctaactttcaagttttttttaaaatgacaatgatattaataatgatgaatgctgatgaaaatattctaccttgccaaattactttgtggttccttaaaaaccacaagctctacgaatctcatcatatcctaatgcattgctttgtacagacccaggaaggagaccagcctctatcattcatcaaagtgtccttcctaatgcagtctacgctcccttcagaagtccatctgcacacccatcaggcttccttctcactcctgtactatgaaagtgctgccttcagtagactttccccccatttttcccatttaaatatttataactgtaatgcagccatgccctagttcatcaatagtgattcttcttatattcaatgaaaaagaaatgtagaacattagtgagttagaggttggtctctcttgctacacgctaatttgtttctttgaccagcctctgagcttgcagctcacatcatcccaactgtgccacttggagggcatgaagtttcaaagaatatccagccctctaggatcctttatgtggtatcccagccaataatttggggagaaaaagtgttcaatccttttctcaaatgtacaccaaaataaattctagattaattaacgtttaaaataaagtgtttaaaagaaaatagagcgctaatatttccctgccttgagaaagacttttaaggaataatattagtcagaagccttaaaaagaatgattaatatgtttaactgaataaaaatataaaacttgtaaaatatttttaaagccatgtattattagtactattaaaaagcaaataaatatcttgaataaatatttgtaatatctgatgaataaacatgtaatattgtatatggaaaaagctgcttaaaataaataagaaaaatgagaaatatttgaaataaatttttaaaatctaaatggccaagcttataaataggatattcaaaaaagaggaaacacaatcaaccaatatgcatacgaaaagtgttaacctcccttgtatcaaacaaatacaaatcaaagccatgctataacacctatttttcacctactaatgtcctatatactgctagtgatagtataagttgattcccattctctagataaccatttgccaacatttaaaaaaactttaaaaatgtgtatatgcttcatgccgcaatgccacttgtagaaacatatcttaattaggggtagaggtgacgtctattaaagcaaccaacaataatgaacatgtatataatggaatgctttgtgaccataaaaatttatgatctagatctataattattaacttaaaggttgttgttgatatattgctatatcagaaacaacaagtttaatgaatagtatttttcttataatttattttgggtaaaatgaaaatgatgatatgcttatgtttgcagagggcaccaaaatagtattactatgtggctggtatttaatagcttattaattaaatattttcttttctgtattatataattttctataatacgtatgtattagttattgtaatgcatgttggttaaaaataaaaatatgtaaatatttacaatgcagaggggagggagagggagagagtcagcaaacaaaatattcggaaggggtcccctctcatagtaagaaggtaagtagagagggctcaccctttcagagcgactagttgcagagggaagagaggccatagtgggttgtctgtctcctttgcttcgagtcagattttattgctttgtacactttctcaactatacaaggaactattaataaaaagagttaaacatcaacattgctcacattggactgccagcaagtgagttgcctaatggtttatttaactaacataagtaatgtgtcactatattactgatgcaatattctgaagaacagtgatagctctacgtttcccttgttatgttagaagcactttttaaaattagcaaataaaaactatatatttatggtgtacaaaatgatgttttggtatttcatacattgtggaatggctaaatgaagctatttcacacatgcgttacctcacatatgtatgtcttttttgtggttagaacacttaaaatatgctctattctcttggcaattttctagtatacaatatatggcttctaactgtagtcagggtgatgtactatagatgttttgaacttacttctccatatctaactttgtatcctttggctaatatgttcccaatctcccttctcccagactctggtaatcactattctaacttcctgcttctatgaactcaactttttaagattccacataaaagtgagattgttcagtatttgtctttctgtgcctggcttattttactaacctaagtgttcatcaatggatgaatggataaagaaaacgtggcatatatacacaagggaatgatattcagccttaaaaaaaaaggagctcctgtcatttgaaataacatagttgagcctgaagggcattttgataagtggaataagttagaagaacttttgagtgaaccccacacctgtgatttttctggccagcctcttcgtttggccttccagaatactccatcagaacacattatcctaaccatgcctattttccttaagagctgcagcataaatggcagaatcactagaagccatgccacaaactggaataaaaccacaaaattaaagttttaaattaggaaagaaaaatcttcatcctttggaagcacaaaggtcaaaatgcactgagaatatcatggagacaatgaccacttggttcaaggaaatggtgttcattcacataatcacagcatcatataaataagctaatagactgtgggccacaaacctggtgaacaggcataaatgtacaggtcgttcttagcaggatttactgaccttgaaagtgagatggaggctgatttaacagaggcaggtcaaagagatcagtttccaaatagtcacttatctattcgtaaatgaaaatcatctttgaataaattagtgattctcttggtgcctgtgaggccccaaattattctggcttttcattgtaaatgttttgggtgtcatgatttcatttccctttaaaacacatcctttactagtaaggactttggaaccttgtgtctgaagttcagagaagctaccagcaggtggcaatattggtttattgagtaacatcacaggtatgtgtgggcacagactgcgggtagctccatggatactctccctaagatgtctagtttaattctttcaaaatacaaaactacttacacagcctccagcacttagttgagaggagggaactctaatcataaacgtatatacttatatagaaaggtaatgagaagcaaggttctcttttcaaatataaatcaaagtcaaaaaaaattataggtagtttgagtctcatggttagctgtcttattatcaatgttttcataaattctataatcagagcttacattcttccacatcctcagagatgatctttgcctttcttccagtcctgcacattctagttattgtgagatttaagcattgttctatgactccacaaaccaagtaaacaaagtccttaattatctctaagcaagggtgctgactacaatggtcaagaactccagccccagtatcaaacagccatgaatttaagttgttcaccacttacttgggcagagtatttattctcgttaaacctaactgtcttgctctataacatagtgttaaggatacacctgcctcataggattaaatgagagatcatgtgtttaaagtgctaagtttaaggcagtatgcctggcacatagtaaatcgtcactaatactattatcatgacttaatgcaagtccctgactgattgagtaccttttcttttgttttaatggtcagattttaaaaatggaatagttaacttaccattgcttgtacactaatcacaaaagatgcagaagggtaattatcaaagggatgcactctctcttctaaaactgatttcaatctcctctcctaactgtcctctcagtctgcacttttgcaattacagctcttatcaatgttgtattccattggcctgattcaccagccccttggctttccctgcagctgtctggcagcttagcttttttcccttatctctactactttaaggaaagctcttacttagcaggatcacttcttttcgttatctttccaaatattccaaacataaccaagatatactgaaatgactgcacacaatcattttattttctacaaatcccctccaactctatcccgcttcattgtctcattcctttgtttattcttctgccataattggccaggtcaggcagccagttgaagtaaacattttgccattaacctattgaccgcagaactttctgtgtgaaaaacctggcttgagagctccctcctctcctgtctcttctctgcatccttctccctgcttccacctttatctaacagatgcagcttaaagaaaatctagttataattccacttcaagatccattcaacgaagacacctgcattttatcctcattaaggatgtgctacaagctgaaaacattacagcctgaactacaaatagtgcccctttctttacggctgattacagcaacttggttgtggtagttggtatgcctctgtatgtttataacaaaggatatgagatggaattaactacatctagcttctgttatgacttactctacctatgctgaggcttgttaataatttgtaggactttcagaatcttaaccaactctatcttgctctgctagaaactattctaccagaaactgcaccctcccctccaaataaataaatcaacagcagggtgaaatttcttgcccagactgtggtcctcttaccactcaatattctccatgaacctattctgacactttccttccatctgagatgctgagtataccaatcccaatggtcagcccataaatagtaatagaactctaactcatgatccctataataatacgcctagaaagccaaaccgtaactcctaaagaaattggctcagaaaggtcaggacttgaccttcttaatgactgtcagcttccctattttttgtctccactctgctttcaacttgggaccaatccaaaaaagccaaaaatgatcccccaaacccatcacataagatgccccacctctggttagcctaccttcagcttccccatggcaataatgtccaatcagagcacaactggaactatttaacatgtatgtatttgttgaacaaagcttccgcatccccctgcctgtcttggaattaggcaagtgatggtggctgattcccttgctgtagcaagctgtgtgtgaatacctccacttattctgctttgaatagtctttgttattcccccagtattactagaggttccactgagacatggtctgcaccacccactgtttctgtccctaggtttcaatcaggtgcagtacccatggatacctcttacagcttgctgcttgtggcttgcatccatgcagatgtggaaagtcagcatgaggtctgaactcagctatcttttcactgagtcccttggctgtttattctgtttggtacccaagttttgttattgtctcccatttgtttgacatccttggcaggcctttcctactcaccctctttgctttatttcattcttctgtgtcggactgtctgaaagcgtttatcattagaatgagaatcccagggtagagcacaggcatgagtcctataagcctatagtttgagctggtctcacagactttcggttctctccagaccagtttccatttgtacaaactttgctgtgagtcaccaacaaaactggacgaggtcttttttctattctattttgtttttggggtcctgaagttttgctttgattcagacaagagttttgtccctgatgttcagcctactgtgtccagaattggtgggttcttggtcttgctgacttcaagaacgaagtcgcagaccctcgtggtgagtgttaaagttcttaaagatggtgcacccggagtttgttccttcagatgttcagatgtgtccagagtttattccttccggtgggttcgtggtctcgctgacttcaggagtgaagctgcagaccttcccggtgagtgctacagctcttaaaggcggcgcatctggagttgttccttccttccagtgggttcgtggtctcgcggccttcaggagtgaagctgcagacctttgccatgagtgttacagctcagaaagctggcacggacacagagtgagcagcaggaagatttattgcaaagagcgaaagaacaaaacctccaaagtccagaagaggacccgagtgcattgtggctgcttgcgcagctggcctgcttttattcccctatctggccccacccacatcctgctgattggtccattttacagagagctgattggtccgttttgacagagtgctgattggtgcatttacaaacctttggctagacacagagtgctgattggtacgtttacaatcctttagctaaacagaaaagttctccaagtccccacccatcccagaaacccagccggcttcacctgtcactggcatgcgtcgcgggactttgcggcacctagccagccactctggcagcccagagggagctcgccccccagtcaagcccagcaggtgcctgccggctgtgccgctgagtgcggggcttgcggagcccgcgcctacccggaaccgcgccggtggccacccgtaagccccagctcccacccgcgcgtctccctccacacctccccgcgagcagagggagccggctctggcctcggccagccccagagaggggcccccacagctcagcggtgggctgaagggctcctcgagcgcggccagagcggacgccgaggccaacaaggaaccgagagtgagcgagggctgctagcatgttgtcacctctcactaccaggggatatacattgtcaggtctgcatttataggcagctgacttgttgaggacctgagacatgaagtacacaagcattacttttgactaagttttggcaggtctcatgaggttaagactaggtcttctcctccaagaaaaacttctgcttcttttatgtactgtcattgcagtcgtaactcttgagcatagctctctaaatggcacaagttcacaaaaaaaaatattgagaccaaaggctacttcgacttgaaaaaaaatgttcatttgagaggtgccttaggaaaaaaaaggaataagatttctcaggcctaaggagcagcgtttttctcttgtgcagaggtctccaaatgaaattctgatttcttcactaaaacttcttcactaaaagatgctttggtctaggctaaccctcggtttgacaaacttaaaaatcaagcgagatgcatttccctagtaaatccctgttttcctagtccttcagttgcctccttatatccaggtttcccttttgcctcttcccccttcattatattatctctcctgccactcttccatcatctcctcccttcacttctccttgtctggactccctacattttccaaatgattctcctaaaaccctaaaatcccagttgcctctaaagacccatccgtcctagtcccaagtggtcccaggcatgtaggcaattctagaatttaggcctcagatctgagctgaattaaaagctataattaaggattttcctaactccacacaagactagcacgtactcatggaataatttagactattttgagtgcctacaacccatagatacttgacctatgacaacttaaatgtatgttggttggaacctcagacactaaatcctaaatgacaaaaatggaccggaatgactcaaaaaggagacctagatgatccctctttccacaataaacctcagggtagaaaaaaatatcctagtcctgaaacagctacagtaaaaatagattgggctataattcaatcatgcaaacagagaaaacatgacactataggatatttgtcaatggattacatgtgaaattggagactcaatttagaaacagaaattagcataagaagtagactcttttacctgagttacaatatcatacagaacatttttaaagggcttcagaacccaaacaagacaagacccaaaataaacttaagagacctgcagatcaaacagctaggtagctcactttctgacccatcacctaccgaaaaggatacttgcaagtattaaaaacagaagagacactggaaaaaaggattgtcccatcatgcaaaataaacaccaagtcaaagaaaaatctctcaattcagatctgtgagggtaatctgaagaaagaaaaagcacccaatatcctaccttactgtaaacactcaagatgaattaactgtaatatagatggtcaacctgctggcaggtacaagagctactctgtcttcattacaccctgttacctttgttcagcctcttccttagagcaaacatacaacataggtggtaggtttttcaaataatgcacagattgttcctatatctcaatctttaactgtaatccttgggctcttgagtaaaaaacattccttccttctctgtgataaaatccctgaaattttaataggaagtgacttactttgcaaattaaactgtagtatgaaatgcaaaccagaagaactatttcttgaggttccagagtcctcctctattcattatcaaattgtgtctgctctggtatgtctttgcctcctccattacatttgatgcctaccacagataaagctcctgatatatggattagtttcctattgaagctgtaacaaattaccacaaacatagtggcttaaaacaacacatatttattattttacagttctgtaggtcataagtgcaaaatgggtctaactgggctaaaatcaagagtcaccagagttgcattagtcctagaatctcacagggagaatctgttcccttgcgtattttatcttttaaaagccacctaaattccatggctcatggcctcttcctccactttcaaaagaagcagtggggcatcttgaaatctctctaacacaagccttcttcttctacttataaggaccactgtgattatattgggcccacctggataatgtaaaagtcaactaattagcaatcttaattccatctacaaactgaacccccttgacatataggatgacatagtttctggtcagtaggaggtgaacatctttgaggggctattattctgcttaccacaacattttacctgacattgcatgggctaaaatttctgctgatataggaaaaataattagagggaaatctattaaacttcagacagattctaccagacagttatccaaactcccccaatatccaaaagcaaaggaaggacttaaacctatagataaaagccttatatcaaagaccttcccatactctacactagcctttgtaacactcccgttctgccagtaaagaaaccaaagaagtgagaatattgatttgttcaagacctcagggccatccacaaaattattatccttaatttccccatagaatgtaacctaactaccatcctctcatcaattccaaatgccagccacttgctgcactgggacagatctctgctctgcccttttcagagtgtctgtagtgaagtcaatgcctttataccttcacctggggagtgcaacaatatactctgacagtcatgccttaggggttcactaaagaccctcctattttcctagattctcaaataagacttaaaagacataggtttcccttctgattcagttttgatacagtatgtagataatctcttactttgttcacaggacaacaaagcctgtaagaggaattccacttactctcagtcttagcagaaaaggacataacatttcaaaaaataaattacaattatgtcaaaatagagtcaattatttagggtatgacctatgtataaaggggaaaacatactctcattataaagacaattcaacttgtcctggccctctaataaatgacaacttagagaaattctaagtttaattgatactgaagataatgagtgccaaacttttctgggattgcaacatctctttatgaattgactagggcttcaataaaagatactctcctctaagaggaaaaacatgaacagggcttctgtaatccaaagaaggctctttaagagcctcaccttctctaagtacccttaactacaaaaagctcttttatctatttgtgcatgagtaatctggacaggttgaggtttaaactcaaattcaagagaagcatcagaaacacactgcttactataactgcacccatgacccggttgcacagacttagcctccttgtctcaggacaatagccactgctgcaaaaattgtcaatgcttctgctgaattagttcttagctccccacttgacttcatggttccttacacagtacagacattactactgactaagagcaaacaatgcttttcagccagttggttaacctcttatgagactctgttactgtctccctcccacattactaaaattcaccactacagtaccctaagtcctcccactctcctgctcctaccaaaagaagggaaactttacaattatcttacctaagtgaaggaactttatgtacctcactcagatttgttagagattcccattggaaactctcacctaatatgatttgttggcggatgtctcaaaacagaaacttgaggttatcaaacaggatatgttatccctcactaatttaaggtctcctttagagtacacttggccctccacatctgtaggctcctcaaccaagaattccaccaaccacagatagaaaatattcaggagagttttccctaggttttcttcaagtattgttatagtatcaggtctcacatttaagtctttaacccatcttgagttgatatttgtatatggtgagagatagaggcccagtttcattcttctgcgtatggctatccaattttcccagcatcatttatggaaaagcgtgttcattcccaatgtatgttcttgtagactttgtcaaagattgattggctgtaagtatgtggctttatttctggctactctattctgttcattgatctatatgtctgtttttatactggtaccatgccgttttggttactatagctttgtagtataatttgaattcaggtaatgtgatacctcctgctttgttctttttgcttgctttgggtattcgggattttttttttctttggtttcatacaggttttaggattttttttctaatttcatgaaaaaagacactggtattttggtaggaagtgcattgaatatatagttttgggtagtatggtcattttaatgacattaattcttctgaatcatgagaataggatgttgttccattttttaatgtcatctacaatttattcattagtgttttgtagttttccttgtagacatcgttcacttccttggttaaatatattcctaggtattttgaggttttctgtggctataataaatggggttaccttcttgatttgattctcagctagatgattattggtgtatacaaagtttacttatttttatttgttgattttgtaccctgaaactttactggattcatttatcaaatctagttttttggtagagtcttcagggttttctagatgtaagattatatcatcagtgaatagggataatttggcatccttttttttccagtttgaatgtcttttctttcttcttgcctaattgctgtggctaggacctccagtactatattgaataggagtggtgaaagtgggcatatttgtattgttccagttcttagaagaaatgataggcaacgaagattttgaagggtggaggggtgagaggggtgaagatgaaaagttacttaataggtacaatatgcattattctggtgaaggatacactaaaaaccctgagttcgccactatgcaatatatccatgtaaccaaattacacttgtaccccataaatttatacaaatagctttttaaaaaaattagaaaaaataatacaaataaaaaatacagtaaacaaccatttgcatagcatttacatatattaggtattttaagcaatcatgagatgatttaaagtatagtcatgcattaattaatgagggggatactttatgagaaatgcattgttagataattttatcattgtgcgaacattacagactgtacttacacaaacctaggtggtatagcttactacacaactaggctatgtggtacaccctagcgctcctaggctgtaaagatatacaacatgttactatactgaatagtataagtaattgtaacacaatggtaagtacataggagaggtacagtaaaagtatggtattataatcttagggtatcactgttgcaaatgaagtccgtcattgaccaaaacattgttatgtggcccatgactgcatacaggaggatatgtgtagattatatgcaaatattacattttatataggaaagttgagtgtacttgaattttggtatctgtaggaggagtcctgaaactaatccccagcagataccaagggaggacactctatactcctccaactgaggtaccatcagctcaggtggcagaacgtattatgcttactagagcttacaatctaacaaaaccctagaaagtaaacatgcatacatagagcaggtatgcttttgcagtagtacatgactttgggatgctttgcaaccaaggaggtttctcatctctgctggaacttccatcaaaaacagacaggaaacttttatgcagtctaccaccaatgggcatttaggttgatttcatagctttgctattgtgaatagtgctgcagtgaacatttacctgtatgtgtttttatgcctaccaggggttgtagggtgggaggagtgagaggatctataaaaataactaaagggaactaagcttaatacctgggtgatgaaataatctgtacaacaaacccctatgacccaggtttacctatataacctacgcatgtacccctgaacttaaaagtttaaaaaaagaaacttttagatgcttcctagggaggtgactattacaaaggttgaagcccatacaaaaactgatagtatgaaagtttggggaaaatgctatagcagatcattctgccaataagcaggcttcaccaaggttatgagcctaattaaactctcaaagaataaatcccttgaaatattcaaaaaggccgttatgaaatatcaatgttaagttcctaaaaagtcctaaaaaggaagaatggaaaaactctggttgcacatttcacacagatcatctctggcacccccaatgaggacactggagacatgaataacttccaatggatatgaacaaaatttctctataaaactactcatcatggtacagacaaattggttactatcttaaatcatcattggtggggaagatttatggactgatgaggctatttttagatcatgtgtcacctgtcaacccaacagcatcttggagaaactataaaggtggatgtgaaacctcaagaacccttaacaccctcagataggttttgtccaatttccattctccatgaaacttgtatgcctattttcaggatcggttgaaacatttccttgctgaaaagctacagccttcacaatcagtacaaagctccttgataatgcatttctaatttggggcataccaacttttataacaagtaaccaaggctcatgttttatgggagccattgtaaaagaaatttgtaatgcattgtcccttactcaaaaatgacactgcctttattactcacaattttctagaaaagttgcaagaaccactagcatcattaaaattagcaagctttctgaaggacgtgagcctcctttgggaggccaaagttatttccaccagcacttatggccatatggtccacctgctcagagaattactggttatctatctatgaactggtaactggaaggccccttcatttatggacaccacctacagtattagactaccctgctacacaaaaatatgacaaaatagcaaaagaggctcatgtagtatactcagttttatcaccaataagttaagattgacttcttaacttgtttacaatcctttcctacacagcctctttatgatcttcaacaggagatcctgattattagaacagacattagaaaaaactgttcttgaacctcccctgtaagggaccttatcagatacttttaacaacaaatacatcattgaaactccagagatcaatccttggattcatgtttcataactaaagaagcaattcaatattctatacaactggaaggctactccaacagaaaaacttaaacagaattcttagagatattatagaaatagttggtcttcagaagcagatggctgatccaaaacctccagaaaaagatgatcttggacagtagacagcttgcacccaatacatccaacctaaaacccctgcattcttgtttgtttttcaatcttcttacctgttaccactctccttattttccatagagctctgattgtcatccactaataatggttctttttctcttttttttttgtctattataattaagtcagaacatactcattctaatgccattcttatattttttttttcaaaaataagccactgccctcaatattacagactgctgtataggtcaaccagaaccagaacccctgataaaaaacctctgagcaatcctagtctcatcaaatgataccccagcaaattataatcagtgacatttccacttgtacctacatggacaaatgactttaaacaaatcaacctaagactttgctgttgtctctctataccagaaaaagaaccaattcttactgcctgtttatcagactctatataattctaaatttgaattccataatcttcactggacaatgggccaattacttgatgccaggaagacagtaatagagattcaaataggtaaactcagctaatgtgaggccttggttccaacctcatgtcatgaataattctttttgtccatggctgtccagttcgtgacaaaaattcctggtctcatctgcctcaggctaacacctcaagtctttttggtacacagaggccctgattctataaatcatcaaggctggaaattctgactcaaatacaagttccaaaatgaggccacctttgaagcattctatcagggagaattactgactcattgtttatatgaataatcagaacagtgttcccaacaccagaaatcgtatacatagaaaagactaagaaatttaacattaactctaacagaagttattaacagtaccaactctgccctagatgtaatacacatcagtcttaactcatcagcagtagtaatgcataatatcattgctctaatttcttgttggctagccatggtggaatctgtgccaatagtaatacttcttgctgtacatgaattaataaaacaggcaaggtagtacaggctatatgctaccttatgaaaaagctacctaaatctctaaggtgatcctcatgccctgtagaaatttttctcacagcctgaattgggcaatttaggttcttggacccaaaacatcttataaggactataaactattcttctttttgtcatagtgctcatgatgctgatctgttgcatgctatctagagtcttagatacttctgtgcagccactctcttatcagatgatagccatgatgataacacaacaaaaaggtcaagatcttgggaaatgatgactatatgtacaactgaacaatccgtaaatggtgaaggtcttaagccttccatgagaatgatgcaaaggtgagactgagactaaacatacaaatacacaaaggccagatttttatatatatatatatagtcacaatatatgaaaatagcactctaatgcacaatctccacagcaatgagcctgggaaaccaaaccacagtctgcaggcttcagacagcttccctacattttgtccctagtctcaactcagggccaaaagaaaaatccaaatatgcatcccaaaccaaacacgtaagatgccccacttccagatggcttacctccagctttcccatgccaagaatgtcctatcagagcatgtatagtatctttgcttttttaaattcaatataaggctttaccaccctcctgcctatctctgaatctctgaaaagtgcaagtgatggtatgtggaactataacaaactctgaataaatagtttgttatcatttaggtagttttaatttattttcacacatccttgtacaatgtccacaggcaacccagaatactaaactctagcaagtgtacccataatgtaggaaagtaaatagaccttaaaatcaccagttctgatattcaatatatatctaaccttggaaaagattgttaatatctctaagtcctagtttcctcttctgaaaaataagagtaatgtaatcacctaaatggatttggtgtaatgattaaatgtcatgatgatgatgatgatgatggtttctggtagtagctatgttcttcagatgggatggtaactgtgtcttgctgtttgctacctaatgtgagatagtatatgattttgtgtgtgtgtgtgtgtgtgtgtgtgtgtgtgtgtgtagtgtagcgtataatttcaagcatatacagaggtacacaaatagtatgacaaatctcaatggattcatcacccagttgcacaaattatcaactcatgggcaatcttttttatccatagtccttctattcacgcttccattatattttgtttgaagaaaatcccaaacatcattatttcatttgtaatatttcattatatatctttaagaaataaagactcttatgaaatataaccacattattatactcctttaaaaatccttaatatctaatatcaatttctcatgctatgaatctaatatgatgaaaagttcaacattgatttatatacacttcaattgtttccacacatttatggctccttttcttcatttctatttttctttaaaatggtgttcataaaaatgtatggttactaactggattacttctatatttttgacaaggggcagaatttggaatacaactgaattttgtctccattaatacctaccttcactacctttggtgaatattccttatatcttataatttcttgctattttaatatctaaacaacctagagtaggctgtgtaatatttactatttagctccttctagtacagtgaaggaattacaataaaatgatactatggagaatatgcatggggcttcacttaatcaatgtcataaatatccatttaaatattttcaaaatatttaccagttcccttagaaataatttacttgaggggtgatgagttcttgcttgtctgattcatttgtaaggttcagtttatttactgaggattatcgatgtacagttaccagtaaatttagaaagtatcctgtaggttgcatatttacgaaaagtccttccctatcatttatcatcctctaaacacatcctaaccacttttgctatcatcagttttgagcaattgattttcagaagcagacatttgaggggagtggctgaaagggaggtcgtttgagcattgctgttttatgagtcaataacccacctcaatgaaaaagaattaatttcactgaggtaagtaaaatgtccttttaaaaggataaaatgaaaatatcatacattcattctgtatagttacatcgttagattttctatttttaaaaatttcctctggacacactttattttcccaaactatagtaaataccacagcaaacaaaaatttttgcaagccttatggaattaaaaaaacaacacttagaatcaaaggacattcaactagtgaattattgcacataagtcttaaacttctttgactctttttgtgaacagcaggaacagtgaaattaaacaaaaaattattaaaggatttgtttccaactggataaaaaggaagatggtaaaggaaaaggaatcttctaagaaaactgtgactctttaatatcttaatagaacatatattagtcaaatgtaatattaacagaaatgtctcatttgtaccagtcaaacaataaaattggcttctagacgagatattttcattccataaatcttaggaaacgtaacttgagatatttagtaaaagcatgccctaaaacccgttaaatctaaatttaattttctgtggtattggctaagggtttgattatcttctttaagtgaataaaatcaactgttctgttaaatattttccaggaaggaaaaccagaagatataattgcaggagacaaggataacctcttcttgcttactgtcattaaattaaggtttagaccctcaatgcaataaaaaaaatcaaatgtcaaatctttcagctataataattttatttttcctggtttattcagtctgcctcagataaaatctgtaaaagcgaaaatgctctgagtcatacatttaaaattttaaaagttgtaaccacatcactcttaccagaattaatcttggcactgtgatgaaccaaggtaagtaatttttctctagcattaagattctcttctatgctaaattccagctatgttcaaacataaggatatcacatctaattattaaaactttgacaaggaaatgatagtagtaaggtgaatgactcattgcctaatactcagctgtcccatgtcagcaaacccattcattcttggcagaactggaggcatacttcagtctacaggtataccttggaatatcaatcaattagggattccttccaaatccaattattaccaacccctgtcacttccaccttctgagagtctctctaatccatcccactgctaataccccagttcaggcccccttcagctctcacctgaactgcaactagggcggccatctgagggatctcccgtttctgtgtctacccagccagcaattgatccttaactgaacaggagatctgtcttcccagagaacaaatctttggatggcaaacaagcaagagagtcacacacaaaatatttcacaatttagtttcaccatagtttatcatattatcgtcccctcactctcccctttctcactcccttcctattcagacagacacacatacacacacacacacacacacacgtgcacgcgcaaactccacattaaccctaatctcacaacttcccagatatagagccactttaataacctttgaaaccacattggactcattttcacattcctacaaatacactcacaaagcattgtaaatatttgttgtgtctattgcctctctgctaaactatgaatttcatgggggaagtaatcgtgtcttagtcttcatcatattaatctctttgataaatattcatcaaagcgaaactaattctaacaaatcaatgtaatataataaatattcaataaataaactatgaatatttaagtattcattaaatgttaaagatgccatttcgacttcatttaattttattggaatttatgttaaaatttgtaaaatatgagtaagaccttagctcgttcaatacaacaaaatacattctagaaatattaacaatgtaaatagattttttaaaaaaactatagaaatactagtaggaaataaaaagtcacatttatatcatgttggggaatggaaaagacctttctaagcatgaatccgaaggcaaccatcaataaaaagaaagcaatatcagctttttcaattaaaaaaaaattccatagcagagttatagcaatataaccttcagcaatgatggaaaaattttataggtacactgtctaatacagtagcttctacccacacataactactggatgcttgaaatttagctagtaagacttcctaactaaatttttaattttatttcattttaggaattttatttcatttaaacaattcaaattacatttaaatttcatagccacttgttaatggctattttttgaacagtgtggttctatcagtttaaataaaatcttctagaaagaaagtaaaaatgcaaaccacaaaactgaaaataaaatatttgaaatacacctattgaataaatacattatatcttcaaaacataaactgttcttacaaattcctcaaaaaattatcttttggaaaaatagttacagatgatatacaaaatgagaaatatagatggctaataaatatatgaaaagcattcaccactcactactaatcaaagaaatccaaattgaaacaatatactgactgctgtcacttcttcagcaccaccctatcttcacctcatttccattggttagatttgagtctatccattctaccttttcttaacaacatctttatcttccttaatcaattatttttctggcacccacctgacaaaaactgaaccttggataaattcaacagtccacgtcatgaactagagatcacataatagaaaaccatatgagacagtaaaaccacggataggtgtggtcttgccacctcattctcagcacagcctggacatcctctacatgttctttaccagttctttctctctctctctgtttctccacactggctgcttaaaccctttctgctctctcaaatttccaaccctgccatcttcctcctatgagctgaaggcctcaccactgcttcacaaagaaattaaagaccatcctagggcacggtggctcatgcctgtaatcatagaactttgagaggccaaggtgggcggatcgcttgaggccaggagtttgagagcagcctgggcaaaatggcgaaagcctgtctctgcaaaaactacaaaaattagccgggcatggtggcacacacctgtagtcccaactacctcaggaggctgaggcagaagaactgcttgaacctgggaggcagaggttacagtgagctgagattgtgccactgcacttcagcctgggcgacggagcaagactctgtctcaatctccaaccagtataaatgacacacagttattacctttctactgatcccttaaacttccccaactattaccacagatgcaatgtcaatatttatttcaccatttgctggatttcaccctttgtttcctatctcctcttttccttgtattttctattctcttcatctaatgcacccatccttcaagcatttaaatataccaaattctctcctgttttgaaaagacacatactgcagtgccttaggaaatcagcctcaaaatccgagctctaccattaccgctgtgtgatcatgtttggcccctgtcatgtttccctttctgtatctacaaaagtggaataacaacaacattccatccatagtatagttacgaacagggaatgaaaaagtttccacaaagcacttagcatggtccctggcatatgataacctcttggaaaacatcagcaatcattttcactttttgaaatgattttgagctctcctcagcttcatattctttccagccatcccccatcactctccttcctttcagagcaattcttttttcttagctaattttagatttaaagaaaagtttccaggtactacaaagagttcccatattccccttatcctggttcccctaaagctaatacattgcataaccatggtacaattatcaaaactaggaaattatcatcagtgcaatactatattaaattacaggccttttccggatctgaccagttttttcataatgtaattttctattccaggatccagtccagaatcccacattgcaactgtgatttctccttagtctcctataatccatagcaattcctttctctttcccagtcatgatctcaacacctttgaaaataactaatcagttatttggtagactcttcttcattgggggtttgtctgatatttattcattattaaattttgaaaacttacattttttagtaagaatgccacagagctgacactgtgtccttctcaaggcatcatatcaagagatcatgatagcagtatgtcacaggaaagtgttttgtaagaattatatcctctcactgactccatttcatttcctcttgcttctcaatctactgttcactggcctcagtctccatcagtccattgaaactgttctggttaaggacaccaagaactctcttgtcatttaaagtttctttaaaagaaacttctcaagcctttactcctagaccacatagtatttttgacactgctgaggactatcttctttacacatgcatttagctgccacaacacatttgcatgatttaccactgattttttattttatgagtgcttacctgcactcaggcccttccttccttcctttccttccttcctcttttatttttctttcttttcctctgtctttctccttctctccttccttcccttcccttccttgtctctctctttctttctttccctccttcattctctcccttactttagagatgggatctcactatgttgcccaggctggagtgcagtgtctattcacaggcatggtcatagcacactacagcctcagactcctgcggctcaagtgatcttcctgcctcagcctcaaagtatctggaattatagactcctatctcttagtgctttcctcagtcccctttcctggctccttttatgataaactacctctgaacgttgagagtgcttatctctgactacacattcttcctagattaatgcatctacatatctggttttacttgctatccagatgcagacaattcccacatcaatgccttcaacacatttctgtctcctagtcttcatcccatatacacaactgtattccaaacatctctaagggatagcctacaggaattacaaatggaacagatcccccaaccaactctactatgattctaaagttgagccttctaaaatatgatttattttatgccaccaaacctactaagccacttatacatataaacacaacaaagtagacagtaggtaaagaatgtcatatggtctttgaaataagattttattaatgcagtctaagcctgcaattagattttgtgatagtcacatcatataactgacacataagctgaccacaaaagaaaagcttctattttaaaaataaacatatagccgtagctgtttttccaatcctgtaattgtatgggtaaaatttaggacatgctacatcactctgtttaatttggtcctcattccagtctgacataatttgggatccaaatgcagtaatccaactagctgttaaattaagatacactgagcaaacactactagagatacagaagtgaggcagagtattagttgtcccttcaatccattcttctctttatccatagtattgcagtttaatctaggtccctggccattatctagatgtgaccctgtctaagataaatataataggggccacatatgtaattttaaaatttatgattgccacattaagtaaataaaggtgaaattaacttcagttacatatctggtttagccaatacatccaaaatattatcatttcaaaatgttatcaatattaaaaatatttagatattatgcattctttttttcattctacgtttctgcaatcaatgtgtatgttaaactcagaacatatgttaatccagagcagccacatttcaagggctcagtaggctcacttgaatagttgagaggtagagagactgcatttatggtacagcagcttaaaccttaactcaatgtacacaagagttgaacaagcaaccacattccaggtcctaaatttgccttctctcctagctgcaaatttggtggctggtggatttccatatttccatatataagataatgtgtttgtgtgtgtgtgtcaaagcagaggttcagggagagagaaggcaatctctcttaaatctgtatttgcataaaaataacacttttgtttagattccatgttaccagtcaataaatataggatatctaaaaattattttattcatttttacataaaactaaagaaactgttattcatattaaaatatggtcatcactgttattattattatttcttaggttgagataagcattgtttatccttcaattagtcatttcatgttctccagtggcagacagcctgggtgaatttatagcaatgggatgttgccaagtttgtttcaattactcccttagcattgtgtcacaaaaaaagtatatatttttatgtatgtatcaaagtgcacatgagaaaggaaagagtcaaagtcaatggcaaataagaaaccaataaataaaatgtactgtgctttaaaactttgttgatccacttcccaggaagtcattagtgtctaataatggcaggtttctccccactgcccattcctgttgactgggggaagggagccttgtgagtggagaagagggtatgctacctacagaactgtgttcacagtgttggtatacttatgtgtcctaccaactgtggctaagcccatggcaggctccaagctgtggatcattttatctttctatttgtcaggtcacagtcatgaccactaatggcacccatcccaaaagtatatgattcttcaggaaatacagcttgagataccaatggaagtatctttttaagcaaaaataggaatataagattttaaaaattattttcttcaccttcttggttagtgactaataaattttttggaatcttttggctttcatgaactgttagcagtcccattatattggctctttcctccctaactcatatgtggtaaaattaaagaaggaaggaaaggaggctgaatgaccattggtcatgaaaacctcaatattccaaaactctctcaaagagcctctcttcctcaggatagtagtttgaaaacagaaaatttgggaaggccacttgggataatgtttggtgtctgttgctgcatcagcgtttacaaagtgagtatccaaacatgtactttttttgttgtttttttcgagacacagtcccattctgttgcccaggctggagtgcagtggggtgacctcggctcactgcaacctccgcctcctgggttcaaatgattctcctgcccagcctcctgagtagctgggactaaaaatgcacaccaccatgcctggctaatttgttgtatttttagtagagacagggtttcaccatgctagccaggatggtctcaatctcctgaccttgtgatctgcccaccttggcctcccaaagtgctgggattacaggcatgagccactatgcccggccccaaacatatacttctttaaaatgcacaaaaactcaatgagtgttattttccttattactattgttatacctaactaacaatgaggaaatctaaggtgtagagacattaaatgacttgctcagggtcaaaagctaataagcggcagattaccaagatttctcaattcaagtccagagtttccaccatgaatagcctcagaatattgcaaaaggctatgctttaggaatggtacttaatagtgttaaaggactgggtaaaataagataacctaccaagaaaaaaagttgtaacttcaattgacaacttacaatatgaaaaacctaaacattggttaaaaaaaggaaactgaaacttttttttattattattatactttaagttttagggtacaggtgcacaatgtgcaggttagttacatatgtatacatgtgccatgctggtgtgctgcacccattaactcgtcatttagcattaggtatatctcctaatgctatccctcccacctccccccaccccacaacagtccccagagtgtgatgttccccttcctgtgtccatgtgttctcattgttcaattcccatctatgaatgagaacatgcagtgtttagttttttgtccttgcgatagtttactgagaatgatgatttccaatttcatccatgtccctacaaaggacatgaactcatcattttttatggctgcatagtgttccattgtgtatatgtgccacattttcttaatccagtctatcattgttggacatttgggttggttccaagtctttgctattgtgaatagtgccacaataaacatacgtgtgcatgtgtctttatagtagcatgatttatagtcctttgggtatttacccagtaatgggatggctgggtcaaatggtatttctagttctagatccctgaggaatcgccacactgacttccacaatggttgaactagtttacagtcccaacaacagtgtaaaagtttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatgtccttcgcccaatttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagtagctctttagtttaattagatctcatttgtcaattttggcttttgttgccattgcttttggtgttttggacatgaagtccttgcccatgcctatgtcctgaatggtaatgcctaggttttcttctagggtttttatggttttaggtctaatgtttaatttttgtattaattgaattaatttttgcataaggtgtaaggaagggatccagtttcagctttctccatatggctaaccagttttcccagcaccgtttattaaatagggaatcctttcccccattgcttgtttttctcaggttcatcaaagatcagatagttgtagatatgtggcattatttctgagggctctgttctgttccattgatctatatctctgttttggtagcagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctgtaaattaccttgggcagtatggccattttcatgatattttcttcccatccatgaggatggaatgttcttccatttgtctgtatcctcttttatttcactgagcagtggtttgtagttctccttgaagaggtccttcacgtcccttgtaaattggattcctaagtattttattctctttgaagcaattgtgaatgggagttcactcatgatttggctctctattggtctgttattggtgtataagaatgcttgtgatttttgtactttgattttgtatcctgagactttgctgaagttgcttatcagcttaaggagattttgggctgagacaatggggttttctagatatataatcatgtcatctgcaaacagagacaatttgacttcttttcctaattgaataccctttatttccttctcatgcctaattgccctggccagaacttccaacactatgttgaaaaggagtggtgagagagggcatccctgtcttgtgccagttttcaaagggaattcttccagtttttgcccattcagtatgatattggctatgggtttgtcatagatagctcttattattttgagatacatcccatcaatacctaatttattgagaatttttagcatgaagggttgttgaattttgtcaaaggccttttctgcatctattgagataatcatgtggtttttgtttttggttctgtttatatgctggattacatttgttgatttgcgtatattgaaccagccttgcatcccagggatgaatcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattagaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttcggagggtgtatctgtcgaggaatttatccatttcttctagattttctagtttatttatgtagaggtgtttgtagtattctctgatggtagtttgtatttctgagggattggtggtgatatcccctttatcattttttattgcatctatttgattcttctttttttctttattagtcttgctagcagtctatcaattttgttgatcctttcaaaaaaccagctcctggattcattaattttttgaagggttttttgtgtctcttcagttctgctctgatttcagttatttcttgccttctgctagcttttgaatgtgtttgctcttgcttctctagttcttttaattgtgatgttagggtgtcaattttgggcttttagtgctttctcttgtgggcatttagtgctataaatttccctctacacactgctgtgaatgtgtcccagagattctggtatgttgtgtctttgttctcgttggtttcaaagaacatctttatttctgccttcatttcgttatgtacccagtagtcattaaggagcaggttgttcagtttccatgtagttgagaggttttgagtgagtttcttaatcctgagttctagtatgatcgcactgtggtctgagagatagtttgttataatttctgttcttttacatttgctgaggagagctttacttccaactatgcggtcaattttggaataggtgtggtgtgatgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtcactgcacatgagatgggtttcctgaatacagcacactgatgggtcttgactctttatccaatttgccagtctgtgtcttttaattggagcatttagtccagttacatttaaagttaatattgttatatgtgaatttgatcctgtcattatgatgttagctggttattttgctcattagttgatgtagtttcttcctagtctcgatggtctttatattttggcatgattttgcagcggctggtaccggttgtgcctttccatgtttactgcttccttcaggagctcttttagggcaggcctggtggtgacaaaatctctcagcatttgcttgtctgtgaagtattttatttctccttcacttatgaagcttagtttggctgaatatgaaattctgggttgaaaattcttttctttaagaatgttgaatattggcccccactctcttctggcttgtagagtttctgccgagagatcagctgttagtctgatgggcttccctttgagggtaacccgagctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggatgttctcctggataatatcctgcagagtgttttccaacttggttccattctccctgtcactttcaggtccaccaatcagacgcagatttggtcttttcacatagtcccatatttcgtggaggctttgttcatttctttttattattttttctctaaacttcccttctcgcttcatttcattcatttcatcttccatcactaataccctgtcttccagttgatctcatcggctcctgaggcgtctgcattcttcacatagttctcgagccttggctttcagctccatcagctcctttaagcacttctctgtattggttattctagttatgcattcgtcttaatttttttcaaagttttcaacttctttgcctttggtttgaatttcctcctgtagctcggagtagtttgatcgtctgaagccttcttctctcaactcgtcaaagtcattctccgtccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcctttctgtttgttagctttccttctaacagacaggaccctcagctgcaggtctattggagtttgctagaggtccactccagaccctgtttgcctgggtatcagcagcggtggctgcagaaccgcggattttcgtgatccacgaatgctgctgtctgatcgttcccctggaagttttgtctcagaggagtacccggccgtgtgaggtgtcagtctgcccctactggggggtgcctcccagttaggctgcttgggggtcaggggtcagggacccacttgagaaggcagtctgccctttctcagatctccagctgagtgctgggagaaccactgctctcaaagctgtcagacagggacatttaagtctgcagaggttacagctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgccaccttgcagtttgacctcagattgctgtgctagcaatgagagagactccgtgggcgtaggacactctgagccatgtgtgggatataatctcctggtatgccatttcctaagcccatcggaaaagtccagtatttgggtgggagtggcccagttttccaggtgccgtctgtcacccctttccttgaccaggaaagggaagtccctgactccttgtgcttcctgagtgaggcaatgccttgccctgcttcagctggtgcacagtgcgctgcacccactgtctggcactccctagtgagatgaacccggtacctcagatggaaatgcagaaatcacctgtcttctgcatggctcacactgggagctgtagaccggagctgttcctattcggccatcttggctcctctgaaactgaaactcttataggcaaataacatgtctataagtaaattagtttcttgaatgttacacatttgagctgttaagcttgttttctgtttcattttaagagtttaaatctctgaaagtttggtagaatatatcctctattttcattttcaagtgtgaaagccatatcaataaataagtgcagacttatataactgcaaaaatgtatcttcaagtatttattgtgtacctactatgtgccaaaagctcagtgtgcctcaagcttggggacagaatcatgactagaactcagatcattgtccaagagttagtacgcaacatagtgccatcttccaaaaaaaaaaaaaagaaaaagaaaagataaagaaagaaaagaaagaagtgccatagtggactagatcccttatctactcaggcctgtgatctagaatgacaatagtacatactggaagaaatgatggttttatgatatcaattttataaagctaggaatgtgcactcaaacatcgtcttacttgtcttaacaactcattgtaaatgccttttctttgaattcatttaagccacacttaaacctatctatatattctgtatctaaactcactctctattcagatgaagccaacaaaaaaacaccccaatatacataataaaacactataaagttgagttaaaatagcaacttttttctatactacaattaatatgtttgcctactttttaaaaattgtttaacctagacttacacattatgtcatcaaacatagtcatagtactaagaagagattcagtataaaactactgttacaaaaagggatgagagagtagctgcaggctttcattttgctaaaccacatgactatccttctcaacagaatgtagaaacctgcacttttggtacttttattttacataaaacattcttctattagtttatttttctaaagcattttgcagttattccctggctaatagtaataaccaagaattaaaagctacagcatatgttgaatagctgtattacaccataaatcacatttactgccatttgttaacatgctgttttaatttcagaaaattcaatgacagttcatgaattttgcggaatctcaaaaataatgacatgattttatgttgaagactaaagggatgttgtcaattttaatgtgtactgggaggtcacatggtattctcaaatttaatggtaaagcaaatttagttaaccctgcagaaacataaggagtcttgaacaatcagtctcttggctagccaagggcaaatgaggaatgaagacacttacaagtttaaatccaacacctgagggtgctttgaaaacttttctgcaccaaatgcagctggtggaaagagatactcaaagggtaaggaagaggcggtacaaagatagctgataaaaggcaacagtcacagcagtagaaaaatttagacaactatttgcgagaacttatcatctgagtaatcattctttgcaccccaggtctttattcccaccctcaagaataaagttaactccagctatgtccagatacaggtagttttgcctaggatactagttatcttagtttgttcagtctgctataccaaaatgccatagatcagatggcttaaataacagacatataattctcacagttctggaggctgggaagtccaaaatcagggtgccagtatggtcaggctctaacctgatctgctctttctagcttgcagatggctgccttcttgctttatcacatgagagacagagaggaagcccgtgtgtctctttctcgtcttataagcacactaatcccatcatggagccccaccttcatgacttcagctaaacctaaacctcccaaagaccttgcctgctaatcctatcacattgaggattatggcttcaacaaacaaatttgggatcagggaggacataaacattcagtacataacaatggtcatcaacctttagggtgcctaagaaccacttggggagatttagtaaaaatgcagattactaatccttcaacatttgtgattctgattcattccatctgggaggcggacagaaaacactttcaaaagcagtccaggaaattctgatgtaagggtccactggccacattgtgagaaattctgtcctggcttagcttcaagcagaagggattgcttgcaaagtgcctgtgctgtgcctcaaagactgaaagaagtgtattcagagatcagactgtcctacggatggtaaaagccagaaccaggaggtgccaacagaggtgctcccacataaatgtcaaccaaatggtgctaggtaatatagatgtactcagtgtccaattcccatcctctcccccattgccatggcctttagaaaactatctttgacagagaggcaaaaggaaaacacctggctagaatcctcatatccaatctaaaaataagattttaagatagattttaaggggaaacaatacatgggaattcaattgtgcatatcctaatggagtcactctggccaatgagagctcaccctgagaaagagggcctctcccttacaatatgataacaaggaaaagtcttttgaaataaacaataatagtaataataacaataacaatcctatgaggattatattgaagtccatgtagtgtttttccatttatcagttccttttgtcttctgtgataaacatgaaggaaaatgtatggttgtaaatggtttcaactaacaaaacaataacattcagaaaaaagtcatcaggagaactgatttttcagttgtcctaaagataatgcagtgtagtcagattaaaaaccctgaattgacaaggctttaatagatttaacttctggggcttactttttaaatactgaaatcacaaacttcaacagcttcaaagtgttttgcaacaaacatataatgattattttaaaaacgattattgtttataagcttaaaaaggaagcagcaaaagaaacagcattataggctgggttggggctcacactgtaatcccagcacgttgggaggccaagctgagaggattgcttgagcttaggagtttgagacccggtctctgaaaaataactaaaaaattagccaggtgtggtggtgtgtgcctgtattcccagctatttgggaggctgaggtgggaggattgcttgagcccaggaggttgaggcttcagtgagccatgcttgcaccactgcactccagcctgggtgacagagtaaaactctatctcaaaaaaaaaataaaaaaaaaaagaaaagaaaagaaaaataaaacagaattataacactgagaattaaaattacttttaccatgtagcgtatttccctacaaaaattcaagttgtcctttaaatacaaatacatgaaactactgatgtttcaagtaaaataaaaatgaatgtcttcatagcactgtttgttattaagctatttccatactggatttatgcaagctatgttttactaaaagaataagcaagtagaaaataatgcataattcctacaggccactcttctttaaagatgaggaccttcttgataccaactgaaattgcctgtgtcaatgattccggtgaaatatgcctcagtaaagatgggactcaggaaatataataaaaatctgtcagccaagttccaagtgcctaggaactggtcatcactggcacattgtagagcagtttgataagcattaaaaaaaagtttgtagtgataaatgattaactattgttgaaattaaattgaatactttcatctttaaaatccatttaatttctttaaagccataaggtttttcaaaggttaagatttattatggattttggtttcaggtgattggtaagtaccagcctcagaatgccatttggcacacaaattgattccctcaggaaaactaaaattatgtggataatcccatctctatgtcctgtctctcaaaaactttagaaaattaattcaaaggacagaagtgtaggttgttttcaagcaaacaacttcaaagtgagtacatttttctcctttaaaatacacacagaaactctaaaagggtcaggccatcttcaagggcagaatacttgttcaacatctagatataggctgctaaggctgatgaatgagaatggaagtaagagaaaaagctgacaatcagtcaagggtatcatcccatatttttaaaaaattccttctttggtcagttcattccattttgatcaaaagcatcatgcaaccacttgtttaacataaggaaaaaaaatctcaaaatataagatgaatttcacattactgaagctcacagagaatgaaatacagtttttctagaaccttatattaatttcttggccaaaattaagtcctctcgaaggttaaaaaaaattgcaagactcatcagttatggcagccaacagatcaaatactcatttactcattgtatataagaaaatggtgtatttaaacattcaacaaataaataaagaaaacaaaaatttcctgggagcaccaccagaagaatgatgatgtatgttggtgatagccactgaacttgcagctgaatacctggttcaaggtggatcatgccattctcctaccttctgtgtcacttaaaagaaattcaaattccataacatagcccacaatattctgctgagctgccccctgcctctcttttcagtctcatcacctattctctcctcctcattcacactggcctcccttcaatctctccagttcagcaagcttcatcctacttatctagcactctctggctcctcccctgcctcgtactcacctgctgtctcctgctcatctttcaggtctcagactgcatgtcactccttaaattcagtcattgcctgccccacattctgaatcaggtgctctattttctttcagagtatgctctattcttcctttgaaacatttatcaacacagatgattatacatttgtgtaattattcatctaattactctttccctcattagaccataagatttctgaagtcttatacatggtaactagcacgtagtacaaactaaacaaataatattaaattaatgaaatcccagttctgacaattatattatcttaggtaagtcatccaatttctctgagctttattttcttatctataaatatgggcattaatctaataattttatatattttaacataataggaatatattcacttttgcaaattggaaagcaccactcagatttaagacattatttttttttcttacatcaagattatgaaccaaagaacttttaaattgatcattatagtcttcatttagtcggcataggcatatccagaaaggcctcacatttagtactaataaagcttggtgtttaaggaatattatagacaatgaataacaatgattccttgtaatttacaactgaagttgatgccacatcaggtatatcaaaatcttcgttaagactatttcctttaataaagtttatgctaccatgttacataaaaaggaatcaactggtattatttagttgttctgtttatatggactattttagcaatttagaaaagatgtagggtacatgccactttatatgcaaatatgccttgacaactgtatgaataaacaagaaaactgtaaatatactttaaaagccaagatgatacaaatggccattcatgagtggacttactgtctaagttatttttccaagagtggaaattcattcatgttgatacacgcaattctcacttcattccctcttccaatgacaaggtgaggagatctatgtctagagcactttttatctaagtgaaaggagccaacaagtgccagatgaacatgactgtggtctcatcttttttcaccttaacccactggcctaacgggcctggacagcagaagatttgtgatgctaaaagaatttacttctgcctggatattttagggatttgactcctgtcaggtattgcaacaaagtcaagtgattcaatttaccaggcaaggacaagaaatggtttcaggaaaaaccaaggtgatgaactattgagcatccagttcattagctgtcatccatcttgacatcttcatctttcaagcagtactgcagaaaatcaaagacgtgtagtgcttcccttaaaaaatctgagaaggaaaacatatcctcttaaagttaaagagactgtgaagcctatttcaaatggattatgaaagataaccattgcctcaagtctgaaaatcttgatagatactccattgtaaatactacctgtgcccttaaacacactaatcttaaaaataatatcattaaaatatgtactgcatgaactgctagagtatttttagcttattctaatttgatgcattgtgcattttaatatgcagtaatagttacatgacaaataactgaccttttagaaatagcatcttgggggaaaaaaaagactcaagaaaaaaagtgtttccctgaaacatcagccaataaaacatgggcagtaagactccagtgacatagccaagtactggtaatatcaccttccttcttttgtttctctgctctgcttattcaacactgaggtactgaaactctggggtttttgcacttatatgcagagtttcctggaattaaagagtaatgtaagcaaccaaagacattaaagaagtgattcataaccttccccacctactattctttatcaaggggaaagtgttttatttcaagttcttgaaggcccctagaggtaaaggtgaggtgaaaattatgcttttcttctatatcccacatactactttattaatgctaagaagcactgtaatgttgccttttaattctctgctttctgaaacactcagtgaatattattccagatctgtagttactaacaaacaaaataaaattaaagactcatacattgttctctcctgaatttgccatttaaaacatctaagtcaggctgtgaaagaaaatgttaactcacggctcacatcatataagcaactagaccacaaaacctaaaagattaccatggactctcagaagcctttgtagtcttaaattattggaggacaactaaggaactattcaggtgtacgctttgcccatcggggaaagccctaggtgcaggtgactgaatggctgcttctgaagaacggcatttggtatctgagtaagttcctatacctacaaattacttgcaagcccttcagcctgaaatttcccaatatattattaaaactcttattatctccacactacttgctgctaccaccactaccaccatacactgcatgatttttggccgggaactataccaggcactttacataaggcacacatgtaacacccgcatcaactgtagaaagtaggggcattattatattcagttgatagaaaacagaggcaggtaagatgttctaggcttctgctaagcaaaacatggtccatggaatagcagctacaacatcacctgagagcttgtctgaaatgcagaatctcaggctcaagtccctgatctaatgaattaggatctggattttaataagatatccaagtgatttatatgcacatgaatattgagaagcagtgctttgggtaaatggaatcactcagactcaaactcaggggtctctagctcaaagatccagatattaaaatagtcagctcttcctgaagatgcaagacatctaaagaatgtaaaacattgaatacattcacatttaggaccaagtttttcatcagctgagaaaatctgatactgagaattacaaatttgagacgagaaaacgatgacctgggaataacagaggaaggagatacctggtaagggaatagaagagagccactgggaaaagaaattgggcttaaaacacactttgtgcattttggtttgtccatttcagtttggttaagggagttcttagccaaactgaacagagttttgactctgttcccaaaactctcggctcacctgaagtggtgcttgatatcagacaaccttactggggagctcaagagtgcttaattgaattattcacaagatcactttctcatgaaccaaccactccatatccagacatccctttgctgaatgtacatacttattcttcaagttcttacatcaatcagcccaatatggagctttctagagatactaactgcttaactaagtctgataaatgaaaacatctgtatgggtgaaatttttttaatgcaattttagttgttttttcaccaccatatataataaatcaaactatattaatccatcaggtatccatctgggatcagttttgatggtattcaagcctgataggtaattaaaatgttatttccatgcaaattgcatctgatcttgaaaacagtttcccttaacctgaaattggctaaacatttctctgcagtcttaaattatccaaatttccaagcaaatatttttgtttccataatagaaagggaaactgcaggtcattcatgaatcaagttatcataattaattaggtttagctctattacctttttatttaaaagctaactggatactactatttatccttccttttgtattacagtatttcataactgactttcatagtatccactctaaaatttgttaacactttgatgatacagtattttcatcttttattggaaaagaatttattgctactttcaagcatagtttttttctcattcattatattgttatcataaccacgtggcttataaagatatgcagacactaatgttatatcaatacttatgtctttggacttttcatttaaaagttaattgttgactatgtatttttttattgtgcaaactttcccaaattccacaccatagcatgacttgctaatgaatatatttacaccaagaaaataaaatgaactttgtataagtttctaatataaataaaagggaatacttactttcgaaagaaagataatttcctatcaatttaataattttctttcattttaacggtagaaattatacaccaatttcatgtcacaaaagaggttagagcttgtttttataaacaatgtttgttagattactcttgcccctatcagaggaagatctgaaaatgtaacaaagaagatatatttcatttttgtgcaaatagacatgtatataaagattaaaggctctgacagagcctaaaaatgaagtcctttatttaatgtactagaataatgcatgcattggcagtatgccagctttaaaattgacatagaatgagccttaacttctcctgcatgattcactatcaggaccagaaagccattcagcaatgcttgtcatgtcttgctatataacaaaataacccccaaattttgtggcttataataacaacaaccatcttatcatctgctataaatgtgtgggtcaagaattcaggaagggcctgcctgagaaattatctgtgccatatggcattaacagaagtcacttggaggtattctgctggtggtttggctcctccagagagctcaagtcagctttacctacatttctgcagtcttggtggtaatggctagaagaatgggctcagcaggacaattgaccatagcacctatgctagcccctctgatatggtggcctcagagagtggggtatcttttcatagagtcttggatagaaggtataagtcttctgacttagcatcacaagtcccagaatgtcacttccactgcatttactgactaaatgtaacatagatcccaagacagaaaatgaacatgcattaggtaaaaataaaagaaatctgaatgaagtctggcctgtattttatttttatttattggattattatttttttttttttgagatggactctcgctctatcacccagactggagtgcagtggtgcaatctccgctcactgcaagctccgcctcccggattcaccccatcctcctgactcagcctcctgagtagctgagactacaggcgcccccaccaagcctggctatttttttttaaatatatttttagtggagatggggtttcaccgtgatagccaggatggtctcgatctcctgacctcgttatctgcccgcctcggcctcctaaaatgctgggattacaggcgtgagccaccgtgaccggccccagcctttattttcaaacaaatgttgttgagaggaataaatatgacagtgtggaataaaacagaagctcacacacctacattggcagaaaaagttagatatgatcaataaattgttaaaccatttaacgtttttgccagagaaagaacacaataatttgaagaaaaaatttaaatatggtttctctgcctacaataaaatggaatagagaagagaatactcactaaagagaacaaaggtcaaatagcaagagaaaaatacaaaggcacagccagctgtagatccaggaggacaacaggatggtcctgagcagaaggataccagaaagggatgtttaagaggcaataggatactgcaaaccagatgagtctttatagtttctttagctgaccctgaaagcaagtgatttctaagttacaaactgctgaagagaagaggaactcccacccaaaactatatagtaagaagaaaaagacttgctaaataccatttaacttctgaaacaggaaagaatcactacatatttgtgataggcagactaatgcctgccaccaaagatgttcatgtctttctcccttgaacgtgtgaatgtattatgttgcataggagaattaaggttggagatgggattaagatggctgatcagctggatttaaaataagaagattaccctggattatctcagaaggcccaatatgatcacaaagctcctttaatgaggaagagggaggcagaagagccagaccagagagcaggcataatcagaaagactccattggtcattgctggctttgaagatagaaggtgtccataagccaatgaatgcaagcagcttctagaagctgaaaaggacaagaaaacagattctccctagagccttcagaaaagaatgcagtcctgctgacaccttgattttcatccagagagacccatttcaaacctctaaactccggaactgtaagacaatacgcctgtgttcttttaagacactaaatttgtggtaattttttacagcagcaatagggaactaatacaattgtgaaaaatgaggggaattggaaggaaaaaaattaaagcatttaatttgcaaacaattgttcaaacatgataaaaatgataatgagacttacaaaatatcttacaaatgaaagaagataactttcctgaaagaagataactatccataacacataatgattgacataatcctgtgagggtcatgacaaatatgctctatgaagtgttgggatttcagcttcctgtttcatttcatgtcagttttggcagatctggacttcagtaactagcagtgtgcctagtacatggtagaagctcaataaggactaaatccattatataaactaaaggggactataaagtagaaaaaaaaactcattatcacatatggcttgtgagattaggcacatagcaaaggaaggaagagagaagagagctaaaattatttggaataaaaaaagaaatccaattgagatccaagtgaaatgcaaatacatttctagtgagacatttttaaccattgacgaagcttcttagtttcagttgggtcttcatagcatcctgcaaaaatgcatggcaaagatacagctgaacacccaccagctgaagctgggctgtgattgttctggcaaacacataacccagagtaaatattgtcttgcacgaagaagtgaggaggtggattaggcattgtaattaccatttgctgggtatttggcattctttttaaagatttaatcatttagatgagacttagtatcactaaaaaaggagtcaatatttctgtgagccagggaggaacagcgctgctgttttccttctgctcagctgttacatgtgcctacagaaagacaacttcacctgctacttttttattcaagacagcacagataaagaatcatgagcagtaacttctttcagttcttttttcttcctgaacacactgtgttctcatctattattgatcagaaagtgatatttaaatagggtggcaatttataaaattgcacagggatgttattacattatcttaattaattttacaaccagcactcactcactgtcctttatagtacatctaaagaattaatgtgctgattaacaatagccaagcagactcagatagtagctttcagataagaacttctgttaatcttctgcttgtcaattggaatctactgacataaattgctttaatctgagttcctggcattaagcatttatagaacaacattttgagacactgattattgtaccattcctttggggcagtgcccctaaattttagtgtacaaaagagcatctggaatttgttaaaatccaaattatttagccctttcagagagatcctaattctttaggtctaatgtgggtccaagaatctgtatttttaacaagcattctgaaagtgtctgagccatggggtgaggggtatgtaaccaaacttgttttgcaatcgtatataaatatggacaatatttttgctgaaacttttcttcttttctttaaatgtccaagtccttatgtacatgatctcttttagtcctcacaatgatcttgtgaagtaggtattattatttctattgtaacaaagagacaaagggtttagtcacttgctgtctgtttgctcaggctgccataataaaacactatagattgagtggctaaagaacagcagtgtattctctaacagttttggaggcttgaagtccaacatcaggatgccaccatggtcaggttctggggagagctctctttctggtttgcaaatggctgccttcttgctgtgtgctcacatggcatttcctctgcacatgcatggagagatagagaaaatgatctctcttactcttcttcttataaagccaccaataccattggattaggacttcactcttatactgtcatttaaccttaataagctcctaaaagctctatctccaaatagtcacattggaggttagggctccaacatatgaacttatttgtgagagagggcggaatttagtccttagcccttgcctatcacaaatagtaagtgggatccaggatttgcaccctaattgccctgactccaagcccacaccatctctaccttaccttgcccctcttgccctctgggccattagcaagaagtagtgatgggctactcagcaacagaggcatggaggttggttagatgaatattcagtcttccattaactgagaattgactttaatgtaatcagatcacttcattaaactttaagggctgccttatatctggtgactatgactattttattcctgcaactttattactagtgacatatttgtgctcatggagaaaaatagttcacgaaatcccttccagacaaggatattcagcagtttaagagagggtattggacaaggctcaggaggttacatatgcttctatgagcagctcttccatcttccctttcaatgctagatgccttagctcaacctaggccaacttagtcttatccttttttttatcccaaaggagtaaaaataaaggatacttatcagcatttttccatctcacaatctgcacagaaatgaatcattcattactaaacttcctttacacaccatagcctgataagaaaacaaataaagcttaaagaaaaatattaaaacacatttgtacaatctcataccaatagcaaggcaaagtcaagtcaaaaaagcatatatttaaagaaccacttcttgtgaatgtataaatatttgtatctttgttgggaacttatatattcaaaaataatatacacaacaaaaattatattacttacataagatcatggagagaaggaaattccattaaaacaaggaacaaatatctttttgtaaggatgagttcctgtcctagggtttgaagtctagatatcatgtcagggaaggtatgtgtgggagagagggtcagggtgaatcccttagagtgatgtagagaaggagatggggaaaaaatgtgcaggggagtggggctagatggagtttggggagggtagattatcatcactgactctattcttcctataaaaaatggaaataattaactcctatatttccagcaatataaaatatatataatagtataaaatatatctttcataaaaattccaaatattgtacacatatttggggctcagtaagatcagttaagttgcacaagtcatatagatactaaatgtggagccaggaaatgcagcaaattcagaagtggaatatgacattctagatttaagagtttgtcaaggaaactttggaaatctactgttaaaactcaaactaaaaattaaactccttcactcaaaaatgtgactacataagatgcaaaagcatttatcaataaaaccaaatgtaggagaagatgattccctctcatccactgcaaattcctacctgaggtgacaaaatcatttcctccacaaaataatcacacagtgtgaacttaagtgtaatggtatcttacctttagaacgttgtctaagcaacattataggagggaaactttggttactgaaagatatagcccaaagggctatgctattctaagaaaagaacaaaattttctgtaatgagttttctggtaagcacagaactttgtaaccctggagttgaataatatgtcccatttgtacatagctgatattcaaaaaattcaataagagattcagctttgtggacattaataccatgacatttgacttcccaactatttattaacaaaaaatataaaaatccacaaatatgttataaagcaaaaaaaaagaaggaagagagaaggaagaaagaaggttaaaataaaagagagtagaaacaaaagactatagcagtttagttctaaaggagagggagagctttatcaattattgagttcactctctcatgttacccagtgtggaccacggccagaacacacatcaaaaacacaattcctaccctggtatttttcctattgcaccacagtataaaatgcaagaaaccatattctccatttattaaatataatcataagaaaggcatgacttatgcctatttttaaaattatctctacacaattagtttgcagcattctttatattttaaaatgagtttactttggatgtgctgttaaggtaaataatataaaattgatagtatctttcacagttcagttgacattcacagaagctatccttactttgtctaatatatcccaagcctcattttctatgcaacacaagtaagagactagaatgaggtaaaaggcaactgttaatcaatttgttcttatagaacaacactagctttttccagtttttgtatgtgtgtgccaaagacttattcttatcaccttgagtacataatgaacctcctaggattaggcaggtggatgatatacaaagataaaaagtgagaagtgacaagtgttctagatatctaatgctgtgtaacaaaatgccccaaactgaatgagcaacagcaaaatttattttgcgtatgaccctgcaatctgggtaggatgtaaagtagatagatcatccctgttccactcagcatccactgatgccccttgaggtgtaggggctggtgtcatctgaagtaccaaacaaatagtattagagttggggatccctagacatctcttgtctccaggtggtctctccacatgatttctcctacatggtagcttcagaatagctgagctttttgcattttggctcagggatcccaagacatgagcccaagagagagaatcaggtgaaagccatactgcttttatgacctaactcagaagttaggcaactttgcatctgttttgatcacaagccttcccagattcaaggggagagaatatggacctcatctccacgtagacaagtatcaactgtatgttgcatgaggagaaaatgtgggatagatatattggtggatccactttgggaactaaaatctgcaccaatgtccttccagcaagacttaaagtgacatcatgaaacctgagatcaagagggatttctcctgaagcaaagcataaaatggagaggagattacaaatggagagaccagttaggaggttattgcaattgtcaaggtagaaattatcatggtgagaactagtgtgatgataggaacagaaaggagacttccaagagcacttgttctgacccttttctcaatggaaaatgagagagaggagaaaataaaatagaaatgtaataaagacgggaagaggaacagatctgagcagacaggattaatttggcttagaaaattttcagttgttcttgtggaatgttgaggcagaagtgtccagtggtcattggaaaatgagagtctagagctgtactgttcattaagaccacatacgactattgtgttattgaactgtggctggtttgaattgagaagtgctctaagaaaaagtacacactgaattttgaacacttagcaccaaaaaatgtaaaatatgtcaatattgtttatcttatttcttgaaataatatttcagatagttgggttaaataaaatatattaaaattagttttaccttgtgtctttttacttttattaatgtggctgctagaaaatttaaaatgacaggctgggcatgatggctcacacctgtaatcccagcacttttggaggccaagggggcagatcacttgtggccagaaattcgagaccagcctgggcaacatggcgaaactcaatctctacaaaaaaatacaaaattatctgggcatggtggtgcatgcctgtagtcccagctatatgggaagctgaggtaggaggatcacttgagcccaggaggtcgaggctgccatgaatcaagattgcaccactgtactccagcctgggcaacagaacaaaactctgtgtattagtctgttttcacactgctgataaagacatacccaagactgggcaatttacaaaagaaagaggtttaatggacttacagttacatatggctgggaaagcctcacaatcatggtggaaggcaaggaggagtaagtcacatcttacatagatggaagcaggcacagagagagaacttgtgcagggaaactcccccttataaaaccatcagatctcatgagacttcttcattattatgagatcagcataggaacaacctgcccctatgattcagttacctcccaccaggtcactcccacaacacatgggaattcaagatgagatttggatggggacacagccaaaccatatcaccctgtctcaaaagaaaaaaacagaaagaaagaaaagaaaatttaaaatgataaatacttgtcccattataattttactggactgttggtctagttttgatgagaaagcatatagggaatactttaccctagctctacactatacctgaaagcatgggattgaatgatgtctcaaaggagggaattttaaaagggaaaaaagaggaactgagaagataatcttaggaattctcacaattaaagagtagagaaggtaataagcagaggagttcatagcttcatctcctacatttcctattatatgtttatgtaaatatttactgaaagaataagtacatggaaaatgaattaatgtttgcttaatttaagaaagttcttcatgctgctcagcaaacattctttatttccctaaacccccatctactttcgttctcctaaacaactatttccttccgtctcttcaaaccttgaacctcaaatatttcctctcctatcctcactgtcagctgatgatcttgcatccccattctttaagaaccagaagcaattacaagggaaggaacctcttccctaagctttgctcccacccacctcatctggtctgcataccttcatacccatctcctctccctttaccatgctccaacttagccaacccttccacttgtacaataggtcccagctccattcgaaaaagaacacggccccaacagtactttctctcctgcaccataatgtcccctctctactggattgtttgtccaatcagtatagaaaagtgctgtttctcccatcttaatgcagccctcttttgatactacttcaccctccagttattgctttttctcttcttccctttgcatcaagatattttaaaagagttgtctatgcatgccgcctccagtttctcttccttatcctctcctgaatctacatcaatcataatttccaccatccagctgtccttgtcaaggtcactaataaagttgccaaaccggctctcagtccttgtcttatttgaccgctctaaagcaattgatgcagttggtcattttcatctacacttggcttccagaacagcatacattcctggtttaccttctatgcccctggctgttcttttcaatatccttaattgaccccttgtcatctccctgtcctttatgtgttggagtgcttcagggcccagtccttagagctcttatattgtttatgtattttctaagtcaatcccttccatccaaacacacctggaacacacctgtagttgagaaagttgggtttattactcactacaacagggagaacacatactcatacataggtaaccatgatagttttagtaagatgaggttagaaaggattattacaaggtttaggatttggttggatgattttggagagagtccaaggaagggaagtttcactgtggactgagtgctgtctgaaacttctatgattatctcaataaatcttatctatagagaagggcagactagagcaaagctacaactgtaactagcaaagaagcaacagttaataatcgaaataggaagatagttgatcttctttaaaaaatattcatgttttgtctgtgtctattttttcttgatccattgtggtcagagtggccttgcccaatgttggtgttcaatgcaattgtttatgggcaacaggggaacaccagggcttaggtaacagtgcgaggcaggctcctgaatgtcaggggttgcttttgtctaatctcatctaatcccatgactttaaattccatcaatatactgaatattctcaaatttatatccctagttcttatagccatgaatggccatgacagccaaaaagtcttcacctacaaggcttttcatactgaacatatctgaatctagtgtcctgatggtcccctcccaatctgcttattggggtacacttccccatctttgtttagataactccatcctttccagttattcagaccccaaacctttcttgactcgtatatactttatctatcatacatctgatatttggcaaatcctgatggctgcacttacgaaatgtacccagaatttgagaacttgtcacctctccagggctatccctctgttccaagtcaccatcatgcccctcctggactactggaataactcctaactgcccccaccctgattctaccttttctccacttaagtcgattctcaactcagcagccagaataatcctgttagaaaataagtcagatcatgccacccatctgtggaaaaccctcgaataagttcccatctcaaagtaagagagccaagagcctttctatgatgtgcttggtctggatcttctatctgacctcatctcctgttatccccatcctaacccacactgttttagctacacctccttgttgtcctttgaacacctagaaaatcatctatttgcaatggtcttctctgcccagatgactgttcagggcctttgcaatggtcttctctgcccagaaaatttcttccccagctatctccatgtattccttcctccattcccccagggttttactccaatgtcatctcagggtgttcctccccagcctttctgtctaaaatggtaacctcccacgcctgacatttcccctccagattaccctgctttatttttccccttagcacttacattactctctagctaatatactatatatttaccattttagtgaattgtttctctcctaacccccatagggacaggacttttggttttttcacagctgtataaagagtactcagtacgtatttgttgctcgagtgctgtattgccatgccagagagagtagatactgagactgaggaggatggctgcctggcagagcagtctggcccacatctccactggctggaggggttggtgttaaatatgcataggtgtgatgctgtttctggttccgatctcattcgtggatggagatgtctacctgtcgtgtatgctcaagccaatggcactgtatccatctgagtcatccctccctgcccagagagtgccccgctccagccattctatgtgcctgtttctgtgtatcccagatcctaggcagccaggcccagcatgagccataacattgtgctttgagctagacagcagcgcctgacatgttgtttttcctttcttagatatcattagacaaaagcttagctagggagttggaggaatgtatcattacaaacaaacaaacacaaaaatcgaagacagtagcagttcctcagttagtagctggaagggccacaggttgtcaatagcaggatggtattcggtaatcattacccttctcttttatcctaattaaattatcctagtcctaacaaaaggaataaatgaaaagaaagagctgacagtaaataggtttatagaactgaactagaaagattagaaattgcttttgtgccaaattggaacatttaataaaccttcttagaaatcttaaaatgtattgagagtattttctttaagagaattttcaagtgttgtatttgcaaaatctagtgatgtgtgacttattcctcacaaaatccagcctgtgtaattaatctttgatcaaaatatgtgtgtgttatatactttcatatatttatatttatttctgtatatttattttcatatatttgtatgcttaaatatatgtatttataaaaaatggataaaattttacctttttgagtatttttaagttttggattgtccttgatcataataatcataatagattaacatttttaatttagttttgttcaaatgacttagtgttgctccaagcagtttagaagtaaacagtaactttgctagcatccgcattattttcaaagttcagagaaaacaattttgtgatggatggaatgtttcataaatataggccacaagtccagggttttcaaagaaggatgtatcagatggaataataccagtagtacttgcttcctccgtttctttcagccattttatgttaacagtgatgttacttgactggccttagaggatgaaagaatcagaccactggagacagtgcatgctgaatttggcatctgcttttctctgcatcatcagttactagtgttttgtttgatctgtaacatgtaataacagatgatggaggtcgcaaggtgttttttttgtttgttttttttaagtctttgttctctttattttgctgtgttaaattttgcacttactttaagaggctccaggtcatagaaagaataggtgagcctctaatggacaagtcttgcagaggctgccttctagagacaggaagcctggtttctgacttaacctatgaagcagttaggactcttcctggacccagaaaaacatacaattgaaccaagtcgttttatgcatgacccattctacataagtaatctttgacacaggattatgtatacatatagacttaaattcgatatcattgcaccttgatgagcaacaagtagcttaagcaaaaaagggactttactataaggatacagtggcagtacctggaacctaaggcacctatgaatggtgctgggcctcaggaatgggcaggacccaggggccatatgcctggaggtgtgctcctgttctctcccactcctctcttcacttgctctccaacttctccgttatttgcttttcctctttcctctctctcctttgctttctcccagttataaaatctgcttttcactatgcagtaaaaaggaatggatccttattggctctggctgagtcaggtacccatgcttgcccatcagtggaagttgtggtcaactgggaaaacatagctggaaggaggctcacagctgtaaagactggtatgtgaacatcagggtaggagaactgggggtggggtgtggatgcttcccagaaagggaaccgggaaaaccatttaatgtgtctactgtaattctttctggttcagtgagccttttagtgggcagaaaatgagttgctcccaagttttaaaatctctcacagtgcctttgtccctgttccctaaacagccttttccatggttcccctccgccagtggaataaagccaaaactagcttaaatgtaacagggaaatccttcatttagattacatcaacctagctttttcttttgccactgcctctcttacaccatgaagtccagaaaaattgaactatcttccatctcctgaaatggctttatctttcccagctcttactttcacttggatggtttaatctagtggctatagttttagtatgcatcagaatcacctggaaggcttgttaaaactcacatcattggaagaatccacagaatttctgactcactaggtctggggtggaacgcaaaatcttacatttctcacaaattcccaggtgatgtagaagcagctggtgctgggatcatgccttgagaaatttaatttctcaggagtgctcttccacgcatctacatttatgcaaatgttaagattacttcattcttagctgctatgtcttattttgtcttccttagctgttaaaccaaaagtaatttctgtctttactgtgcttctgtagctagttggaattctcttaaaccattacctaccttgcattacaattaatttgtaagtgaatattccttaagggtaataataacttacctatttttgcattatccatagtgcatatcaaaaatattttctaggcatatcactggtgaacagcaacaattttgactttctctttactgttttggatgccctttatttctttctcttgtctgattgctctggctaggacttccagtactatgttgaatagaagtggtgaaagtgggcatccttgtcttgttccagctctcagggggaatgctttcagtttttccctgttcagtataatgttggctgtgggtttgtcatagatggcttttattaccttaagaatattttctatatatttttaattgaattacagatgtagaccataaccttaagaaatatgaatcctttcataggaaactggagagtatttcttatttttttcttactcataatagttgtaccttaattcttgacttacatggtccatgaactacagtttgtgaagaggtgagtggataccacttttggatcatctacattgtgctagctaacttgcatattttattttaaattctgtcagcaaccctgaagatacatactgttaatctcattctacagatgataaaactaagtctcagaacagctaggaaacttgtccaaagtcacggtaggaagtcacagaaccagaatttgtaaagggcagcccttatgatttatctttttttttttttttttgagacagagtctcgttctatcccccagccaggctggagtgcaatagagtgatcttggctcatggtaacctctgcctctcaggttcaagcaattcgcctgtctcagcatcctcagtagctgggattacaggcatgtaccagcatgcctggctaatttttgtatttttagtagatattgggtttcaccgtgttggcaaggctggtctcaaactcctgacctgaagtgataaaccgccttggtctcccaaagtgctgggattacaggtgtgagccaccatgcccggccctcttatgattttttatatcccacacttccttcccatggagaaaatacttaacactgatcatgaagtgaactgccagcaatcaaagaggtgataaagtccctggaacacagcaggtgtccaggagaagatggcccaaccaggctgccaggaaaacactcctggcttcctgatgccatttgccatgtgaagctgtatgccagatgctggattgtgagaatggagagtctttccttaaaggagaaaagtggcttcaatgattaagaagcatgaactttcatcagctttttgtacttcttctcatatattactaaaaatctacgttttttttccaaaagtaaattctgtcttttttttttattcctgaactcaaataattaataaaagaacaggcttatatgcaaaatgttacaactacagaccttactggttcaagtaattacttgaagaaatatcatatcttaaaatatttccatccagtgcatcctttttattagcactctataaatttgctgtcactgtgatatctgcagggaatgcttataaattaaaaaatcaaataacaaaactaacatcgccacattttttttttaacaatctgttctgaaggatctgagtagatgcagttgaaatatggacatacagtttgagtgattagaatttataggggaaacagtaccatttctacatgactttcatttgcatttgtttgttattctcctaattttgtctgcagtagccttggggatgagttctgttacatcgtgatatcttcctttatataactaagtttagaagtcaatcagactactgaataaattcataatatctagtcccatgatgtagataaagcaggaaatattttagctaattcacttgggggagacttcttgatgcaaggaattggaaatgggagcaaatatacaacaatgctaagtcatcacctaaaccaagcaatgataaaactttgaagcccttaggtcagggaaaagttagtaagttacacattgctgtttaattcttgttatggggaatacccatcaaagtgacatattatccactggaagattcgtgcattctttccttctgccctgtaggtggcagacttcttggctaagacaattacctcttcttttgtggcatttggggaattagcatacctttcttccagtcctttgagaaagttctctgagactagattcttgatgcaaaggtcttaatgataaagaagttctttgtaattgcatggtacatttactctgtggcaaaagcaaaataaacattcttttccatgaataggaagatctttacgcaaaggatcttaaaaattgacataattactcactagagaaactatgcctattctagaagggacaagggagagattcaaataatagggaaaattctgtgtactaccacaactagacaggagggtatctttgcttttattaatgcctagaggagtctgtctaagctttataaaacctcttaaccaaatggtgttattgcctgtgattctgcaggcaggggtggcagctgcattttaagcaaccattttccactgagttacccaggtaaagaaaggaagttgaatatctgacctatgggtagaagacatgtctcaacccttaaccctcacaattgcagtgagccatcttctcttggcatcatcatttgctccctaaaactggatcacttccattcataaacaaatgtgttctaaaaaaagttcaccttaataaaaaaagaaaagaaatcctcccaagcttgactcaactcccacttgtgcctacaaaatcatttctatgctttctcttggagcaacacgtgtcaggtgagacgaactgcctacccaggtcttctttacttctctgtcttattcatcctgtggttaaaatagcctttgtatattgttgattctcaatcttcatctcaaggctgcacagttcctctgcactttagactcctatgttctattatattactggatgtttactaggtacctaaaacttgatacattgaaaatagagaacatctgtggtggcagatgcctgtagtcgcagccacttaggaggctgaggtgggaggatctcttgagcccagaagttcaaggctgcagtgagctacaatcctgccactacatttccagcctgggcaaacagtgagaacctgtctaaagaaggggaaggaaggataaaaggaaggaaggaagagaggaagggagggagaggaagaaacaattttccactctccacgcactaaaatctgagccttcctagtcttcctcatcaaagaaaataataaccccattcacccagttattcaagccaagaacttggtaattaaccacttcccttcaaccctacactgccaaagaagaggctggatctgagatatacatttggaagtgatagaacttgcaagatatcttggtggttttgatctagggggactccctatatctacattgacccctacagtcccttttccaaggatcactgggagtcatagtttaaacacttaaatcaggtcactccttctactcagaatttttaaatttactcctatttctcttacagaaaaacccaaattcccaaacttgacctataagcattggtatgatcagactcctgcctgcccctccaaccttactgcttacctgtctccctcacacaggatgctcaagccacactggcttctgttaaataaaaattatagaagtccattgttttgaactaagatcctgcacttggctccaacagataaagggctaaaagataaaaactcacaccaaagttctgtcaccaaacaaccaatttcccaaacaggccagtttcaatcttccattggcatgataatgaagttccctctgctttaagttatgtttccactgttctgtctccctactcccgccctgcaagaaaagcaacgctgaaatgaccctctacttcatgttccttgtttctgcttttttccagtcctgttaaaactaaccccctctgatcaactcattggaacacttacattttatggattctagattcacaaataaagccaattgaggtctttaaatttgttgtaattttgtcttttgacactcctttctgttccttgaacaggacatactttttcccatttacctgaggcctctgccttgttattggttttccttgctcttttcttggcagtcccagtctaatgtgtccctccaccccccaccccacacacaccaccttcccagaccttcccagaccaccacatgataaaacagcctccctaaaggcagcagggttggtttccatcagggcacatatacctctccctacacatccccacacccctgtgcccacccccagtcccctgcccctgtaatttaaaatctccttgctggtttgtttgcttacttccctctctggttcaccacgacaggtcgagtacctggcacagcttgtggcacacagtaggtttttcattgaaatttattaaacgtgaatagataaaagttgggcttgcccctactaaatttgacaaagtgaagtcaactccatgtcagaagccctttatcaccccaccccagattcccagggaattaactcatcttgaggtatgatggaccaagatcagatctgttgcactttccccaagctatttgcaacttaatggagagggaaagagaaaggaacaagaagtttttgtgtatgtgcagttcacattttgaaagtgaagcaaatgcgcttatccaaatgtgaaaagtagcctggatgatcctcagtatcattctgttttataaaggatgtaccattcatgtttaagagccagtgcatgctaatatttcagaggagatgggtactttgagagtctgatgcaagtttagacagaaatctaaatgaaatgcatatacgtaaagataattacatacaatttgagtggggcatgggcctccagaaacctatccattatgcatcctgaagatcctaaacaaatcgtccttctattttactatgtgaacaagattccactttctttcatggtaaatcctgggtcattgattttgtttatagctcttcctaaagcaatttgaacttccccactgcccttatagcttgaagagaatatgttaactgggaagagtgaaaggaaggaatactaacatgtgttagacacgaaaatgtatccagcactctgcaatgcaagttctgaggaatttatttctcaaatttaattctcatatttatttatttattacagaattaagttatcacatttaactataaaaacaatccagtaagactgtgagtcccatttttgcagactgaaaaactgagggaacaaaaggacaaataacttacaaataagaagtttatgatggagcctagattcctatccagattataaattcattttctgaatcttatactacatattcatattttaaaagtggctgattcattctttcatttaactaatgatctggacacctcctcctcaactctctgacttcgtcttctgttgctcttccctttgctacttttatccaagccacattggcttccttcctattccttaatctaacatccttaaggaaaagtctgctatagaagctattaatagactattggtggtgagtctgtaaaatataattatttatatgaataagaatctataccttcttaagaaatgtattttggtaaaaattatttagaagatgattgcctctactaagatacttgcaatatagatatatttgtgaaattaaaacatattatccattctaaagaaacaattactaattaaaatggttacagaacaaatagttttacaataaaagcataaacaaaatctcattaaaaatgtgctaatattttacccagtttgtagatattaactccaattcttttaaacagcggcagatttatttatggaaactgcaagcataatgagttcaaatattctactacattctatataacacatttactggccaaaacatggcttttaaattgtgactattggaaaaatactgcacatttttatatattcatgtccttttgctttttaaaatatactttttatatattcatgttctgttgcttttctggaaataaaatcactctcttgacctgtgaatattagtatataactgagaaaacttataaataatgaagaatccatttcgtatggtgaacatattaaaattgttgtatggtttgtgactcccacaatcactgtaaatctttcatgggtgaattttcctctgtggccttcagccatgctcagacatgcatttcccattccataccagctagctattctcctgctgttagatcatgtaccaccaaaaattaattttcctacccagacattattataatactgaagttgctgtgaatccttccctatccatatttttattttccctcatatgtatctatttataaagagtgtattatactatgcttttatttgtttctatcaccactatgctctcaatatttggccaatgttagtacatgaagatatagtgcatttattttaactcttacataatatgtcatatataaatggtaatctacattgtttccaatttttcactattaaaatcaatgcagctattaacatccatggcacatacatgagaatttccctactattactagtatagaatgcaaattttcaacattactagatattgctaaactgccctctaaagtagtttgaccaatttattctcccaccactagtatttgataatttccaattccctataacttctcccatatttggtacggccagatattttcatttttttttcttacctgatgagacataaaattttatgcccttgatttttttttaaacttgtatgatcttgattactggtaagcttgaacattttcttatttattggccattttcttatgccttgttataaactccttgttcccattcttgagtttttattctactcaatcaattggttttcatttcttactaattcgttggagttataagcctggaacctaatctttttattttcatttgttttgttatataaaaagactcaagtatatataacacaattatcattttttgatctgtaactggccttttagctttttattttgatatactacagcttttaagtggttgtggtgtagttaaattgatctgtcttctcccttttggcttgtttttgttttgttttgtttgggttttgtttgtttgtttgtttttgtatgcttttaaagaactctcttgctattccaaggcagaatatatatgtatagattcccctatattttctacaaaatttaaactatttttgattcaatatctatgtgtttaaatttgtctgcattttagtttgttttaaatgtcagctacaaactcaatttatctttgtatttgtacaacttattacttcaatgtcaacaataatctatcctctcctcactgatttttaatgccatcccattaatttgatgttttatatggtcagtttctgagatctctattctgttttgtaataaaggtacaaaaataataactagatatcttataggcatgttatggctattattgctactttgatttttttgaatgtaatatttttctttgcttctgtattacaaaaatattcttaaatgattcttatatacaacaaaattattacttctaaaatctgtcagtaagtgctcttggattttctatgtacatactcatgcaaccattttgttctttattttccattccctacatacttttcttaactttattgcataggctaggacctagctacaataaatattaactgactgcatgcatccttgtggaagaaagcagcatttttactactaatttaatgctttaaattataatattagtatatttagatgttctcttcctatgttgatattgaaaatttatatttagaaaatcgttcagttagtctaagatttcaggttatttagcataacatgttcaaattcttctctcagaatttaaaaatcttcactagatctgaaatgatatctttttttatttctcatattgcctgtatgtgttaatgtgtgctttttaaattgatcgattttgccatgggcttgtctattttaacatccttttcaaaaatccatcctttgtattttgttagtaatttctccattctttctgtttgctattgtattactttgtgcttcttcttgtatgcttttccccttcccactttcattagaggttctctgctattcctcctctaactgcttgggttgaaccttcttttatttagttccaaatgatctatttcctgatatgtacattcatttttggaaacttcaattgaagtgatcgctgtatgccacaagtttttatatatactatgttcactgatttagttacaaatattgtttgatagctatttaacttgcttcattaactcatgaattatttagaagtccatttttaaatttccagctatatggggaagttggggctattttttatagttggtgccacattttattaaacttatttcatggaattttgtgcttcttcttttgcagtcatctagagtaataataccaactaacatttttcaagtatttaccatgtgttaggcactattctaaacagttaatatgttttaacttgttaaagctcacaaacgcacaaggtactatgatgatcagtaatttacgaatgaagcatctgagccatagcaagataaagtaacttaaccaagtaacacagctggcaagcggcagtgctaagacaagcttagtcaaacccatagtctgctcctataaccaccacaaaaaaacctacctctgaatttagtgtgctcgagaaaatggatatttgcgttttcagagcatgcagtcatacacgcatctgtcatatcagcttcagtgagttattgaagtcttctatattttttctaaatattttcatctaatttattaatttctgaggtaaggtgttaacatctcctatttggatagattcatcttattttgttaatgttttgctttgtacattcattttagttcataatgcatatttgatatctttattaatatttctctttatctttactaatggttaactataaattctattttgtctgatattaatttactataccactgttttttctttttgttctaatttacctggtatatcatttttcatttttaattattatatatataaacatatacaaatatatacttggttaacttactttatcttgctatgtgtggctttttttttttttttttgtagagacaaagtcttgttatgttttccaggctgttcttgaacacctggcctcaagcaatcctcctgcctcagcctcccaaagtgttgggattacaggtatgatccactatgcccaggacatcagtacctttaaagattaccttcccatttcattcctatccatttcacagtttcactgtgatgtttctaagtgggcctggttgttccttcagtctgggaattcacttctctactacatacagttacctacttggctattgcctctccttcattatttctatactcttattctggaattcctgctttagattttttttattctatcctcgacagctctatttccatatttctaggtctacgtattccatcatgggtgatttctttataattaacttcaaactcactaattacttaattagctgtctggtccattgtttgtccaatctattgataattttatttctagaaatttcattttagttcttcataactgcctacgaacctttaagtctatacttatatacatatatacctatgtatacatacctatatatatatgcctatatagctttaagtctataccttttaagatatcaaatttattttttaatgtctcagattattctatatttctagacttgattatttgctgattctacttcagactgattcattttctgatattgcaattttttttactatgagctgttgtgtttttattttgttttggcagttgttttgcatgaaaccatccctacaagaaatcatttctatagtacaatcagtggtctcttctgctgggaccccatatatggtagcagttacaggccaagttttgcattattttctctgtttgggattcctacacactattgtgagcatagtgtaaattcagagcctactctggtacagggcacagatgtggtcttgccaacccatagccctggacaaataaccagttttctttcagcttcctaaggctgtggagactttttagtactgtgtttgtgagctaagcagaatcctagctctgagatttgttcaaggagcttggctccaattccaaacccagcttcagcatccagtattgatttcccatgtcaacttttgatacttcctgagctctcttcactgagtttcttctttgtttataaaacttggtgatttatcttagttttagcctttcttggtattggaatttttaatatcatgctttttccagtgtttacataattttggcatggaacaaagaacctttgatgtcacatcagttcttcatatcacttttggtgtttccaaagatcatccttaggctttattcttctaatcaagaaagaacttttattttggtaacagctttatagagatatacttcacatgtcacacaattcacgcatttaaaatgaacaattcaatggcttttaatatatacatagcacagctcatctatcaacataaccaattttagaacgtttttattacccaaaaagaagccctattccccttacataccactcttcaatcatcctgttcccgtcccttcaccatccaaccctaggcgatcactaatttacttttcctctttatagatgcacccattctggatattccatataaatggactcataacaggtggtcctttgtgacttgtttgctttcacttagcatcatgctttcaaggtttatcaatggtgtaacatctatgagtaatttatttttattgccaaataatattccattgtatgggtatgccacattttatttgcctgttcattaattgatggatattcgacttgtttccactttttggctaatataaatgatgctgtcatgaatattcatatacaaatttttgtgtgtatgtgtggtttcaattctcttaggtacacagctaagagtagaaccggtggaatatatggtaactttacttaactgtttgagaaattgccagactgtttttcaaagtggctatagcatcttccattcctgccagcaacgtaggacatttccaatttttccacatccttgccaaaactcgttatctgtcttttttataacagccatcctggtgggtgtgaagtggtatctaattatggttttgattttcagttccctggtgactaatggtgttgagcatcttttcaggtccttattggccatttctatacttttctttggagaaatgtctgttcaaatcctttatccatttttaattgggttgtcttttattgagttgtaatagttctttatattttagctacaactgccttatcagatatgtaatttgcaaatatcttctcttattctgtgagttgttctttcactttcttggtggtttcctttgaagtatgaaagtttttaatttcaatgtcccatttatctattttttccttttatttcttatgctttttggtggcatgtctaagaaaccattgcttaatccaacatcacaaagatttatactttttttcctaagagctttatggctccagatcttacattcaagtcttgaatatactttgactcaatttttttttttttttttttttttttttttgagacggagtcttgctctgtcacccaggttggagtgctgtggtgcaatctcggctcacagcaacctccgcctccccgattcaagcaattctcctgcctcagcctcctgagtagctgggattacaggtgcatgccaccatgcctggctaatttttgtatttttagtagagatggggtttcaccatgttggtcaggctggtctcaaactactgacctcatgatccacccacctcggcctcccaaagtgctgggattacaggtgtgagctaccgcgccctgccttgactcaatttttatatggtttgaacacagtggtaatttttaaagtggttatcacctgtaacagtcttctctaaactaaagatctgacaagaaaatgacatgatttggggcgtattatgcataattggtatcacagcaatattaggggatatgagacatcagccttcctgatacttcgatctctttaaaaagcatggaattataaaatcttagttcaaagtcattggtctcttacatatttccaggtgtgtgttttcctatggttaacagaactaaaaggagacattattgtggcaattttgatataaggaggtagtgctgtcccactaagaactaaacaggtcagcgagttctcaccaatctgagtcactagtatgaagggctctgaggaaataaaaaactcatttacataggctaatttcttacactgccccgatgcagccttgttccaaacattcgctgttgtgatttacaagaaaagaaaaaaagtagtaaattgggcactttcttacccaaaccactgtaggtttatttgacatttagttgtattgactggagacttttataaatttctggaaattgatgtcaatattttcaagtaatgaatcaccagcaaagaagaaaaagcagaggtgctttataacatggtaaatcccagtaagtaattcttgtctgcatttctttctatattgcagtatcaaaaaaatgagacattaaaggaggaagagagaaaacgatcctatcaaaacggtcagttggaacaaaaaataacaataatgccaacagagaaatgagaggagtgaaaaaagcagaggaaagccagagaagaacagaaatgagaggacagaggtgaaaggaggagacaagacaagaaacccaggaaaagatgttgtcatctacctgctttaaaaagtgtgcagtgtttgaaccagggccaaggtcttaagtgggattcaagcaaagtaataaatccataatgaatctaaaagtatttataaagtacctcaatattagtaacagcttacagcagaaaaaaatatatgatcaggacctaaggatactttctatcataaaatgttaatcagagaaaaaatgaagtgtgaaaataaaggtgtgaactctagcagagagcatggtaagacatagagcttggctggtaccctctgggcccccagctctcaggctggtgggtgagctgagtgctctcaggcacagggccaggcttagaccctgatggcagcaatccccatcctgcctgtgacctctccaagccagacccactgggccacagctgggcccccaccatgcccagagtaaacaacactactgtgtgaagggcatggaaggctgggaagaacacggcaaccccaacccaacaggggcatcaggagttgaaagagtgggccagtgtggactcgagctctagctgctcagcctcaggctaaggagctgtgcagatcacagatctgaggtgaccactgtgtccctagtgaacaagatgccactctgtactgtcccttaaggggcctagaaaatgagctgagactacaaaagttggttaatcaacaccagaccttgatgttggaagagagaaatggtagaacactgtgccacacttggccaacaggatgtgtctgccatcctttgggaagattaagtagacattaatagaagaccagtgtatatacacataactcagagatagtgcacgttttgttctagactaccacaataaagtgagacacatgaaatttttggtttcccagtatgcatacaagttacgtttacactgtattatattagtctgtgatagcattatatcagaaaaacaatgtgcatacctgaatttaaaaatactttattgctaaaaatgctttcagcatgagcttcagcaagtcactttctgctggtggaggttcttgcctccatgttgatggaagctgaatcatctgggtggtagttgctgaaggttggggtggctatggcaatttattaaaataagacaacaaagtttgctgcattgattgactcttcctttcacataagatttctctgtagtatgcaatgctatttgatagcattttacctacagaaaaacttttcaaaattggaattcaatcctctcaaatcttgccactgctttatcaactaagtttgtaggaaattataagtctttgttgacatctcaacaatgttcatagcatcttcatgggaaatagattccatgtcaataaaccattttctttgctcatccataagaagcagctcctcatctgttcaagtttgataattatattgcaacaatccagtcacatcttcagactccacttctaattctagttctcttgctatttctaccacatctgcagttacttcttcccctgaaatcttgaacccctcaaagacatttataagagatgaaatcaatttcttttaagactattttgccctcctcccatgatatattgacttatttccatgaatcatgattgttcttaatggcatctagaattatgaattttttctagaatgttttcaatgtacttttcccagatccatcagagaagtcactatgtatgggagctatagccttatgaaatatacttttgtaataatcagatttgaaagtcaaaatcactccttgatccatgggttgcagaatggatactgtgttagcagatacaaaaacagcattaatcactttgtacacttccatcagagctcttgagtgaccaggtacattgtcaatgagcagtcatactttgaaagaaacctttttttctgggcagtaggtttcaatagtgggcttaaagtgtttagtaaacaacactgtaagcagatgtgctgtcatctggctttgttattccatttatagagcacaggcagaggagatttagcataattcttaagggccctatgattttcagaatggtcaatgagcatacgctttcacttaaagtcacaagccgcattagcccctaacaagaagatcagcttgtcctttgaagctctgaagccaggtattgacttttcctcatagattaaaaaaaaaaaaaaaaaaaaaaaaaaaagtcctagatggaatcttcttctacattgaaaatctaatgtttagtgtatccaccttgatcaatgctcctggctaggtcttctggaaaacttgctgaagtttgtacatcagcacttgctgcttcaccttgtgcttttctgttatgtagatgacttctttacttaaacctcacgaagtaacttctgctagttattttcttcggcagcttcctcacctcgatcagccctcaagaaactggagggaattagggtctttctctttattaggctttggcttaagggaacattgtggctcgtttgatcttctatgcagaccactcagacttcctccatatcagcagtaagcatggttcgcttgcttatcatttgcctgttccttggagtagcacttttaattttcaagaattttccctttgcatctacagcttggctctctgtttggcgcaagaggcctacctttcagcctacatcagctttccatgtgccttcctcattaagcttcatcttttctggttttttatttaaagtgagagatatatgattcttcctttcacttgaacatttagaggtcattgtagggttattaattggccaaattccaatattattgtggctcagggactaggaaagcctgaaaaaagggaaagcaatgggggaacagcaggttgctgaagcagtcagaacacacacaaaatttctcaaccagagatagggttcgtagtgcccccaaacaattacaacagtaacatcaaagactcctgaaaacagatcactgtaacagattttacagtaaagaagtttgaagtattgtgagaattaacaaaatgtgaaatcaaaacactgagtgagcacatgccattagaaaattggcactgatagacttgcttgatgtagggttgccacagctcttcaatttgtaaaaaatgcaaaaactgcaaagtacaataaaacaaggcatgcctgtagcatatgaaagagctgcactcaagtttccccccattttttgagaggaaaacttattttgctatatcttggccttctgtatgtaaagaagttctaaggtatgttagaaaatcccacatcttgtaaatgtcttatttaaaaagaggaagaaagaagaaatcataggaaagaaatgtcttctgaaaatgacttttggatatggaattgtgagaccatctctagaagtgacaccaagagacacacaagtccatgttcactcactgggttttagaggagatggaaaagtccacaaaaatgaatagaatcgttctctataagcctatgccaagctggtcacattttgaagatattttcttattatactcattgttctgtgtatgcattttattcctaataagtgtacaaatagttaacaatgttaagtacttttctgaaatactgagtctttatagacgttccggagtgccttatacatgtttaaggtagtaataaaagagcacattttatgaataaccttgataaaattcatacgacatttgtcttttggaaatgaaataatcaaatcacctttctgagcagtatacattgtatgtgtgcactggttcagggaacaaggcagaagaaagaagaggaaaaggctccatgccagtcattttatagtaagccaagattagccatcttatcctgaatgttctgtgcattttattttactttgttctctatgtggtatacataatgaacaaatgagtcaattttacaacatcttgtctttctagttgttaaagagcctgccaatatatgaccaaagtagagtttgtaaactattttgtacattttgcgttatatggtaaagactgtcttctgaaaacaacttgagaatatgaaattaaatccatctctaagaattatagatacttgtacacatagtaaatactagaactgttaaattaaaagcaaagtgttcagtaaaagagacaactttgtggttgatcataaactaaaatacttttaatatatatgattcataagatgtcttacgtttgccggttctaaacatcctttatattttatcatttgcatgaagaatgtgcagatattgccagcccacacccagggaccctcacagagtaaacttgtgtatgtctataagtgatctgggtgtttggcttgtgtcttggcatgaaagctactcctgctcttgatctttgcatgtgcataggatggaaggaagggaagggactctgctgttctcaggagaacttcaactctatgtctttatttttgaggatgagcaaactcttcaaagggctgttctgccctatctcttattttctgctttcctaacctttccccatttcctcttcattctgaagtgctaagaacgtttgagaagctggaggacacatgcttagaaccatagggaaaaagccattcacattccattgtgtcatcagcccagacctctttgtcttacccagaggccacttcccaccaccaaaaggaatattaggagtattaattctttccgctactaagacgttgtttagggtaccctaaatagcagtcatcgaaataaatgaagcctctattttaaagttaaagggacactagcactttaagctgtttggtacagtgtttttaaagtatggaaaataacactcaccttcttttgagaccatgttaacatttttgaaactgtgcattattcttttcagtagataatacatttaaggtcagaactatgctagaatatccagattccctgcagttggtgttctgccactgaaacctcaaaaccagatactctcagcagtgtactgcatatattacacaggtgcatcaaagatttatcactcctcttggtccacctccgggcagcatttcatcatcgaagaaaataaactcatttgagccgctctttaatttttaaaatgaaaatctatatccatcaggcatatgtcatagtttcagagtaagaaaaagaagataacttttgtgaaatgtctttttttcctataaacacaattacaaagcactcaacttataaataacatttattttatattaataaaaagaatttagcaaattcccagtattatgctaggtgttcatactctctactccagtttaaaacacacacctgcgcatacatacacacacatacagttttaaagatgcatttttcctcttctggaatgtgttactattgcttcacctttgataactttcattggggagcacttttcaacttaacttgtgtctgcacagtacattcaatgtggctttctgatgaaattgacaggtcaattcaaaaacaaccatattcattgcaatttttttctattccgaacatgaccaaatccaccaagcatattagtttcccttaaaactaaagaactttttaaaatttaggcttgagagaagcgaaacttattttaataactgaaggaaaaaacggttgatgcttataaactgtgtatcagattttggcctacgtgttccatatctatattatctaatttaactctcacacacccttaagatagtaggtactaatattaattcctgcctgtgtaacctaccattcagagagtaaaataacttccctaaagttacctgaacccaggaaatctagctccaaaatcaaatgaccaatccctatcctatacaacctctcaagaatgagcacatgtagaggagaataagcagaaaatatcattagttcaaattaactggatgtaattgagggtgaataagccaaaaatgtgaatctctaagtacctggctttaccttttctagagttttctttgtcttgagccatattctatgttcaggctctcaacatggcaacctattgggctgagacagatagaaaatgcatccatgatctcaaaaagtaattggcctcacctatcccgaatgcataaaaagtctgctaattatgacagaattatgtggacattcaattgttttttaaattttatattctaagtcaatattttgtaaatattttagaattagtaagtagtgttattcttaatgggttacccctgccatgaatattaggaaaaatatatataaatgtaaaatttgcctgcatacatttttgtttctgaagaagtgttagtcactttcattctttaaatatcatttgtgttgtcaaattcccatgttttttagctttgccctctttcctgagtttcttctctaactgcctgatggaattcttcacctggatacccatcatgctttcagaatcaacattcctgcagcctctaaatcattttggattaaatgcattctcaatgattataaaggaggtgcatgactggggtaaaataaaactttttaaataataaattttctgacacaagttcagatgtgacttatataagtcattgaatcctaatttcagtcatcaaatatggaattcatccagtctactagcttcattttacaaacgaagaggctcagatcctgacagaaactgtgacttgttccagatcatcatgaatttgtacctggactgcaactagaatctttaatcctgatttttttaaataataatgatggctgttatttttccactgggcataccatgactcagatgccatactgacattttactttcattatctcatttaatcctcaacacgaccctgtaagtaagcatttttattcccatattacaattgaggaaagggaagctatgggaggtgaacctattcattaaggttcacaaagctagaagagtcagaatcccaaaccatgtctgtctcactccaaattcccttgcttcagtaagcttctctaggccaatgttccttctgcattgcccattttcttcctatgaatgcaaattacataaacatggaagtacatttgaccattttaattgtttaacagtccatgttgcaggaccttccacaatagaatcaatgtattaaaatgtgtaaatgaccacactttttacacaaatgctatgaatccttaaggttttccaatttataaaatatgtctgcaaagcatactttatgatgctttgtattctgtcagtaattggatgtcatatatttaaattctattaaactgcttattaaaatgtccagtgcctcttttcttgcatggccacaaatattgtcactataaatcagcacctttcaaagttagtttcatgacaactcaagatacttcaaactaatttagaaagtctcaaaataattcaaaaataattcatttagttaacatattttgtaaatatacatattctatatattaacttgaatgtggaataagtcaaggaagagatatcaaatgtctttaaaaggtattacaactgtaagtaatcaaagaaggaaaaaaaaaaacaaacagaataaactgttaaagggccagaatactaggaagaacttaaataggtagtaagcaatacatacttcctcacctatataatatcaaagagtttgggatacccacagaagggactgtgaaaacctcttagaccatcctccgcattggtgtctccttaaatcaatgggataaatactgaaaatcttgtccaatagcaatccaatttaagaagtcaccataggtatgaatagcaaacaattatatgttccccatcatggctaaatgtatcttgtgagccatctacaaaatcaattattcagcaattcagttcatttcattgagacaatattaataaaaggatcaaaagaactatcgtctaattatgtcatacacaataaatcaccaactatttatcaaaaactgttctttccattctacctctgtggttattgccttaggtcagacaccatcacttctcacctgaattaatgtattaagtttttaatgggtctccctatctccaatctcaccaatcccagattaccctttaatgatttcacattaccttgaaaataactaggcacttatttttgtgctctggtacaaaaatgcctttgtctgttgccacacaggccattatctcatggaaaacctgttttccagctgtgtcgaattcagtagtattcatagacccaacacaatctcttcttgtctttaatgtgacgtttatcctgaaaagagtgcttttctctcacactccctgtatatctggttggcttatccttgaatatcctactcaaactttaccttccccaagcacagctttccatgatctcctcaatgctgagctgcccttctctgtgctccttttgcaacagctgccaagccatttcttacatggcatttactgtctcctctcccagaacaatttcttgaggctagaaaccatgtcttaattatcttgtggcctagtatctgaatgtctgcaatatggaaaaaacgctccattggtgtttgttgaaaggatgaataaataaacatttcctaaaattgcctgatactaagaatcgctcaggtgctaattaaaaattcagatccccaagctaagatttatattgaccagtatgaattgaggcagaagattctgtacatttatcaagtatcccaaatgattttcataatgaggaaactgagagaatttaatcataacggataggaaaatctgtctttgcatgaaatttctctgtcctctgtctacgggttacttgtttttgaggtatccatgaggatactcctccccctttatctgatacctaactgtgctgtgcaagaaaaacaaaacagtttttcgtcatataagggcatgaggctaatctatccttagctcagaatataaactcagcaagggacttagatatgatttcaacattgtttgtattctttcagctagcgttttcaatgtggcctaaaaatgtcatgactcagagtacttattcgtagaattgcttcaaaattttatctaaaccactaaaatttcacacctggcattgaaactacctagtttgcctgcaagaactccacttacttgggaaatatacagtacttgctgagactaacttactgtgtaatgctttatcctataactctaggaatacaaactctttaaaaaaaaaaaaggctgttccatgttgcctctattcagcataccttactcctaatttcctgcaatattcttttcacctctactactcagggcaaactttttttctcaaagtcacaaagaagctctgaattaccaaatctaacaaatttttttcccatacccattggcttctaactaacagtatgagacaagcctttcttcaatgcccattccttgttggattcctggccttcctctttctctctctgcaactttttggtctccttcataaacgtattcttttgttttgcctgcttctaaatatgtttgttctattttggaatctaaacttgttggcctagcagtaaagttcttcaaagtttgccaatctgtttggatcttatcacactaaacacctctccatgtatcctacggtttgagctggcactcgtcagatgtggttttaaaatgtatactaattaaaattaaatagaataaaaaattcaactcctcagtcacactatccacatgtcaagtgttcaacagccactagtggctaccatattggacagaacgttcatacaacattgccttcatggacataagttctattggacagtgctagtctagacaactggactactcaaatttctcatctctacactttagctcattctattctctgtctacctgaaatgcggtccaccaaccatatctcttcctattcagatatgacttgttcttcaagatttattcttaatatttacctgtctccaaagtctttacttatcactctagctgaaagtatggcagcccacctatgaactctcaaagttgtttatactactgctcttccccatgttgttttgttctgtcattattggtgcaaatgcctgctttccttgatcagagatataatctttgaagagttgattgatagttgccaactgtcattgagcactttgaacatgagaagttaagtgcttgatcatacttctcacatcctcataactcccctgtgaaatatatgatgttttttcatattcacgttaaagaaactgggatttacaatgatgaaacattggacaaattaaggtctcaggacaggaggtcacggagtgatgagccctgaattactctaggtgggtttaactccaaagcccatgcccttacccaggggaacacactgcttcttgagatctcattcaccatgttaatgaccaccccacagccccaccacctaacgctaggcatgctccatttgtgaatgagtgaatagatgactaatactttatatgcttatggtcatttacaattcacaaaacttgttgacagccatacttgatttccatatgatttccccaacatctctgaggcagctccataggaaatgttatctccatttcacagaggctgagagagttcagagtcctccagaagctcacattgctatttagtaacaggcatagacaggacttcagcctgtgtgttctgccttcaagttctgccagcctttcttcaaaaccttctgtgagtttaaaactcatcaacaatcagcaaaggcttaaagagttgttgtatcttaatatatcgtcgtcttcttcttttttttttttttttttgagacagagtcttgctctgtcgcacaggctggagtgcagtggcaccgtctcagctcactgcaacctccacttcccgggttcaagcgattctccagcctcagcctcccaaatagctgggattatgggcacccgccatcatgcctggctaatttatttgtgcttttagcagagatgggatagggtttcaccatgttggtcaggctgttcccgaactcctgacctcaaattatccacccattttggcctcccaaagtgctgggattacaggcatgagccactgcacccagccttgagatactgtcttctaaaacttgccctttttattgtttaaaaaacatgatgaggccgggcacggtggctcacgcctgtaatcccagcactttgggaggtggaggcaggtcgatcacctgaggtcaggagttcgagaccagcctgcccaatatggggaaaccccgtctctactaaaaatacaaaaattagccaggcacagtggcgggcccctgtaatctcagctactcgggaggctgaggcaggagaattgcttgaactcagaaggtggaggttgcagtgagccaagacggcgccattgcactccagcctgggccacagagtagtgagactctgtcttggggtggggtcgggggagggggcagggaggaagaaaaaaaaaaaacatgatgaggcttaatggtttatgtctaagggaggggaagaggcaatttattcaagttttcagtgcttttaaatagccacatatttcaatctttatcatattgtttttgccctaaccctattaggataacttgcttacattaagcaaaattctgagaatgttaattagcaatttagctatgaatatgcatgattatttttaagtccactaatattatgcataggtcttatctgtaattatatctaaatgttctcttttttctctccctctctctttctccttcaggaaagccatttaaaacacatttgggaaatgtttgaaaaaattaattctattacccttatttccagaattttcttaaatattttatggctatattttttccttctcaaggcaaagccgtacatcaccacatacattatcatatttgtttacaaaatatgagagtcaaggaattaattttacaccagttaaataacagaagaaaaagttatactgtattttcttctttattatactaattttttcacatccttaaatggttttatattttgtggctatctgaaattatatttaagggcgagtattatactaccatttgtttcacatccaacttggagcattgcatatttgtgtagacatataaggttagtcaggggtgagagataggaggattaaactcatctagtttgcgtgccctttctcagtcacaatgcagtctttacaaacaattttttcctttaacagaaaaactgaaaaggtgtctaaaaaaataatttgccttaagacaacctttctaggaaatggtgaagatctgtttcaaacccaggcctgcctcatgccaaagcctatgaccttttcactattaatgaccaaatggttgaatgactgttaaataagtctcttgggtaaaacataaacgtgcctgatacccattcattaaaatgtttattagatgaataaataaattggtggatggagctcaatataatcagctcatgtgcctccacaccaaaagagaacattttcaaatgaacatgcaggaggaatacatgattacaaaaatgcttcagcaatgatttcgcttttataggattacttgtcccaagttcaacagtcttaatgcacatgcaatttgcttgaagtctataatgcccttggatttcaagctgaggagtctgatcatctggaaactaaaaattaaggatctgaaatattgttaactaaatagattgaactaaaattagcctcttaggacttaaagtgcttccacataaagtccaagagctagaaatgagaatgatgttctctacaatcaaatattgccttaattccaaatttagcttctgccacttgatctaatgttacatcaaggcatatgggccctctgcatgtgaagagcttacaccaatttaaagcaaatgcatcacatgggcaagaatgcaaattccaatagtaataatgtttctttcactatttatttcattccttatttttcatacttgttgccactttgtgaacttgcctccaatcactttacactggcttattttaaaagccttttaactgttctccttactgtcacccttttttcctaattccactgttcctacaaatggttgctagaaaaatcttccccaaacacagcttttatcacaggctcaaaaacctatcacaattctctaatgcctggtctataagactcttaaagtctttcccccttctcaccagcctagtctttccctgaggcagattccctattaagaagaaacaatattttgctatgccctgtattttcttatctgtgccttttggcatgctagtgctagtgatcctaatgtagagctttcaaacatgctttgaaaattatctttgatatattttcatatggcctctgtattagtcagggtcccagaaaaaaaaatagaattcatcccagagtgttcaaataaagagattttaataaaggagttatttgcataaattgtagacagacttaaggagcaaacaagatggcagggcacccaaaggatagcaatggtgagaatataatactacccttagggataaacagtcaaggaaaaggagcagtgtttccttaggagccctgcatcagaagaggtacagaggagaacagggtgaagggagttatatcctgaaaggacatgatcacggccagcgcacaggaccgaagtaggacatgaagaagaaatatcctgacctctttctcttcctgccctccaatatcctgctagagccttccataggccccacccaagataaacacagagagcagagagtcccagtcatgcaaatgacaagggtcagcttcgcagagcacagggaagacatggaatagtgttgagtgcatgggggcatggcaaatggagaacaatttgcacagtctgagctactctgtagccttctggaggatggcaatttctgagatatcccacatttggagtaagagaacagccacagacctcactctatgtgtcactttgagcaactttgcttagttagaagctatttccttacctttaatataagagtaatactcagtttgtataatagtcctggacatccaatgaaaaactgtgtataaaatatcttgtcccataagtgctaaatgaattgtaactactgctgtgactgactaaataaaaattatatatgtataagtataaaacctcttacaaaacatgtaataataaaagaatgagtcataaaagacaagaatcaatgagtgttaatggtcacctttgttgctgacctctaaactccatcccctggccttaacaaatatggcaggacatcttcaggatttggcaggcagacaattttatcttacactagtgacttggatgccattcctcttccttccactcagtaacagacggtgccctggacagcagtgacatctgcagccccaagggagaagggtcagcacaaattttaattttgcttttggtttggggctttaagtacacaaacaggttttttttttccctgtcagtttgcatctagcttcgcatctgacattttttaatgttttatgtatttggattgacctagaaatttatagcttcaggtttttgcttattttgctctgtctctaattcaacctccttgatttaaaaataaaagccaaaatataacatgaacaaatactctatttgtctgtatcactaagggggtaaggaagaggtcattctgctctttttgagctacttcttattacaatatattaacatttgaatatcttcaataacaagaaacaagaatactagggataacctataaaaacctgagtataatttgactcatcgctaaaaaaaacttaaaagctaagaggagaacatttacaaaaattgttatgttcactgacaaggcattagatttcagactaattgctgctatgagaaaaatagatagatacacacatacataaagctttatttttagaaggtcaagtatctacaccaaatgtttcatcctccagagttcagtttcagggaaatctctacaataggagagcctcctgatgtttgttgtggccacatttggagccatcaaaatttcctactcaggcatcccacagagaaaaagcatctacccctaagaatgtgaaatagtatcctcattactgagttgattactcatcaaccttaatagtatttgtaattcgcctttaccctggggcagttttcaaaggtcacagggaaggctgaaggctgtgtctataagacagtttgatcaaaatagaactaaaggctggcctcaggtagctatttctgagttggtcagaggacaatgaaaactacagttcatgcccaaatgttctccttggtcaaggggagactggctagacagagtcagatcttaagggtcatttctgattggcctccatccagagtatgacaacaaaactcgagaagcttcgcagataaataatgatgtaactaatttaggtgtttagataaatcattccaagtctcttttgtctgcttaggcctgattttcctgggctaggtaaacaccctgaatttacaagagaatgttcagcctcattttaactatgcaactggtagaagaagaagaaataggccttcttctattttgatgctagaaagacaaataaaacgacatgcataagtcatttagagtagtaaagcaaataatcaacaattcacaggattgaattgtatgataagaagacatatggaatttctcattctggttcttttctttgtcccttttgtaagttacttactcaaattgattacagcttttcaatctgtaaaaaagggatataagataaataatctctaatattccttctaactctataaaaatagctattgttttatgtatcaagaataatcaaagtattttttttagattgcagacctatgttctcatgagactgcatttcagatggattggaagcaacctaatatgtattcaaaaaccagcaccagatgaaaggactcagccagaatcatgcaaagcagaagaatcaaattcacagagacagactaaactttttaactaagactatcatgcaattatattgttggtatatcccatgtctattggttgtatatgtatccaaaaattaggtttagagatggatgatacacagattagataaactgataatcaatgaagaaatggaaaaatagacatttttaagcacattttctgaaatatcagatgtataaaatatgtgtattcatgaaagaaataaaattagacaggagacaaaacagataatttagcaagaagttattaagggtgaataatagtattcagatctatctgtcataaggccctacaaatactaaaattagctgtgatttttttctattagttccctaggattctgctaaaatcagcatcctcatgagcactggttaacactatggtgtaaatcatttgctgatgccataaattaaaaacaaaacaaaaaactatattcaaagtaactgagctataggaacatctccttaaaagatggaggcattaagagcattttccacaaccgagaactaaatgtcattcacctgtgaattaaaaaaaggaaatcacgggggaaaaatgagcagccagatcaattgcataaacctttgtcaaagatagaaatgtttatatgggagttctgtggctaaacaaaatgcaaacagccacatattttttcaaccaacaaatggatatcagtagcttaaataaactctttcatctttttatttttttcatccttatccttgctttaaaaaaatggaacacagtatttgttgaagattttatgcacatattgcatcatagcccaatttctcaaactcaaagtcaatttagcaaatagaaatgatagcagaaaaaacatataatgtcctgttgggaagaactgtctttcattgtagtgtgaacttaatgactgcatcacctaccttgaagtattttttaggtctagttattcatttaacaaaggattatccagtgccttctatgtgacaggcacagtggccacaaagataagcaaaaagatatgctccttatcttcatggagcttacaatttaataagagataaatatgcatcaaacaaccccacaaataaatgtacaactgtaactgtaataaaagctaaaatgagtatggtgcactatgggcatacagtagggagatctgacctaatcagagagttaagacaagttaggggccttgtatcctattcctggaatcttgctcatcagcaaacagctgaaggaagtatttgtaaggatagtatatccctctgtacatcccaaagtcctgtcctgtgcacagccactgactacatacctctgcatccaaagcagactcagctttcagctggccttgctgagagtgagcccagcatatcttggaaaatgaattcaccacactctggcacaaaccccatatcatccaacagcttcttcaaccagagcagctcagtcttggtccttatccatgaatgatggttgcagaaccacgctggctttacagggatctgggtaggatccattgcccccaccctgagtgtattcatagtgatgtgctatatggtttagaagccttggtaaataagtcaaggtagaactgtctcaacccagaactttcttcaggtaagaagtatgcttccaacagaagttcctaacaggaagcagctatcaccatcaaaggggagtactgaaatcattccaagactaacccccacagtctactcttttcttccctatcatctgtgcccctaaagcagtcaggagagttccctagccagacctaactcagtacttaaatatctttgataggcctgggaaacagaacacaggaagaaaagtcgtggcttttcaccccagcagtggaatctattcttgttttttgtagcatgagatgtttacacctaaggaacagaaagtgaacttaaaatgtctttaattaagaaattaggtttaaatgattccatataacaaatctgatttaattttaaatttttgaatacatttactcattcaagaatggtttcaaaccctccaggggtgagataaatggcaattctagctatcttctaccttcaaatataactttcctgaaataaaaacaggaaatccaatttgtaatcacaataaagtttcttatctaaatccaaaggccagtttttttccccttggaaacataagcgcctgaagcaggggctgcattttgatattctttgtggcacttggcacagtataatttctatgaaggtgccttgtaagtagcctggggtgattatggtggtgtaattttcatcacaaccacagataacccaggtaactgtgcaggtacaatgacgttcagcttaagtggctttgttccaaacaagggcctctattgtaaaaacaaagcaggtgttaaaacatagagatattgaagataggggtcattttacatactaacatgcactgaaaagtaaatctgagcttccccacattattgccaggaattacggtatacttaagatgaatccattaagtacacaactggacaaatgatgaaatttcatgttagcaaaattcctgacatatttcacacctcttactctattaaattacacttttttaacaaagaaaagctttcctactgctacacattttcaattttttctcctatgtatttcatattaaaatttcaaaataatttgatcagagatctagtgcacaaaggtgcctaagtgaacaataatcaccaaaaacacttgcaatggctgcagtagtgggattcccatcagtgatgtcaacagtgatgccaagaagacaaaagaagagggaaggagctaataacaaaatccatagaaaacaggcttcattaatttctgaacaggctacataaatccattaatgcctacagattaataacatggtcatataaatgaagttactgcctacgtgttttctgaaaaacatcattgctaattcatcttatactgtcaaaatttctttatccaaaatgtatatatttttgagtaatatcttctcaagaaagtaatactttcttgtaatactcaagaaataccctcaattcccaagtactacagtttatatgtgaccagtttttgatataataaaatatataaaatgtaaagttaaaccttagatgtctatctagtgcttattctgagtggcaatgaaataatgtaatagaacacagcaaaaggccgaaagaaggaagagctgtattttgggagtgcagagaagtattacttcagaaatgtgtccagacaaagaaaactcattcaagggacgtggataagggccaggtggactaaggaagaggtaatctatctgggtgtctcaaaaaggaagttttcattctggaatctgaaaagaggatgaatgcacctgaaaatcaaaccagcagagagtgtttcaagaagtagagttagagagaaagaatcaactagagataggtacatcagacataggaaaggaaacgtgtagctaactgatagcttccataaagacaaattgaataataagactgtgtatggtttacaaatgcaggcagtatttttctcgaggtgtctttgtagtgaatctactatctttatatttgccatgttaaagatactactgagctgcccagagagcagtcaaggaaaaagatttttggccacagggctgtggtccttgagaaatcctggagttcctgtgtgcttaggaagttatcagaaacagaacatgttgtgagtgtctgtgcttgaagtgaaagaagggagatattgagaacagcaatgagtttgcccctttttgacaaatcttactctctgcttatttatatcaaattatcatcatcatcacccttatctccagtgattacccaagtctcttgttcacactcctccaaactgtctacatatacctccccctcgcaatacacactgaagttattaagaattgaaagaacaaattgtttgcccatcctcataatcatctgtcctaaaaggtcatttaaacatttaatcaaacctgcagttctccaggggaacgtgtgagtcatgccgttcatcccacacactcaagcggggctttgtgtcagtcttaggaatgatgcagactggtcccacaaagaaatcagtcacagggacattttctgtcattaggcagagaacaaaaagctaacagtttcctggactctactgaaataaacttttgcaccaattaatgaaacccctatggaaagcatcatgccagaatccaaggaggctgtccatgtattgacatgcaaactaacactcctgcaaaagagggggtaggtgagcatcctaagtcaatatgaattatttgtttttctgctactttggatcagctataccactgctccctttcacaggtacaaatacacaaaagagggcttctgtttcataaaagtggctctgacaaatgacactcctcagggtgctgaacccaacactggcagccagcccattctgtgccctcagcctgccagtacttttcacttccaaagctatcagcctgcttcagacctatgccttcactctgactagggacaaagaaaagatcacagtggaaatccttctgcgtgctgctaataagcctatttagagtcaatgagaaagcctcattttgcaccaccaataaaggccttcaagagtactactgaatcagagaaaccgaaatgtttctatgtactccctgtcctcattttacatcagcctgacaggtgacactcagcaaaatatcgaacaggatgacctccaagtttccttccttctctaatgtcctctggttctctgttggccagtaggatttaaattttatttaaattatctcatattctgatggattcttgagccccttttcagttttagataatctccctgtggtttgctgaattggcatatctggagtctaggatctctgttggcaaagaactgaatattgctcccatccaacagcttagctagcactgtctattttctttctgaaagagatctgggtaggagacaggtgcagagcatctttccacctcccacagaagggctagggaaagctttgttgtgcatgaaccatgaacaaaaggataattcaaaccagcaataatgtccttaataaaaaataataatcattttcccaaatgaaaatctacaattctaaccatttgatcacagtgatgtaagcaaacaagcctgcagctaaaggttatatatgggtcaaagatttaatggaaagtgatacatgggtggaatgacatcacctatttgtcagaatactaactcctctaccatatcctatgtcggcccaccgttggggtgtaagggaaaggtgcataaagagataagtacccatttctaaacataatgcaagtttgacatttaagctcaatagtttagctatagagcgttttggtaacataaaaagaaaccagagcaatttgagtgacctttgtgaaagacaggcataaaggttgcaaccaccactctcaccaccaaaatctaaaaatgcggaaaataagcatttatcaaaatttctcagagactatgttacccacccaagattccacagctaggatgcagtgtttgagtgtctactaacaaggctgggaattattaaacacagaaagcataacagaaacacttagttcctcttgggtcttatggtccagttgataaaacttccagcactttgaacagattttcacttactgcaaagaaaaatgcttagctgaattattgtctatctgggttgcaagtagcacacccccaccatctgtaaaataatattttggtagactagagggcatgttgttaaaggaacccaaaggagaattgttttgataaagttagggacaatctctaatatgtgtgttttataattctgcaacttatgtagaaatatatctgaatgaaatgttgttgaaaagctgtatatcattttaattttaataaatcaaatcacattttatattcactgactgagaagctggtacttaggaaacctgtgagaaattagtttaataatttgtgtgtattgcaaatattgaccttctgacttaattcagaatttctatataaaaacaaaaatttaattctttaatatcttaaaatgagggatgctcatgccatgttaaataaatcatttccacttatatttaatacattgtattagttaggatgcttgcagctgcaaatgatagaaaatccgatccaaaatggctttaaaaattgttgttctataggtctatcaccctagacttctgctgtccaatatgatagtcattagccacatttaaatgtaaagaaatcaaagttacatttacatttaagtgtaaagtaattaaagttaaatacaatttgaaattctattttttcagtttgcactagccatattccatcaagtgaccaatagccacatgtcactaatggctgctctattaaacaatgcagatatggaaaaaccttcttcacctcagaaagttctattagatagtgctggcttcaaagaaaaggaagttgttaaatcagtaagcaacagtatctgttatattccctatgtagcaggcaataatctttatgcatattatttcctttaacttcccaaccgctctatgaggcaagtattattttaatgtattagtctggactctaggttgctagctaaaaatgggaaaacataattaggagaaccttgaactatctcacatatctacaagaaaagcctggttaaggtcctcatcaccatcagaactctttccatctgtcacctttattctgttgcacaagtcaatattattcttccaggtcagcttcccccttgtggtggaaacttcccagcctcatatctcacagcctcaaactactgcctcccaccccctgagagagaataatcttcctcctttcactcccattttagatattactcggaaggactctgataatttagctttagtgaagagctcagtgttaaatcaatcagttgtggctgaagagacacaaaggagaggatcagggttgtagaatagagacatggccagaggggctccacttatggacagtgaaaacaatttctacagaaactggaatggcagggtcctctccttcaacatatttctgagtcctcaaggctctatctcaggccctctgcaatttccactccacatactttctggatctgtctcaccaagtcccattaatatactagtgaggccccaattctctgtctcagcaagaccttgtattcttagcttcagactcacataaccaagtaacccttcccagacatctgcagctctatatctcataggatccttaaactcagtatctcccacaaaattcatcatcctccttccccctcttccccaatcattcattatatcaggaatgctctttcaatcaatgaccgaatttcccattccaagaatcaaggcatcatccatgatttgtcctctcctttaacatgcaattaattgccaagccctacatatatccctaaaatgtctttttattaatatatccatctacttctgtccattcctagtacagtgcaaccatcataggctgggccactatcatttctggaaaattactgtagtatctcatgggtctcccttcctccagtgttatgcctcaccaatacattatccatactacagccagaataatctttctaagatggtgattctattattctgcttaaaaccttctggtgcccattcattgactttcaaaacatttttcaactgcctcttgaggcatataaagtgttatatgatctgtcccttgcctaggtctctatccttactctcttcctatccccctctcctagtctctacaactgccatcctttctcttgcccactggtctttgtgccaccctctggttaaaataataatactactgataatctctttttcttaattctgctcatattttagtctcaacttcaatgacaccaatcttctcccctaggctacatcagttctccctgctatatgctggctattcgcttaacacattgcattgcaggaactgggctaaattattcaccttcccaattagactgtaagccccatgaggacaataaccatttttgttttgctcacgaacatgtccttgacatctaatagctagtgcttgaaaaagagcagaaaataagctgaatttaattctttcatttaatccacaaatattttaaggaagcctatttgtgccagatgccacccaaggcactgagattcagctgtgaatgaaacaaaatctcttcctatatgaagctcatgttcttgcagggtaaaaaaaaaaaaaaaaaaaaaaccctaataaactaataattttttagaaaatgcttaaattgtataaataaatatagttttaatatttgtataactttttacatttttatttttactttttaaattttattattattatactttaagtttcagggtacatgtgcacaatgtgcaggttatttacatatgtatacatgtgccatgctggtgtgctgcacccattaactcgtcatttagcattaggtatatctcctaatgctatccctccccaaaccccacaacggtccccagagtgtgatgttccccttcctgtgtccatgtgttctcattgttcaattcccacctatgagtgagaacacgcggtgtttggttttttgttcctgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacatgtgcgtgtgtctttacagcagcatgatttatagtcctttgggtatatacccagtaatgggttggctgggtcaaatggtatttctagttctagatccctgaggaatcaccacactgacttccacaatggttgaagtagtttacagtcccaccaacagtgtaaaagtgttcctatttctccacatcctctccagcacctgttgtttcctgactttttaatgactgccattctaactggtgtgagatgttatctcattgtggttttgatttgcatttctctgatggccagtgatggtgagcattttttcatgtgttttttggctgcataaatgtcttcttttgagaagtgtctgttcaaacaaatttacaagaaaaaaacaaccccatcaaaagtgggcaaaggacatgaactttttacatttttaaaattgtataaatgaaacctttttaaatgacattttccattatgtactccaagttgtcttttcattattctgttacctcattagaggtagtatggaaataaagtgctttcccctcaaatagtataaatgtaattttatttttttagaaaaacaaaacactatggagtcatggcatttataatgaagtaatcaaatattccaattaaatattcaggtaaccaaatattccagttaaatattcaggtaaccaaatactccaataaaatttgactgattttataggacacaggactatatgtgtttctagaatcatattcccatttaaattagcatcgcagtcaggaatttaaagacaaactatcagaatagtacattttcttcttaaattacagtaaaagcccttttataactatgttgagcttttccttttattaaaaaatatcattccaacaattaaaatatttatcaaatgcatgccaagctaggcaccatgcatcatatctacatcactgtaatgaagaacaggaggactatctggccatacattatagaccaattaattaacttaacagatatataatgctaagcatatgctaagtcctgaggatacagaccctgcttactagcaacttacaaactattgtctgactattatcttcctcacaaaatataagctccttgagggcagatgtttagcacaatatagagtttaacaaatgtcataagtaataaaaaaaaatcaagactcttcggtagtcttgatttctcaattagccttagtaagctctaatcacacttagtcttaatttctcaattagccttagtaagctctaatcacactttatgtctcctttgccctactgtatccaatcctttgttcagctagttcttttgtttagctatgttcctaagaagttgtggtaattctcttgtatttcagcaaatcatatctatgagactctctcaaatcctctgagttaaaaagaatcccaagataaaacatagagaagaaatattatttttgaaatatagtctcctgtatttatctgctttgtatcacttttagaaaagaggagaaatcaagttttcctgatattgaatcatctatacattgttcctttttaaaagtttgtttggttttaatgaattggttccctcaactgaagtttaatagccatttaaaggaagacaatttatcctaatgtttctgtatttttctaaactttctcatcctctctggcccaagccttaccatagtttttcaaataattggtgatcaaaaatgctgaactgtcacctgtttgcctatatactcttttccatttgtgagttcttcagtgtaatattccagagattgtgtttattcagatacattcatcttccaatcaatcaagataatgccagcttctgttgtgggttttgcagaaaggatttcctagactcctgaattcattttttctctctgtagtgtgagcatttttctgttttaaattattttctgaaaaaatgtgagtatttacgtactcgaaattttaactagaattgcttcccttctaaaaatgttagtttctcagaccaaatgcatcaatctgactccctcagaagtcaggcggttcacaaagagggaatacttcaccttaggtggccaagaaaaaaaacatactggcccatataccaggaaaaatagtagaatgggtcagtgcaactcagccccacttcggtaaagttcttcagagcaggaaaggatgaaggaaagaagcaagtatcaaatcagacttcagtcctatcatcgttaggtagctacagggctttagacaaccaacttgaccagatgagcctcaatttccctttctgcaaagtgaggaaactgagctaaataatctctaaggacctcttcaactcctccactctatgtgtatttacgattgacagtacagttttctaagtgttcagaatattttttgtttctgagatggcaaactttacaatctgctttgcagactttgaagatacaggtgcatctgtgtacgtttctttaaatttagtaatttagtaattaagcttcccactttcaaatttactaatgagaaaaacacgcacacacacacatatatacatattactctgttattatactttactgatttgaatacatactcaagtaagtatataaagctggctactgattgcatgtttttgcattgacaatgtataggtcaagtcttgtttagacgatcttctgtaagacaccttgagtttatcagtaacctttagcacagttgaatgtttattttgctaatttagcttcaggtgctatggttatcattacaaactaactctaatattctctgttactcaaagtataccctagagctcaccaggatccatgtcacctggaactcatcagaaatgcagaatgcctacctccagagttacaaaatcaaaatctgcatgttaacaaggtacttaagtggtttgtgtgcatgctaacattctagaaatgctgttagacatagtgcttcccatattgctttaaaatagatatttttctttaagagaatgaataaatgagtaaactaactctaatttagcaatgtgaactgctataattcaatgtcattggacttagagttatagaacttctagttgatagtttctcctattttgttttttgcttaatgttgtcataggtctactcttatacaaggcaaggggccagggaactggatgtaaaggtttacgctgttcaagacccactagcaaaaactacatgtataactgaaaatcaatgtgaagaatattaaaatatttactactttataaaggattaggtaataaccaatatgttatttttgcttcactttatagttggtgattaaaattccaaaatgtattccatcacacataaagtatcataaagagcaaaacaggaaaatatttttcaactatgtggtaaaatatctaatataagtaaataataaatggaggatataaatgtcaaggacaaatccaaataaaagaaaccaggatcctggctgcagctctgagattaacactgtgatttgtcaataattcactttacttctctgggttctagtttcttcactagaaaacaagagattgattcttattttacatcccagctctaaattctgaaatctagtatgtctgaaatcaatgcctgttttgtcatctcagatggatctattgaaattcaacatgaaatctcagaaacagcataaataagtcatccttggatttctgctattttacttgcgaagaacaagagcatatggatggctacctggtagtgctcacgtaaaggcattctccccaagagttttactctaggcaaggggacaaatggggatggcagaacgcattttaattcaggggaacctacctgggttatctttcactctgaatcaccaaatcaaattatgtaaattcatcccccttgatgactacctacttccttcatatggtctctatgcgtcctgagtgaatacgggagagcttatacctttcataactttacaaaacagaggattgctgagaggtagttataattgaaaagttacatagttaatctagcaccagaaaataaactgacaggtcttccagggagctaattattgaggctgctatttggttcactgacaggattgcttgtttgtgggaagaaacatatttgtgcgttgctttttccattaccgctatttctatcatcataaataagaatcaataggccattttgcatagcatatgctcaccactattttgtatctgagtgtcagctgtatgcaggctaagcagcagtgccccagtctcctggctgagaattaaaacccagcaaagaaaacacctcaaattccacaagacagtgtatatgtctttgtgagctccttgagagcaagggaggtctgttgtttgtctctctatctgaagcacagtgcctggcacatggtgagcttcaaaatgtataaacaactaaatgaataatgaatgaatggatggatgaatgaaacaaaggaaggttttaagataggatatggaatcaactgtatttactggatcagtcaagggatgtcgttttgataagcacagagctatttataattcgtgatggagacaggaaggaaaagacccggcctgagtccagagggagctggcttttgtttagcagcttaacccacatactcaggtctctacaatattcactattgggtcctcactatagaagacaagaaatcagaatgacagtcatttaaaaagtaaagcaaaacttctgaagaaagactctactgccaatgagaacattgctggacaaaacaaggtcaagtaagggactgatcagaggaaagataggaatgagaaaaaatgaggcaatgaagggagaggaattgtggcagaggactgagtggggaaataagtgtgtgaaaaatgtgtaaagacagggagaggatgaagatgcaattctcaagagagtctgtgggtgtctgggttttggagagtggaaagacactaagcctgagagtacaatgagggagggaggaaggaagggagggagaggtcagataaaagtctataaaataacacccatcaccactgataacaagtataaaagagtccttttttcttctcgagaaagacaaagggaattttaagtaggattaagtagtagtagctttcagaactcagcagctctcagaagcaataataactacataaatagctaagtggatggtaggaattacctcacttggaatttggccagcaaatcaaaagttagcagtaatatcacatctttttgaaagctttcctgagattctagaggggaaaattatctcagaaaactgtttctactgagtaaatttcaggaagaaatgctcctcactgcttgaagatgttctatctctggaaaactggtaagacagaagtccctccctgctgggaagcactctctcatccaagtaaatacattgccaattttgcccccaatggaagcaaataattacgttcgcagatcaccgtcgcctaatgtaaaatgttactcaacacatataacttaacctaccaatgatgttctgaatgaacaaaaagggcctcatggatatctcactttcagagagtgccttaactttttgacttattgcaggtagttaaaatgcaaactttttaaggccacattttaaagcactttgcaaacgctggacacctctactcgtgaatatcctgtaaatttttcctttcaagtacatttgaccactaacatgccagatcatcttcccttctcccctaaaacagaaatgaaaactgggtaaaatggtaatttgggagacaaatatcttctcttatcatctgaaaactgtcatatgttgcttttttaaaaaattaaattagtgttatttgttttccacccagagacaagttattttggtatcacccacaatggaatttgcatgaaaatctgtttactgacccagttccctaggggtgcatttgccctagcacttggagtaaacaccattttcattgcactagaaatagttctaattggacaaattgttataattttagcaacacccaaataaatcaaaggaattggaggcagacatgccacagaatctggattcggccacaaaccagttcagtatttgtgcctgaaataaaagtctagtcatataccacctacagatgctaaaggaacagctacatacctcaactgaacttagaaaatatgatttttttattgtactttaagctctgggatgcatgtgcagaacgtgcaggtttgttacataggtatacatgtaccatgatggtttgctgcacccatcaacccatcatctaggttttaagccccgcatgcattaggtatttggcctaattctcactctcctttcaccctcaaccccctgacaggtcccactgtgtgatgttcccctctctgtgtccatatgttctcattgttcaactcccacttacgagtgtaaaaaaaaaaaaagaaagaaaatatgagtttggagaaactggttattctgaaaacagcctattaaaaagttatgtgactggttaacagtgtgtgtgtgtgtgtgtgtgtgtgtgtgtatgagtccatccatttcattaactggggtattttcactaatacagtctaaataacaggaaatgaatttaaagagaatcaaacaataacattcagaactcaaagttaagcatagtgtaaaatatatctcagtggaaagcatgtaagtgcttaacttaactctccttccaaacccatctataaactgccactttgtattttccattcatgtatcctcctctccaagaagctggacctttttactgctgttcacgcacctacacgtcacaccctactccatgcctttgtcctgctgactccccatttcttctcatcttggatgtctttcccaaatccttgtcatcaaacactcatctcctccacagagctttggattttacaatgtaaacttacatacattttctgaacttccctaattatctatatccaaatttagcatttaattatagaactttcctctctgattacgtatatgtttgtgtgtaccttcttttcccccaaccaaatcacatgatttaaaggtaacattggtctttaatgcctctccttaaagtttccatcaagatcctactctgcatttattctctttcactagttatcccttctttttttttttctgaaaacatgcttaaatgtgccctatcctaaagaaatctccaattctttctcaagctctcccaccatacctactttctttctctcaaaacttcttgaaacagcatcctttcctccacttctattctgttctctctcaacccctctaatttggttacccaggcacacccttatctctcagctgcaagtccctgcagcactgaaacctcacgcacctgtctttctcctggagactgagacaaccttgactcccagttcatctccttcccccaagcccagcattctcagtgtcctttcctggttcctgcccttgaattctcagtcatcactcctcatcttttctcagtctcccatggcaattgcatctctgcttttgtctttaacttcaaaatctccaagacttcctaatctcaaattttagtgaactgtctgtggggtcccagaccttatgctgccacctgctggccagtttcatggggctatctcagaacaaaattcaagtttattcccaaacacctaaccattctatttattttatatttcctctgttaactaattacatcaccattttcctagacctccctgatagaggtttaacatcagcatcctccatgatttaacgatctttgccccagcatcaaccactcagctggttgttatataaacacaacactatgtagcgttagataaatataacactacgtaccaaagcgtctgtcctgtgtgttacatccctagctagcttttttgtttgtttgttttgttttgttttgtttttttggagatagagtctcactctgtcgcccaggctgggtgcagtggtgcaatctcagctcactgcaacctccacctcccgggttcaagcaattctcctgcctcagcctcccaagtagctgggactacaggcgcccgccacacgccgggctaattttttgtatttttagtagagatgggttttcaccatgttgcccaggctggtctcaaactcctgagctcaggcaatatgcccacctcggcctcccaaagtgctaggattacaggtttgcaccaccgtgcccggcccctagttagctcttcttagaccatgatggcctgtccccaggatactggatgagtcctcattgacctgcctccattttctcccctgaaccccaatcctcttcacacttctgccaggcaaatcttcttgaaccgagtgtctgagcaattctctagatgaagagcctcaagacattgtgtcctaccggtagaataaagcccaaattcctcaactctggaacttctggaaagaacttcaagactgtgcatggtctggctccagactatcatcaaagcctcagctgtcatcacgcttcctctcgcgatattcactcttgctccaacctccctgaactattttttttttcctttactttgaacaaaagagccttactctggcgctagagcttgtcatgcattcctgtcatatctttacatgactgaccacttcttgtcactcaggtcttatctcaaatgtcacctcctctggcgaggcatactcagaccacacagtctaattaccttcctcctcctaatacccaggttagtctttcacagttaatctgttgtatttcttctaagcacatctcagcatctgaacacatctgttcatttatgtttattatggagtgtccatctccccacactcaaatgtaagcccgtgagcatgaatattgcctttcttcactcaacccagctcctggaaaagtgcctggcacatggaagcctgaaatcagattcttccacagtgtggcacccatttccacctccttgttctgtctctgtttatatgtctgtgctagcttttagtatattacatcttttatttgaacagctatttccaaagaaagtgaggaggagggaaaggaggacatatcaaagtctgggggtggcagggtagaagaaggaatgaatcatttctaaaacacacattcaagttgtgtagttttcagtgtaaaggatttgtgcatttttgttaaaattgacccttatatatgttgtatgtttttgatcctactataagcagtattctttaaatttcattttctatgtgttagtttctaatacgtatattaaaaatgaatgtttatattgacctcatatctgtaaccttgctaaatttactgctcagttctaagtaactctgtctcaaaaaaaaaattatgcgagttttttttctatgtgcacaatcatctgaaaataaatatagttttaatcatatattcaaaaatgcatattcaatatcattattatttttaagcacaagctatggaaagtaaagcatctaaaaatcatacatgttccaggatagctgctatgcaggatttaagaaaataatagtattatagaggacagcgattaaaatagttgaaaaatactgtcttatagcaacttatcatgatacatattacattttgaacccctggagagcaataccatgtcttatttgtctgtattccatcaaacctaataaagtacattttccaaagtagacaataaatgtttcccagataccccagtactgtatgcatggtatatgttcaataaaaacttgctgatccattgaaagaaccaataaacaaatttaagtttgttgaatgatcagggtatgctcagccctgagacactataacaaaaagacacaaaaaatagaaaatacattcatcattatccatatagaaaaacgtaatttatcaagtaatgaaaacaaatgaaaatgaaataaatgcaccacaggaaacatttgagtggttacctgtgcatttctttatatgactgttccttttcccatgtgatcctaacttgcagccaaaattctcctcccagaattctgcaaaccacacatttcttcgattattggcaagagttcggcttctaaagtatcgatcaaatcctatttcaaaggagaaaggtatgattttaatattctttcaaaattaaatattgtcagaactttcgaatggacattatattctgatcactgcatgaaaagaaaaaaacaaaacacataacaaatgagagaaagccagtagcccataaataaggcctctcttatggcaaaagtcaaggaggatcaatggacaatccccccacaccaccaccagtacccaagcacctggctctatgaataagtacaacaggaaagcctggtgtcagcgaccttcttaaaccctctcctactctactactcccagaggcagcaaccagtgacttcatgctgaatcctgaatacttagaacccaacttaaacttgcctcattcttttctctttcctagcatggatcaatgttccagactttcctgtgtttccacatacttcaaaatttctccttcctatatgttctgttttcaggtaattcaataaagcaatcatgttaatgtcatcttatggagtcatgaactcaagtgtcggtttgctcaggtaactactttattgaagggagaccccctggaaataatgccttactccagaggataatgttaagatgggaatttcagtcactgtcaaaccgactggaaaagatgtttagaagatagactgcctttcaggatgctccaagtctttcctgttgcatttatttatccataggataagcccagcatcatatatattcattttctataaatcaagcatttccctccaacaatgctataaccaccataaatacccatggaaatacgcaaactcaaactcaaagtgcaattactaacataatggaaataactgactatggtctttttcttaaaaaaatataatgggtcctctttcctaaatacatacacacacacacacacacacacacacacacacacactatatacatatatacatatatatatgtatatgtgtatatatataggtatatgtgtatatatatatgtatatgtgtatatatatatgtatatgtgtatatatatatgtatatgtgtatatatatatgtatatgtgtatatatatatgtatatgtgtatatatatatgtgtgtgtgtatatatatatatatatatatatatatgcatatgcatgctggtttaaatactggtcttgacaattctgccaccaaagctaaaatttgtatcaagtcatcagtaatgagtgcatttcctcatattatgatactccagttttgcctttgagttcagatccaactggaataaaacaaattctctatggtgcattcttaccatcaattgatgctcgtttgggcaaaattgtcacagccccttctgcaatctcctcttgctgatagacaggtgctattttggatccccaactatctgagccaatccagagaaaatgcccactttggtttagtttttttgctgcttccaatatcctcctacaggaataaaaataaataatgcatatcacatgtattaaaaataccacaattatgaatattacaagaccagatttaggaagttgtatacactcagtaggtcactgtttaacaattaagacgatcattctaactgcccgagtcttatcatctcctaaaaacaatatagcagagactaactccaacatatgttaattagccttatccttaacctcattcacatcattctgtctatcacctttgtttgtcttatctcatttggtccccaagttttactctgtaggtatttcagatttacaaactagaaggcagtctgttattggaaggcaattacaagcttttatgttgaacatgaaatatgttagaaagaggatatgggacacaaatctgaccctacatacagaagaaaagtaatcagcacctgatgtcatcctcattggcaaacataatcactgctcgagcattaggtgtttctagcaggcgtttgataattttttcaaattctccaggtcttggttcacgtgggattttctgtgactgagcaatgcaaacaccacctatttaaaaaagaagggaggtggtgattcagaaagagcatttatttaattagcaaacccaattacctactttataaaagcacatacttctgtatgaatattatttctcaaaatatgtgtcactctcacctattaagagcaattgtttgtttgcattataatatattcaccaaataaatgacaacaattattaatcagacatgggtttctttcccaatatttaaacattatttttgtggatatagctaagaaaaccaaggtgtataagatgtgtgatgagagtcaaaagatggaaagaagaagggatcttttgatttatgcaacataagccaaaggacaagtgacagaattaataaaagtatgaatatgtcttatagttgagacccttattaagtagcaaagtccttttgttacttttatttactggtagacttcttttaaagttaatttcattgtatagctaatagaactgcagcaagatcctcatgcatcagcatagcaatgtcttatgagacaagtggtcttcaaggctatgtaagacacaggcaaaccccaaagatgccaactttggattgacatacatcgccactatgaaaatcgaaatggcagaaataccatctcattttcactgcaaataaaaagacagaacccttcttttggcctctccttcttaggcaatgaaggacaaaagagaaaagtatagaaaagatctctgcctctgggctggggtaggaggagaagaaagaggttcccccagttgcagtgaaacagagataacattctgaaactagatgagaaagcaatattagtaataggtttcaactgcattatggtataaacagtatttttttttagtcagctaagaattaaatcaccatttatagcattgcttcagtaggcaaaggcatttttacttccaaacaattgccaatgcactcagtcatccaactgttattggatgccattatattctacgcactgggctcaacattggaaatgcacagtctaatccaggagttaccacctagtctgggaaataggcatttgaataagttaccatggaatagataataaagtatataattaataggatacccaatacaatcagaacacagaagaaggagtaactaaagtgcttgagagaactgaattttaaagagcaaatatatatccacatggggacaaaagtggaacatgtctggtggaggccaaagtatgtaaaaacctagcatgatcatggcctatggtagagactggctgggtttgaagttggaaacaatgaccaggtccaacttgagaacggctttgttagacatgccaaattctgtaggctgagtgttcatatgttaaaacttaatccccagtgtgaaagtattaggagatgggactgttgggaggtgattaggtcatgagagtggagtccttatgaatgggattagtgcccttataaaaaagactccacagagatttcttgcaccatctgccatgtgaggacacagcaaaaagacactgaaccaggaagagggccctcatcagctcttgaccatgctggcaccttgctctcagaccttcagcctccagaactgtaaaaataaattactattgattaagccacccagtatatgataatttttattttttattttttagatatgggggtgtcactctgtcacccaggctagagtgcagtggccagatcatagttcactgtagcctcaaagccctaggctccagtgatttgctcacctcatcctccggagtaactgggattactctgcacatgccaccacaccgcactggtctcctataataatttattatgcatttcaaagagactaagacatcaaataacttggactttattttgaaaacaatggggatccattaggttcatcagcaggagaaatatatgctgagctttatgctttaggtagactttcaaagaagaaacgtctggtagccaaatgacagatttccagggtgctgtgatcggacctaatatgtacagcagatgtatgagtaactggtgccagtatataaaactatttttcttttaagttagagaacattcaaaattatgcctgtaatagcaggactcttagtaaccttacaatttgcatcccaggggtgggaattgcccataatacacagattgggctgtgtcactacctgcagttagctagtctaccgatatactaccactagttgtgataattgattcattccttcagtaaatatttcttgagtgccccgtatctgctagatactgtgtgggtgctgtggacacaatggtgaataaaagaaattctctaagttcacagaattcagaaatattgtgggtaactcaggcttaatgcaaactaaaaagaaagaagaagaagagaaaaagaatggagacgagaaagaagaagagcaggagaaggaggaggagaaagaggaagaggaagaaggaggaagaggaagaaggaggaagaggagaaagacaaggaggaggaaatggaaggaggaggagcagatggaaggaggaggaagagatggaggaggaggaggaagagatggaggaggaggagtaagagaaaggaggaggaggaggaagaagaaaggggaggaggaagagggaggaggaggaagaggaaggagggggaagaaggggaaggaggagaaggagaaagcagaagcagaagaggcagaagaagaaataatacataattataaattataataagccctgtgaggaagagcaaaggaatttaatttagattgaggactgctcagggaaagccaccctaaagttgtgtaatgtagttgagatcaaaaggatgagagcatgggaaagggcaggaaagggccaggggagtcagtgaatgagggtgagaggagtgggcaacaaaaatgagatggagataagggtccaattgtgtgtggctctgcagggcctgtggaagactatgaataattaaatgcttaactttctcactaaatgtttctatttcttcgatctttgagtggcccataggaatatgtctcatgtatgagcattgcactccacggaagaaaaatggatgacgatcgctgatacagagggcagcctgaagtgggatgaacaggaggcaatgagccaagcaaggaggtattggaataggcagtgggaaatgatgactgagccagcgctactggtgctggggaggagcagctggagctaaggcagaatctctgagttagaatcaatggggctttgtattgatttgatgtaagtagggaagcaatgggaaaccgctaagtatgactccaaggatttggtctttgtgaccagttatgtgatggtatcattaaacaagtgggaaatccaggaggataaggaggaggaaagaatgattttgattggaagcaggttgtcttcaaagtatgcatggaatgtcaaactgaaaaagtgaatctggagctaaagagagagaagggaattgtaatactttcgtcaggggctgataggttaggtatttgaagtgttgtggggcaaagaggtcactgagagagaatatttaaatcagcaatagaaaaggtgaattatagaactctgaaaaaaatcaggtttggagaaggaggaaaggagtgattaaatattttgagaaaacttttggaatgaagtctagaggtaagttgaagactatgtataatttatttaaaatgcaaacaaaccaacctccgtgagtggaaacattaggtaactgcaaaaatgtaacatgaagtaacactctatagggaacaatagctgtttcaaaagatgactgcccttttaattaaattgccatgattacttaagcatcccattaaagacatgttatatgctgagtatcattctgagactgactctgtagccataaaaaattaagttctgaaaatttttattattactgtttcagaagaagcaaacaagcaatccaaacatagtttagtctgaattcattgatttatttattcaccatggacctattaaacatttttgtttgtaaagagctgagttagctgagttgaattttaacatagcttaaatccatttcactttttgctattcccacacctcacctcatatctttcaacctggtcagtttgaattttcctggaaagaggcactggactattaatctatttaagctgaacaaatgcttgtagagaacctgttccacatggcattgtgctgtttggtgcctgtgtatattttattaaagtgtagataaattatttctcaaatgattgtagttagaagactgggattatttccttaaccctgatacccattcacactttctttcttcatatcagtcaaaaaccagacagctaatctgttcataagcactcatggtctactatgtttcaggagctacagacaaagaccgccagtcctcagcagttatgatataattgaatgacaatatgtacacataagaaatgtcagacaagggtgtaaattaggtaacacagataacagcataagatacaccacagttcagtcataaatgacaaataggtcatcccctaaaatagtcctatgacttcataagaggaagaggttattatatactgttagaatttggtttaaaaaataaaatgaaattcaaagattcagacctcaaagatacgttttccatacaatactccacatccattgcttgactttttaaagagactctgtcttgatttaaattcctggggtgggtgggaggaagagaagttgcccttcatcaaagaatgtgtccaccacatctattcttccatgtctcagtctgaaagattactaattgtgtacaatttaagggactttaactttcctattctgcaggggtgttactgttctgtaatttttaaagcttagtacttacaggcaaaatgttatatgaaggaatttataattggctgttttctagaatttcctggctagtttccttgcagcctgtgtattttttttccttctggttacttaacaataatttaaagatcatttgttgaatttaacactttatgtatactttacaatacacatgatcactcctttccagtctcatttactcaatgacaccatctctattcctaatggcagaacttgaaggtttgcatcatgaccatctttctgataaggaaaatgagaaacaggggtaccaacggcttgcaagatactgaaatccaggttcaaagccagatttgtctgcctctaagtctggacttcttccatcatcttacccatccacaattgactatacctgtggcttaatggtttagtgactgcaaatgattgatggataagataaagcaaatttaaagactctttttttttttaaaaccctgccagttgtcccttgtaaatctaattgacagctacataaatacagtccttctgttatcctaaataagagtttaattaaaatacttggaatctatgcagattatagaagtgacttaaagttcttcagcatatagccagtctaccctccaaactttccaattgtttctgttgatgcatgttctcaggaagacttttctgaggttcttgtcttccacttctttcatactgcagcaatcataataattttaattttacttttttttgttacttctttttctttttcttcttcaattagaaatccatgagtattgaaccttgtctttcaaatttatcagtataccccaacatgtatcactgcgtttggtacatagacttcaacaaacatttgttgaatgaataaatgcaagacttgtgacaggtactgctaggatagagaaatacaaatgagacagtgctgctttcaaagacttctccatcaagtaggggaacaaatagctacatgtaaatatatgtttaaaagtagatgtcattaaaagaagtaaaaaaaatatttgggccatgacaattcagaggaagttgtcactgaaatgggatctgcctcccaaaatagtttttattagggtgccatgaattagaatactacctaggccttagtgtattcatctgtagagtggcattagaatttcctcatattgatacaagagcaaatttgtaaacaatgccatttcagaatttttacccctttagaaggctgagacttgtgggtgagtggtcaggtgtcacagatatgagagataaaaggcttgtatgtattgatttgctagtgcatagagatggtggaatgagaaagaaaatagacttgtcagaagacctgagagtggccccacataatcttgaaaagtctctcatctctcagtttcctcatctctgtaatgaggttcataataactatctctcaggtatactgtgagaatccaattataaagggtaaattcctatgccaatgtagcatattattattagtgttaataacagtaataatcatagccagacaagaatcatcaccaacactgagagatacttgacattcagccctaaaacacaggtttttcaacagatcatatttttgaatcttcaccattttatgtgtaatattatcaaacatcctaaattctgaaaagtgatacttgctcacttgcctgtgccaatagatgaaatgactagatttcactcttcatcattgttgattacaatgtgatcggggcaattttaaggtgagagaatgagaaaagttatttacattcttctcccatcccccagttcctacccccaagaattaattctcctttcaaatggattccataagtagtaaagatttggctccaatatctgagttgaaattagaatttaactctttaataaaatggttaaaactattaaaatattaacgggtgccaattgttaagcaaaagttgttatggaaacaaccacatgttctgtttcattcaaacatttgtgctacctttttaagaggctggaatctaatgtgttgagataataatgttggactctcctagaagcaaacctcagaaggagtttgaaatgcacaaaatttgctcttggcatctacctgatgcagggctcaggggaagcagagaaatccaggcagagaaatccagctggctgtggcccagtgacaggctgctgacaccacaagaagttctgaggctagaatggccttcagagttgctttaaaacaggccacaaaggccaggccattatacctccacatcaatcagtgcgatgattcattttatgtatcagtttgactgggccacatgctgcccacatagctggttaaacattatttctaggtgtgtcagaaaagattggctgggcggggtggctcatgcctataatcccagcactttgagaggccaaggcaggcagatcaagagatcaggagatcaagaccatcctggctaacacagcgaaaccccgtctctactaaaaatacaaaaaaaaattagctgggcatagtggcaggcacctgtagtcccagctacttgggaggctgaggcaggagaacggcgtgaacccgggaggcggagcttgcagtgagccgagatcccgccactgcactccagcctgggcaacagagcgagactctgtctcaaaaacaaacaaacaaacaaacaaacaaacaaacaaatagagaaaagattagcacttgaattagtggactgaataaagcagattaccttctccaatgcaggctgggatcattgagggcctaaatggaacaaaaatgtagaccaaggttgaatgaactcagcctgactgcttgagctgggacattgatcttctcctgctctcagtgcctctggctctgaggcattcaaactacaccactggttttcttgggtctccaatttgcagacagaagattgtaaaacttttcatcctccataattatgtaagccagtatctgacaaaaaatctctttggttctgtttctctggagaaccctgaccaatacaatgaatcatcagacttgggccactctggaagaggggaaggtgaacttggccaaggcagctctctgtagccagggcattccctcacagggttcagagctgaaggctgtctgcctatagcactcccagaaataggaataacaggtcatgcactgataggatcttgaaggtcaattcaccatatgtacattagtgttaataatgtataattgaaatttatacaaaaatgaagatatcatttttctgaaacaaccgtagactattgtttgccttataaggcaaataattaatagaatgttattatttaatgttaaaacttcctttcaaagacgtcttgttgcacaaacaaaggcaatctatacaaatgatagaaaactggaattgtagcctgcacaagtaggagaaataggaccttcattctttctggtttttcaataaagaagttttgttaaaacaatctaaaaggataaagaattatgtttttagttgttgctcatttataagacaaaaatctctattaataatttagtaggagaaaaataaaacaagaaacaatgtcacagcaccaagttccaactgtgatggaaattgaggattaacttattgggatgaaattacttacaaagctgtgtatagaatactaagtgtgcatttttaaaaaacaacatgactacagtattatcagtatctcaagttggttcacaatttccatcaaattaaattctacataaatcaactcaagtctgtggttatataatttgttagagctacacgacagaccttggttttggtgtacaaataagcaaacaaaattaccattttatcagttgttaaagagaatgactagactattggttaaaaatgattagacttacagtttgaccataagaaatttgcctagaattaaacatcttttgatctaataaaaatgtgatacagcccatccaccattatttatttcttatgaacatgccttcagataatagcaatgagcaaaacaaaataaccaggtgtttttttaaggcaatagaaacacataaactctctaccctaaatatccttagcatcatttatatttccatctttctgaagacataagtgaactaacaatttgacctaaagtaattggtcctttagtggtagttgagtaaaatttgttctatggtttaaataagtgtaatcacgcctcctgtaacaatattttcgcctcctcatgtggcgtacaactgggacttagcaggaaagtgcacaacatgaaactgtaagtttatcagcttaaagtgtactttgcaaaagagaagatttatctcacacatcactgtaaagaaaaagtgttatctctaccaacatggattaaaagagcaaaactgcacttatatttatgttcattttctctttctcactttcaaacattttatactttttcctctatcaaatgccatgtggaatcttaaagggactctgaaaagcaatgcaatgaaggaatggtacagaagaggcatgtgctaccatgcatagggaaataaagacaatccactgtgaaacgggactgcaacagaagcagacacttctcaaaagaagacatacaggtggctaacaaatatacgaaaaaaatgctcaacatcactggtcacagagaaatgcaagtcaaaaccactatgagacatcatcacacaccagtcagaatgactattattaaaagtcaaaaaataacatgttgatgaggctacagagaaaaaggaagacttacacactgttggtgggaatgtaaattagttcagccactgtggaaagcagtatgaagatttctcaaagaaccaaaaacagaactaccattcaacccagcaaccccattacttgatatctacccaaaggaaaagaaattcttctaccaaaaacacacatgcacctatatgttccccacagcactattacaatagcaaagacgtggaatcaacctaggtgcccatcagcagtggactggataaagaaaatgtggtagctatacactgtgtaatgctatacagccataaaaaagaatgaaatcttgccctttgcagcaacatggatgcagctagaggccataatcctaagcaaattaatgcagaaacagaaaacaaaatatttcacgttcttacttataagtgtgagctaaatcttggctacacacagacataaagatgggaacaatagacactggaaactccccaaggatggagggagtggggcaagggctaaaaacttcctattgggtactatgttcatcatctggctgatgggatcaacagaaacctgatcctcagcatcacacaagtatacccctgtaacaaacctgctcatgtacccccccaatctaaaataaaaatagatgcttttttaaaaaagaaaatcataattaaaaagaaaaggaccttggcacagagagcccctctcctgcctgtctgcagatgtactctcagagagatgctgtgatctggaggtggatcgggtctaggtaggttcacagggtcagcgtccacgctgggctctcactcagccacaactcaccaccgatctggaggtctgctcagaggaacagaggagtggggtgaatatgaatctcgtctctagggtcagacttcctaggtccaaatcctggcccttctcttcttagctatgtgagactgggtaagtgaggtggcttctttgtacctctgtccctcatctgaagattgagaagatggcacccaaatgggctttgtgaagagattcaatcgacactcaacacattacgttttcctcagaaaacacctgctagttgtaaattgtttaaaatcaaaatcaacagcccccacacagaaacagtgattgtctttcatcaagtgatattcacctgcattatttctagaaacctcaaatttcattctccaagtatacacagaatcacaactcatactagagattcctcaagggggatatagagtcggctgcagaaagctgtatagttagaagaaaaacttatgctcaccacaatagaaatgaatgtctgatatgttgcctcttcttacctcttcctttgaattagaaatgtctaaggagacatgggtacaggaactgggaaagagtcagagaaacaaagaaagaaatataaaagaagagaaccaggaaggggaaaggggagaagagaaatggtggcgggggagaatgaaagagaacaagagtagaaagaggagagctgagagagaaaacccagtccagaggtatctatggaactgggcagaaaaggaattctctgtagggtcaaaaaagcaagtgcaggatgaggaacaattggagaaggagcacttgactaggtttaaatgaatgtcattaatgtgttgtgtgcatttgtattttctttggattatgttttggtgagtgatttgtgatctttatttgttctatttgtttttgccatttcaaattaggttcccagactctgcagcaaaaaatacaacaggaagatttcaaaagagaaagctaactccttctaaatgctcaaatgaccaatatgaacagactctctgacatattttccagcccattgcctggaaaaaccattatgacaaagacaatattgaaatcaaagtgagcactgtttaaatttcttacctgttctggactttaaaacagcattagactttgaattaagcccattacagaattaataatttcattatggaattgcagcagttaaacaccccagtgtatttctaagtctagtgaagcctgatagctgtgaacactcattggatgtgtgacaaatacgtgaataaataagaagccactgtttcctgatatagtgaaattatctaataaatagataagcatatccatgttttaaaaccaccatcattcagaaaaaggcaaagtatcttggtatctgtgttatatgtgtacatatcataaagtcatttccaaataccttctgcagataggacattctcaacagtatatcaacagcagctatgagagcttataatctatgtgcactcttctactcagcaccaagtaatatctgattctacttatcagcattacccgaattctgcaatgtattagctttcaaacagtgaggggtctttgctcaaagcagcattttcaacagatacagtggctgagattctcaatttaagaaagaagaaactgatagcagaaaggtcattattattttagccaaataacccttctgagcaagggttgtacaatgaccatggtacggcagtaaccaaactaggaaatgaacttcagagaacaaacatcagcacccaaagcatttaaaaactcagtctttcaaggaaatgcaagtaacatgtagtgtttccctaggtaatgcaagatcattccctataggaggatttgatccatgtgtttagtacataaaaaggttaaaaatgcagttacgtttttaactttttggattcagatagcactaaaaagaaaggatagtgaatagatatgttttggatagcaagccatctaacattttcttgggctccagggatgatcctatcctggcctcccaagtagctaggactacaggtgtgtgccaccatgcctggctaatatttttgttttttgtggagataggggtcttgctatgttggccagctggtctcgaactcctggcctcaggcaatactactgcctctgcctcccaaagtgctgggattacaggtggaagccaccatgcccagcataattctttgaaggactcttgtcaaaatacattttggactagattttattcaaaatagaagacaattagtaccttgagatgcaaggacctcctccaaccacacacacacacacacacacacacatggacacgcacacacacacacgattctattaccttttccttaatgaaagatctacttttagaacaaatcgcaaataataatatatttgaacagaaaaatactatttcactaatgttttaatatctaatttcagcttcataatatcctaatgctatcaggttagtagggtaaacattataaatttatttttacatggaaaaaactgtccccaagatcacacagctattgaggagtcaaatgcaaaccttgtcaacctaatcctaatagcaaataattactgtactttgctattatctctcaataattgtctccttggtcattaggttgcctcaatgtacataattaaatacaacatcaacaggtaaggtggtatattcaaaatgcgaacttcaaagttttacatcatcaaggctgcacagtttagataaatgttttttggtctggttcaagttggacagaaatttcattgaccgacatcctctcaaaagagcctattgcaagctattttctccataaacccgggtctgcctgtcatcactcatggagcattaactgagctcttgctacatgctgagctctctgttagaatctgaagttacatgaatgaataaaaagacacagtccctcatcttcaggagataacagtaaacaacacaatatgtaaacaaatattacaatttgatgtgagaaatgctatcatatagggcagcctagggacaaaagaccaagaaaatggaatttggcaactgtaagtaagatttactggttcttgccagcggccttggaattacgtagccagagaagcataaaaaatagttgtatgatacattgatatgcatcagaatcaacaagtcagaaaacatttcataagtgagattatgcttgattcagccagccaaaaaccagaaaaatctatttctaatggatactaccagtccacagagatgcatatttcctttgacaatgttgtcattaaatatgatgtaataaacaccctgctttatgtacaaaaggagatttaatctaacttttccacaataagaagcagacaactcatgttactgtagaaggaatacagaaaaaaaattaagttagccattaaaatgaccactggaagaggaaatagcaacacatcaatcctaagaatgaaggatttcagctggactcaataaaatgtaatcacaacagctatctacaaggctttactttaatgataaaacacatcagaacttgtgagaataggtttttaaaaatttattcctattattggaaattctgaaaatgtgcaagccaggtcaatattgcattatttaaagatgcactgtcaaacaatcttttactgaaaccaaaaacatctacattctcagtgttataggaaatatagccggtgttttataacattctgcattaaatggtattgtttatctaagggggttcttagaaaagaacgttaagctttcaacaatcccaacatcacccaagcacaaaaatgaaaaccgatcagaactgcaaatgacaaaaggataacaatttgttacttcataaatttctgtgatataatttccacaatttccattcatgcagtgacttctagataaaactcattctccttgcaaatgcgttatagcttaaccatatataacatgtaaatatctacaagtgaaaagcagcttagcttgtttaaaaaaaaaaagatcctggaatataaacagagtaacagaagcactcgttcaagttcactcatggcatgctatcctcttctcatccctgcagtggagcacacccatgttccctctgcatgaccctgggcaagatgtgtaacatttgtggctatcagttccttcatttgtaaaaagaagggtgcttgacaggatgatgtcaagatgcctttgaatttcaacattttgtgtttctatgaatataccacatagctgcctcccatgagtactgtgaattatgtaagttctaatacgggaatagaacatcatgttaaatacaataaattgctttttgaaaagcctacaggagatgaactagagggtacatcagaaaacttttccaattcaaaattataaatcctgacttcacaagtcaaagaatgactggggatcttaaaaactgattttttgttagagtattggagccttggtcaggtgctagggatctgatgaccagttcattgaagcattatagttctcttgtcagttcaaaaaaaaaaaatgaaaggagtgttggggatgggctgaagatgaagacaacaatggcttccattttactattcaataatagcctcgcttttcctctcctcgtccatttctctctcctatttcttgatcctgctcaactttccctttctctcccttccctttcccttgtcttactctgtctttcccattttaaaaacctgaaaatggagatgagccacctgatacaacaccctttcaattacttccatcctgttactctgagactcactaatagcagcagcaaaaaaaggactgttgcatggcctggcctcttgctgagcatggaaaatagaacacattcatttacctccatgttataaactgaatgtctgtgtactcttaaaatccacatgttgaagccctgcccctctgatgtgatagtattacctttaggaggtaatgaggtttagatgaagtcatgagagtaagactcccacatgggattagtgtccttaatagaagaggaaagatcagactgatctctctctgtctctctctgtctccattcaccgtgtgagaacacagtgagaaggccattgtctgcaagccaggaagacagccctcatgaaaaacccaaccaggctaacatcctaatctcagactttccagcctccagaactgtgataaataaatgtctcttgtttaagctactcagtttatggtattttgatttagcaacctgagctaaaacactctaattcctccaaatacccaactaagttgtctactataaaaaaaaagaggggaaaagaggagagaaatgtcaccaatgttttgaaagctgaaaagcagatgattaccaagttgcaattgacttaccagaatagaaaaagctcagtgagagcccacaaggagtggggctggggatgaggccaacagaaacaaagctggtgttctacttaacatgatgaaggccctggagtggaggtaccagaggctccagaaggtggggttgaaaatggagttggttgaaaatctctaaagtcccttccctcaactccagtccctctgcacagaagatcagagagtcattttctatagaggatgaactcagggacatcaaacacagctgaagacatagtgagtttctatagaataaaagtctgcatgctgaatggatagtccctggtcccctctccctgtttagcatccagactgcagtagcctaacttatctccccccacccacccctgcccccactaaaccccatacagaaaattggaagagtcttctctggagaatctggtccaagggtaatgacatactgatacttacatggatgtttcccaactaaatgaccaattccacctgctcgagctaaagtaaagcccactggccaatgaatttgtcctcacctccaaggctcacaaacaccatgtcagcacctcactcttaatatcacagcagacatttgagaggagcctttaccgtgaaagtcaggaaccaaagcaaacagaagaggtaaacttagaggacaagaaataagacatacatagataacttcaagattattaatatcctcagagacaagaagtgtgtccatgcaacaagaataggaggctaaaagaatagaaacattcagagggcaagaagaagctcctagaaattaaaaaggagatgatagaaatatctcaatagataaggtataagagcaagtagagaaaacatttcagaaagcaaaacaaatgaaaatgaccataaaattggagaattcattcaagaggcttaactttccaattttgaaatccccaaaagagaaaatagaggccattaccaaagaaaaatttaagaatatttctcagaactgaagaataagaacttttggattgaaaatagttataaaataccagcaaaaagaaaagaaaggaaggggaaggaagaaaacctatatgaaggaatattaacacaaaattttaaaacactcgtgagtaaaaaccaattacagagaaggattaaggctcagaatggtttcaggattttcacagcaataatgtgaagtcagaagaaaatggagcaatgccttcaaaattataagaaaaaatgagttttatttgaaatgaaaagaaagcaagttaactatatatcaagtgtgtaggtagaataaagtctatttaaaatatgaagaaaactcaaaaaaatcatttaccttccatgcatacctttttttaggaagcttctcagggatggaatgaagctttccaaaccaagaaaggaaacaagaatgaacaagacccagaatccaagtagcagggaattcaccacaggagaaggaaaggggatttctcaaagtgatgatgaagagaagcagagttaacagccatcaaaggtccaaagatcatcccacccagattagagcagggaaaggaagcctccagaagaatctccaagaagaaaagaaactgaatggatgggctgtttgaggtgtttggatatactgaaaggatatgtacagttctgtcaaagtttgaggatgaattgataagttatatagaaatctaagcatatgacaaagcaagaaatgattaatttcaggaaaaacaaaatgtttaagaatagaaatggtattttagtacactagattaactgcaacatcaaatgcagaatcatgataatacaagcactgaatactaattaaatcagaattatgatacaatcctactggaaagattggaggaaaggaagtgtatgtgtgttcatacgcacatccatgtgcaatgtgtgtactgtggggagttaagtcatcgtcttccgtagtagacaatcaaaatgaaagctaaaaaaaaaatcaagaaatagcaacatgaaaatgttttgtgaaaaatggagacaaataccagaaaaagagctaaaggggttggaaataattgttcttggggatcaagattcaaaagcacggggagggcagtgggtttctgtgaagtccagtagcactatatacaatatcgcttgggtaaaatacatgtttggggccctgatttttaaggtcattaagtggaagtggggatgatatggtttggatgtgtcctcacccaaatctcatattgaaatgtaatccccaatgctggaggtggggcctggtgggaggtgattggatcatgtgggcagagttctcatgaatggtttagcaacatccacccttgctactgtacagtgagttctcacaagatctggttgtttaaaagtatgtagcacctccccctccctcccttggtcctgctcctgccatgtaagacacctgttcccactttgccttctaccatgagtaaaagctccctgaggcctccccagaagcagatgccactatgcttcctgttcagcctgcagaatcatgagccaattaaacctcttgtctttataaattacccagtctcaggtatttctttataccaatgcaagaacaaactaatacagaggaaaaaagagtttaaagatagcaagataattttagtcctgtatgttagggaagcatcttctgtaaccaggtttctctttaaaacatttctccacctttatgcctgtgactgtattatcttatgctgattgcttatttgtttgtttgttttggtggcataataggtgcttgtttaatatttttaggaacaaaatccagaaaacaacctgcattgactaaaataataagaaccacatgaaaatccatgttgcctgggtttaaagcatctgcttttcatgtaagtcaacactaacctactaatctgtccctaattggtctgatacccaaatgtcaaaggttcttttcagatatatcagtaattggttttaataacaaataagacctatcatttaaccaaaaccactactgacactttatctggatattgtttgcaatataatattatctttgttgctataataaagaaaataagagtcctctcacatacagacataattattacccaactaatcctttttaagcacttcaagggccacaagaaaatgaaattcagtggacaaaatggcttcagagaacagggaaacacgtgagaacccagaggtaggtatttgcagtcatgtaccttggcagagtttagtgtcctagctatgaagtatgcgagtttataactttggtaggtgttcagtagtgtttcataagaaaagagagtagagtatgaaatatatcagtggctgtcttccaacccctccagatagagcttgaaactctggcatgagtgcttttaggaagagaagaggtttgagaaagcttcttggcaaagtctgaactaacccattcagattgaaacttgatgagttctatttgagaaataaatcacagattccattaatctgtgattcaaatacatctacatgtattttttaatgtatggtagacactgaggctctggaattaattacctcacagttctccagaaaggatctgagtggtttcttttccaacagcaaatgggccacctacatctagactccttgctgaatgaagagactccttgctcctcgtcatttacacaagagaaaggagaatcaaacatcagcaatagggggaatggtctcacactgaggcccatgcctggcaaggggactgtatcccaactgacagataatttgggatgcaagtgatgaaagaaataaaaggtattggattcatagggcattccttcattttaataccaaataataaatattcattttaaatctcacggatttcaaacatcacttgggcataaacttgggaacaatcatgtaactcaaaagatgttaagttattttcctgcattatgtcattctacaacagggattagactgcataatccctctggatctcatggatgtcccagatacagtaactcgtgcaacatcaggttggcacattgtcttctagtaacaggtttttctcaccctctaccaactcatatccacaatcctcacatgggtggtattgcctgcctttttgcttttctttctttccttcctccttttctttccttcctttttccctccttccttctttcctcccttccttctgattctctctctctttatagaaaaagacactaatcttagaagctgatgacgtcagtaagaatcaggttcttatctggctctaattgtacacagcatcatgcaaaagaatttaatgaacttaggagcctctctgagcttataatgtatataagaagttgaatgaggaaaacgaaggagaaagaggtcactggcccttataagaaccaaatccataggcagataaatgctgcttcacaatactccaggaaaacaagtccccagtgaacgtcctggaaactcagcaggcaagaccacaatttatgtgagaccaggagaaaaacaggcaaagaagagacacacacacagagaaagaaaagatatagaaatggagggaaggaagatggtggttaataacttcaggtagaatgtgacagaagagagcaagacctcaaaacaggaactttttcttcatgttttccatttgttattattaagcatgaaaaactccccaaaatagcacttgattcatcattttcagagctatcacaaggatttcttctatttttctgcagaatagttagcattcaagttatttttgcatgggtgccacagcacaacatgggcataaaactgtgaaaaattaaatagctcaaaagtgtaggtgggcttctgtgaaatttgtgctgaatgaatttttagaaagcagaatgcagtactagaattgctgcacatgtgttctattattaaatatctaactcttctaaattgggaaggataataacaagcaatctgtgggaaagctgaagatctaaacaatacaattctgaaaccaaaataaaactgatttggtattttttacttttttaattgttaaaacatcattgtggagtaatagtacaaagacataaagaaaaatttctaaaaaaaatattgtccatattcctatcatcccagcattaaaaattattatttctttcagtctttatccacaaaaatccataaattattaatgtgcatgtactttttgtgtttggtttcccactgagcattatcatgctatcacaagagaagcaacagaaagaacatttgattttgaacctaagatgtggtttaagtcttggcacacagtcattccttgtatagtcctcataggaatcattttcttagctacctaatatcccacagaattgatgtaaccaattttacttactcttctccttcttcttggacatttaggtcatgaccaatatttcacagttctaaatatcactgcaatacatatttccctgatatagctttcttcttatattctgttttctgtatccttgatataaattcatggcaggttgaatgtatttatagcttttggtacatagtgccaaattgttttccaaaagatttataccaatttatacttttattagaaatatatgattatatagcagacttgccaatattgaatactgtatggttaacgttctcctaatgtaatatatggaaaatgatatcccatcatactatgtaagtgttaaatgttacccgtattatattttaagattattagtgtaagctatcaggagttctgaaagttaataaaattttaaattatagctcatagaaatgtaaaagactatagatattatttaacctagtcttttacccatagagaaatttttgcagcaatatctttgatggagacctgataattatcttacacccctcactgtgcttaattgccctcattcaatgagtcactaagtcctactgtttcaaaccccaaatccctctcaagtctactccagccatcattatctttctcctcactgccatggccttagttcaagccctccttacctctcacctgggttactataataacctctttgccagtatttctgcctccagttcaatagttgacatactgtatgtggtctaaaatttcaatctgatggtgaacgctacttctctgtttaaatacttcaatagcatgttattttcttccaggacaaaatctgaacttcacggcatagcacacaaggctcttcataatttagctcagacttcagtcttatctcacatcagtaactccacaaccatctgccaccaactaatttcatgctcttacaaaccttcatctggacatgtcctgcaagatgcctttcaagggtccactcctccaggagaccttcccaacttcttgtcttcccagcattggttggacattcataacctcattcaaacagattataaacctctaattggagcatttattccattgcactgtgtttgtctagttccacattttcccaaccagcctattggttctttaaggttagaaatgtacttttaactctgtatcttcagtgtcttgcagagtgtgaacccttagtagtggtaaatacatgtttgttggattaaccaataaataaatgaatgctccagtctctgttcaacgtcttccagtggtagtaccttatcaaacagtccatctcattttttatttttattatatttaaaaacaaaaatttttagaagcaaggtctcactccatcacccaggctagaacgcagtggtgctttcacagctcactgtaatctcaaactcctgggctcaactgatcttaccacatcagcttcccaagtagctaggactacagccatatgccatcacacttggtagtatgttttttttttctttagagacaaggtctcactatgtcgactaggttggttttgaactcctggcttaaagtaatcctccctattcagcctccaaaagtggtgggattataggtgtgagccaccatgcccagcctgtttattgtgactttaaaaatcaaagggctcttttaagtttctgctacttgtgactggacaaatggtctgttaaacaaatttaaaagaaaaaaacaaccccatcaaaaagtgggagaagggtatgaacagacacttctcaaaagaagacatttatgcagccaacaagcatatgaaaaaaagctcatcatcaatggtcattagagaaatgcaaatcaaaaccacaatgagataccatctcatgccagttagaatgctgatcattaaaaagtcaagaaacaacagatgctggagaggatgtggagaaataggaacacttttacactgttggtgggactgtaaactagttcaaacattgtggaagtcggtgtggcaattcctcaaggatctagaactagaaataccatttgacccagcaatcccattactgggtatacacccaaaggattataaatcattctactataaagacacatgtacatgtatgtttattgtggcactgttcacattagcaaagatgtgaaaccaacccaaatgtccatcaatgatagactggattaagaaaatgtggcacatatacgtcatggaatattatgcagccttaaaaaacggatgagttcatgtcctttgcagggacatggatgacgctggaaatcatcattctcagcaaactaacacaaggacagaaaaccaaacactgcatgttctcactcataagtgggagttgaacaataagaacacatggacacagggaggagaacatcacacactgcagcatgttggggggtggggggtggggggcaaggggagggatagcattaggagaaatacctaatgtagatgacagattaatgtgtgcagcaaaccaccatggcacatgtatacctatgtaacaaacctgcacatcctgcacatgtgcctgaacttaaagtataaactaataatgtgcaaggtgcccaggcatggtaactcacacctgtaatcctagcattttgggaggccaagatgggtggatggctttagctcaggggttcaagaccagcctgggcaacgtgatgaaaccccatctctacaaaaaacacaaaaattaaccgggtatggtggtttgcacctgtagtaccagacacttggggggctgacgtgggaggatcacttgagcccaggaggtggaggctgcagtgagccaaggtcatgccagtgtactccagcatggacaacacagttagaccctgcctcaaaaaaaaaaaaaaaaaagtgcaaggcactgttaaagcatttgctggcctaaaagatacataaaatagttcatcttgtgtgacttactaaatataatatggataccatctttgacatgtacattaaatatgacgtctacccttataataataggaggaactacaaaactattttaaaaagaaagtgtgaacacttttagggaaaaaaaaatacgtattcaagggtgatgcagaacctcaggtccaatctggctgtatcagagaatcctcttgcaggtcagaaaaggttgtctgaggaagcaaggctggaagcagactgtccacaggcaaaggtgttgatgcatttaatgggctctggcagctgctttcacacatactcagtatggaaggaggaattgaagtagaaaaaaggaggaaaacgaaaggaacaagaaaaaggaaatttgcttaaaggaattaataagtaagcaagaagaccaaggggaagagacattatatcatattaattctataagcataaaaaagcttaaaaataagatagtccaatgccaatgtgatttaattattatgttgccccatttgaaaggaaatactgccttttgtaatctgtctagtgctagccagtggaactttctgctatgacgaccacattctatagctgtgctgttgaagacagcagccactagcgtcataggacaattgagcatatgaaatgcagctagagtgactaaaaaactgagttttaaatttatttttattttttattttattgtatttttttgagatggagtcttgctctgtcacccaggctgcagtgcagtggcgcgaccccggctcactgcaacctccacctcccggggtcaagcgattctcctgcctcagcctcctgcatagctgggactgcaggcacaggccactatgcctggctaatttttatatttttagtagagacggggtttcaccatgttggccaggctggtctcaaactcctgccctcaggtgatccacccccctcagcctcccaaagtgctgggattacaggcatgagccaccatttccagccttaaatttaaatttaaacagccacatgaggctagtgtctatcctttttgaattctgtactcatacagaatgagtacagagaagaattctgtactcatacagaatgagtacagagcagaattctgtactcatacaagatttaaaatataaagaaacttaaacttaaggaggacctaagggacaaattcccctgtttgggagataattaaataatatttgtattggtctttgcaatttatactatactttcatgtatttcattgaattaataagaatatagaagctaaagatgaatgtggagtctccatcaacagaggccataagaaaggaatcatagccctgtgtcttcaccaattagaatgtgattctcatggagcaaagcccttactgagctatattagataggaaggagacaacagtgattaagaatgaagactctcagccagactgcctgtgctcaaaacccagttcctatttcctggctgtgtgatcttactgaagctacttaacttctctgtgcctgttttctccttattttaatggcaatagtagtagtactgacctcataagagctgacatgagctatatgagctagcacatgcaaaacagctagaacagtggctggcatacaaaataaattgctcagtgttggttagaaattaaccaagggatcggcagtcctacagaagaggaaaacctcttttgggaggacacactgctctggtcttgccgagtcctccttctgactgtgatatgtttttgcctcaggaatgtcagatgaggtctcagacaaggttctagacaagggaaagcacaatattaaacaaataataatgatgggtcttcaaccaagttttcatttcctctgataatccaattccatcatcctatcagcctaattgttatcctatttagttttcatggccacttttccttctaacttctaatgggttacaaaacatagttaagattatgagctgataattcctatcaattattaaatgttttcatgtgagccgagtattataagtgatattcatagtcagaattcttggagaccgctacttttcaccttgcaactgaggtgtattttgtattcataatccttgctctttgctatgccctggcctgttcctgaactctctctttgtctgcttttccaagcctcctctgtccccatccatctggcactcacataccccctcacttctgcttccacctctctccagcaggctcactgcttggtgcagatggagagatacttttgaagttttcaggaaatcctctcaagggcagtgaaacaatttgtctgtgagcagagatgatactgaatgcattggaatggaggtaaaatttagaatatccaagggaaaaatgcgttagttaaaatagaggatgatttttaaaataattttcaggagtaatgggaaataaagattttcaaggtgtgccagagctaacaaaccacagcatatgacaagagctcctacaattgctaagaaataaaatgcaagaatatattttattctcttccaaatacaaattcaatgatgtgctttgaatcagtacatgaaaatactcaggttgcaaagattctgtgaaaaatggtaatctctaggggcttatgcattaatccttacctgaggcatgcttttgcatgtttagtataaattattctttataaaattgcactgagcataataggacatgtagcttgtaactaggttaacaaacaatagattaatagcatttcatatcattcacagataactaaaaagtcaaaaacccaaaatattaataaagaatttagaaaacattacttcaaatagaagtcaaattcatgttttggaaaatactagtattatctcaataatttcagagggcagaagtctcaccaagacaactgaacaatgtaaatatgtctttataattcttcattttctagtttgaagttgtaaaaaaaacttcataggaagaaaaacacagtctcctgcaacaatgtgagttactaatgagtccactgcttcctcaatctcacacaacattctagacaaatgcctcagccagtgctattgagtgacatcagctcacattgcaatatattttctgatgtgtataataaattacaaatacttaataatttatcatggttgctttgagagcatcacacagcacttagcatctaactcaaaataactattgcccttctcacaacaaattccaaagccctcatttttctacttactatgctaattaacattccttttaatcttcttctttaatttatcctgtaaattttaaaatagcatcttagaaagaaacttaagggtaatcttgggtcaaccttaccagtgcaggaatctcactagcatctctaaaagatggccataaatgattttttctattctcaagactgttttatgttggttggtaggttgactactttgtttagtttgcctttgctatgagtctttctttagaatctattaagttaattgtggcattcggacatttatttaaagggcagtggaaaccaaagtgtgtaaaggctaatactcctcaatgccaaaagtaaggaagttaagaaaggtcaatcaatgattaaattgtttatcattagttaatataaaataaaggatgtatttttagctgacaaactaaattcaaggttggcactacacaaaaaaaatcacagacaactgaataaagaattaccacagtattagttatttaagacacgttcctgtgtatccatggttgatcaacacacaggattctgagaaaaattattttataaaagcatggtgctcaccttaaagagtacactatcttgctagagaaaatagacatacatattaaggcatattattgcattcaaagggtagcaggtaaataatatacaaatatgcctagagactacaaattaagtttaatgaaatgagttaagcactttcttctctccactttcttggagaggttcaggtcttacaaattaggatatgtgaaaaaagaataatagtcccttatagccaggcaggggtgaatattataggtcacataaagaagaaaaattcaaaagaactctcagaaatgaatttgtgtgattcagattgtggaggcaagaaagagagagatagatggattccctcaaatgtccgattaagacaagattggctatgaaatgaagtagagatctcaggttgtggagttatatcatatcaagaagcagtaagttaagagagctgtcagagttctagtggctgaaacctatccctatccaggaaaggctaaaaccagaatgaggatgactctgatagtgaaaagcccaagattctttctctaaggaattatgtgtgctgactcctagaaagacccatcctctcacagttacaagaatgacgccttcagcatcacaaacacagctgcaatgtggcttagcccccagcagaatgcaattgacagaaacacatttatcttcctctcctccagaaaatatttttaaagggactggattcaaagctacagaaaagcaaggggagggctcctttaggttgtacagtcaggtgcgaagagcaatgcaggcaaatagtacatcctggaaagagttaagaacatagattaaggattggatgaatgttatctggaaatttcctctagtcaggtaaaagctgaacacaccaagctctatgacttggtccagtctctgttccgttcacacttcactggctacttttaactattctctatgtagccttctctgaacccacatttaccaatcccaattaaattctcacagcacctggtgttcttagcactaatcacagcttataggtcaataactctggacataccggctgataatgtaggaggacagtggggaagtcaagggctctgtgctgtggagagaaatgctagggttcaaatcttggttccaacaattcctagttgtaaataaatgtatttcatacctcataatgttattgtaaagattaacaaccagtacatgtaaaggatgcagaaaaatgtctgtcatgtaatatgtgctcaataaatatggggtaacatcatccatggacccatgagagcaggaaccatgtctgtttcattctctatcacctctctgggactagcacaatgtttgggaagtagcagagcttagtgaatacatgtggagggcatgaatacttaatcacttcattctttgctacccattaagcccttgatatatttgttgatacatgtttactgtgtctccttattccccagttgctaggggtaagacattgttccttttgtatgccccacacaactcttcatgatgttgatacttaaacttaaccaagttctttcccaaatacttaaggagtcagatttagagaaatgtggatggaggcaaaatcccctggagttctcaactgtgctatcaagatgcttctacattataaaatggatataaaaatacatagctctagtatatatttaagaaggcaaaaaaatggtttattcctctaacttatcaactgagagtctttcagccacaaaatgtaattatttagccccactctaaatcattcataaaaatgttcagtgatgggtctccacagcatgcttatgactttttaaaattgattttaataatggtgtacatggaggttaaaccacagagttaaaaatgaacatactggcaatatctaagccagagaaatagcaatacaaaaaaattgaaaggcaaatgaataaaatatatcttcaaatgactggcaatattaaagtcaaaaaacattaaatagtatgagattacacttaagggtcagagacagaaatctcagattctttgtacctgtagttagggtcaaaagagagacagtaaacacttacatgggtcaaatgagacatgggcagaaactagaatggctggttggtaggactggatctaaaggaggtagtcttttctgtgatataatttctagctttctgagagagtctttgccttcataagcaatattacttagcataaatctcacagttagagcttaatttctttgactaagatagtgtatgtttctcaaagaggaatactttgactccttggaggtttggagccatgtgtcaaaagattgtgcaaagccacaggataaacatagcttattttcctgcaaattatgtttttcttaaatattggaagcatagggagatgaacgttttaactggtagtaatttagatcattcgtttatttaacaaatgaataaattatgctgtagaatgcaaatcttgtacatgtaaagaatgcagaaaaatgtctgtcatgtaatatgtgctcaataaatatagggtaacatcatctatggacccatgagagcaggaaccatgtctgtttcattctctgtcacctctctgggactagcacaatgtttgggaaatctcagtagaatgcaaatcttgcattctacatttttaaaaacaaagcatgaaactacagagaggcatcatgtttgtgtagatcactttagggtacctagggctttaggttgaagagggaaacttccatggcaaagacgcaaaaacaagagggaaaggaaatgaaggacacaaagacacagttcactgttttggctgagacccagaactccttagctcagaactactaacagcaaaggtggcagagataccatggtagagtctgcaaaatgcaaacttactagaactggcaatcttcaacacctaggcaggatggcagcaactaaagctcacaaaacactagaaaagtatgttatcagagttgaggagatgctatgtggacatgggggaggagaagaacaatttcaaggtctgaatgagacaaaggccagagcatcagatctgcagttacttgtcaactcactgaatggtgagggatgcaaaggcacaggtgtgcacactagcaaggttcagaagtgaattttgacaattgtgtgttagagatgataacagttcaactgagatgacaaggaaattgcttatagatgtccacatgaacttaccacatcagaaaacaatacatatgtatacctttgaaaccacattttccaaccctactcactttcccaggcttgatgccacctctgtgttttcctcctcctctcatcctaaataaaccttgttcctcaatataaactcagaaagcagtttcgtctataggttcagtgttttcaggggcagcagagattcagacagggtaagctcatcatttttacctcttcattcaccagcgtaagtgtgcttgctctcagacaaacattaccactaccaagcctgaattactctatctgggctggcaacaatggcagtattaagaaaagataaaaaccatctaaatcatgctgcttggaactagttataaccacctttccagacacacagatacgtttccatgattaaagtataatgtggttggctgaaaggaactcagaaaatgatcgatatttgaacttaaaacgtttgatcacttgtcctgtgattttttttcttaaaactcaactcacattgtatttgtaagaacacagggaaagagctgagtaacaggacctagaggagatttttctttcctatcacttttcatgatggataggctccttaggaaagagaaagtatttaagggcttgccacgactccagtcatgttttaacctcattttataacccgtcaataggattgtgttacagactatctgactccccccactatccgctgttcactctcccttttagttatagaattccctgaattttatttaggcaaatggctatcccactggagactacacctccctacttccaacagccttctttgcacctcggagtggttaaaggactaagtcttggccaataaggtataactaggaaggatgtgtatacctttcagctcatgtttcctaaggacaatgttcaccctccactttctctcccacttgccccttcctgcagactggaatgtgagcaggattgtgggagccagtttcagtgctgcagctgagagcaacccccggggactcagcagagtaacaaacagaaggaatcggggctttctctaatcaatgttgcagagaagaagtacccacccatcctgggccacctacccaccttgattgagaccattgggtaaaaaagaaagaaatttctagcttgtttaagctactttcacaaatctctgttacagcagtttagcctgtattctaatatacagtttctacctagaagtgggtattgccataacaatatctgagaccagggtcacaggctgtaaggacagagatacagatattgacagctggaaagctgaggactcctgctagaaaagccaactttttctgttccccaagcagtacaaggtaagactgttgctcagagcatccttcaagaatctcctatattctcctaggccacacaatggcagccagttcaaacattcaggtagggcaggcctggatttcccattcgagcctattgcttcagatgacctcaaggaagaagcccttaaactgagggagttaggagtgggctaccaaaccaataaataagctacaaagccaataaatcaaaaggtagttaaaaactacagccaaaggctactttaatgtggaactggaagcagacagactggaatttttgcgggtattacattgccaaagaaaacaaaaacctggctgacagagctagtgactgttgaatcactaaaccaaatctcaggttcccaaacctgcaccagtagaaagcaagctgtacaaggagggaagctaccaatgagggcatattatctaacacccaccacagatgtggccacaaaagacagaggccatcaaggacaatggacagggagttatacccagagagtgagtttggattggccaagatgacctaataaagactgccaagtagttcttgcccagagaaatgtaataacaacaacaacaaagcgctaactcctactgactagattatgctgtttgcctcctcctcttttccctttccaagtagggatttcatggcagataacttgtcctttagtgccggggtcactggaggcacatccaccctgatagagaggcctagacatatcccagagacctggactctcagctgggtgcagtaaataaatgggctttggtttgcctctttgggaagaaggtgggcatatcctctacgtgggatgaagggtaggaagggatacttagatgctagggagacaagctgtgaacagagactattcattatctcccatgtccattcttctcttgtccttttagataaggaactaccagaaaggtggctcagtaagagcctacatttcataaccccctcttgtagctaactagacatggtcatataactacattttggccaataaaatatgaattttagccaatggtatacatgtttataaaggaaattttttgtccttaactttctctgtcccttccccttctctgtcccttcccccttcccatgggccagaatgcagatgtgaaggagggtgccaccactgagcacatggatggggacagttgcctggggatgcagagcaatgagacagaacctgagtttctggtgacttcatggagccaagctgcctaccctccctgaaatgccttcctaaacaacatctatgttgtttgaagtattacattttgacatctaatttttacagctgccaaacctgtaccctaattaatataggagaaaattggaaagcaaagtggtttgagtgcaaagtctatatattgtgtatacatatgcatgagctaaaggtgaggacctagaaactgtcactttagaaagaagaggtggttataagataaagtagtaagtgcattaaaatccagcattcctcaccaaagcatagctaagaaaatccatttgaataagtaaaactatattcaacttgaaaacactttatcttaaaaaaagaattgtaaaattaagacaattttcttctttttcaatagtttaaagctaatagtaaaatatcacttgatcaactcaagaaggaatcccataaagttatctgaattgataaatggttacatgtgcaaatatttagtaacaaatatcagaaaataaaatcacatagtatacaggcagttaagtgctctgattctgaaaacagatggatcgtttatacatcctagttctcccaattacaggcaacctgaccttcagctacttacctagactctctaagcctcagctgtctgtgcttcagtttcctgtggatcaaatgagataatgtacaaagcacttggggcaatgcccagttcatagtatgatttcaattaattttgtctaaaatcattgccacctgattgtaaaaatatctctatcaatcagaagatgggcatcttaaccatcattgttctatgagactgacctctttctcaggttggcaagccataaaatgcccagtgccttgagttttaatgaaagacaccaattcaatcagggcattcactcatttaccatgtgtattgataccttagcatgaaaagcatgatcaatgtgataaaataaaaatatacttctaggtttgagaagccaattcccatgtcacccttatttagctgagtccacctaaataagaacacccagtctttgaattatcactccctaattgactgatattggacaagtctccacatatctttgagactaggtttcctcatctataacatggaaaaacaatatctccctcatgggttgctatgggtattaaatgagaaaattcaagcacctggttactactatgcctagaaagagtaagcattcagataatggatgacggaaactttattactgctatagttatggctacataaaatagttaaatacctcatcataagaaaattgtgcctgcatgtatttgagacccactggttgtagggtaaatgctttgtgctatctgtctcatcatactgatggcccatactgaccacacatattcattctctcccaatctcagtagataccaaaatgctatttttgcaagcctgttgtccagagatgggatgtattcatgaaacacagacttcctccactctgtgaagtcaaatagcttgcatgagattgcatccacaacattgtttcttattagtgtcacattctgttcaactaagttgaccactgcaggctaagtgataattacagcaatgtgtgtcatccagtatcctccaaaacttaatgattttacaaactaaaagtatatctgcaaagaaaatgttatcttaaccttcagggagctgattgggacaatcagtgtaatcattttaccaaacatccagggtggaccaggggcctttatctttcacctgtaacatgaagatgaatctgaaactaaagcacatgcttgaaactgaagggaaaatgagtctttttcttttccggattaaaatagaaccttcccactaacccccacctgcaattccaattatttatcccatttctatcagggcagaagctatttagcatggcttatttaatccattgttttatctttattttttaaataatcaattttgccctggctaatgcatttacagtgtttcctcttgcaggtttctgatatagtcaccacccaggtctgacctagttttctaagctgatttttctcagccatggagcctcttgctgagtggcttcacagttcatctgcttccattccctaatgccatggtccctgagaccatcttggccgcatatggtgggcactcactggaatggttaaaattgctaccctcttcactgaggcctcagaggagtatgtaggtccaactcacactgctcagcagtgtcagagctaagaccagaatccatcaactttgttgtcaccatgtagacaagagcccttgatcctccatcactcaaaacaaaattaaagatgagctcccaattgaagtgttctactggtaacctcatataggcacagacttattccagaactcctggttatgctataatatcccttgctgtcttctatgattgtcatttggggtcaatttgttgttgttgttgttccttctcttcctttgaggatgcttttggatttgtccagctggattgtttggtccttggctggttgtcccggctaagagcccagcctggagccagtgcccactgtgtaagcaatgcagatgacattgtcgaaaaagggactctgtagagcattgtttgcttagttggcccctttctagctatctgtttgcaactaccttgataaaaaggtgctgataatgagggacagagttttatacattttagttaatcatctccgcagcaggtttttatacaggatggtgatcaatgttgaaattctacctatctgcccacactgactcattagtcatgagcatttgtcatcatacatggggacttcccagtgccctgcactgctttggccatgtgcttaggaaacactgggccaaaggacatctatccagtggacgttttcaatctcagcagaaacaattctaattctgcacttcctgaaataaaatcttgccataatcaaagcaagaaaattaaatcccttcctagaaataaaatatacttatttgaaagtgtttcaggccttgcgcggtgactcacggctgtaatcccagtactttgggaggccgaagcgggtggatcatgaggtcaggagatcgagaccaccctggccaacacagtgaaaccccatctctactaaaaaaaaaaaaaaaaaatacaaaatattagccgggagtggtggcgggcacctgtagtcccagctacttgggaggctgaggcaggagaatggcgtgaacccaggaggcggagcctgcagtgagcggagatcgcaccactgcactccagcctgggcaacagagcaagactctgtctcaaaaaaaaaaaaaagaaagaaagaaagtgtttaattagcagacaagttcgtgtcatttttttaaatagttaacttttacttccagaaaaatagcaaacaagataatactcaaatgcaaccgtggttgcagaatctataaacccaaaagtctgagagatttacaaataatcaatattataaacaaaaatcacatctacctagaaacatttcttttaaaaaaatctgctggcaagtccctccactcttacctcaggtgggccataaatattttcttccaaatatataggataaccagaaactttctctttctttaaacaacaaaaattggtttataattaaaatgcactttggcatacctttctgcaatattttcctcacttgagttggagtaaaaacttgagagaattagcaaagcctgttaacctcatgaattgggtagtgaatttggcaaggtgacttctccagactttcaaaaagaatcaggcaggaaaactactttctggatgttttgattacatgagcaagcaaatttccaagcatctacactcccaataatcaagtgatagtatggaaggccatcgttactatattgagaacgtacctattttttaagtgtcaaaactgcccgataatgaaatacttgccgtgtggtccaagataaccacctggcaggcctacatgctattattttttttccattctgcatgtcttttgtcctctcttctttatatcacttgcccacttcagactatgaaagttgcttgagggctgagcccatattgccaataattcattataattggaagcagtgggtgcttaagcactcattacctgacaaggaacatcacagtaacaagctcagtttagaggtcagtgttaacaaggccaaggtcctagacctgagatgggtggatgtggacgtttgctctgctccatgacaataagccaaataccttggtctgtgctactgctcgcccggcatgcagcagggaggtgcagagcatgaggagtatgtgaatgtcctagtccaagtccccagtgcagctaggattggagaagtataattaaatattgctcagcccagaagaatcagggtgtggtccaggtcagaaacaggcagagtgaagatgagactcaccggtgctaacctttctttcctttgctaacacattcaagtgacagccacacttccaccagtagcacagactcatgagaactggtcattaaacagagagtactctcactgggcaggtgaagggggatatgtccattattgtgagaggttcatgttttgacaaaaggatcctgatactgatacccaatactgagttgaaattcagtcaagtagagcggcacatatgaatcacttggggatcttattagaatacaaattctactcaatatgtctcaggtgggacctgactaataagctcccaagtgatgccaaagctgctgggcctttggctctctctttgaaaagcaagattctagattttatcagatcggcaggtgtaagggaatcctggaccccatgaaactggaggttcagaaacatctgaagaaactgacaaattactaatggtcagagtcaccaagttttcaggaatccagagatcacaccagtcacaatcactcaaaagatgccagaattcagtcccaaccagtgccctgggtttctgagtcccttttttctctctccactacccagagcaagcagccagggactgtgggacacatggcagagccctgatcttgtgggcacaggcagatcaaagtagctaaagatgatgttaaagagacaggtgtggtaggcaccaataggaggctaggaagtcaaggtcctccaatctcagacccctgtcttaagggtaagatcaaaggctggcacaaaacttacagatcattttatacaaaagttggtatatgcttggggccttgtgggacatcttctccatatcaaatccattaaatcattggcccagactccatttgtctttaacaggaaggaatagctcttggggtgattcaaggtgaaaccttatccatttcttccctctctctcattgacgccgtgtatgtgcaaggtggtgaggcagccgaaattaggactatagagtccttcatgttcacagaacaagtgctgcaaatgggtgtgagtcagccttgagctcaatcgagagtaaacagacaaatttacattcatatatggatttagacatttgtcaaatatttgctaaaagagcatttcacttgtcgaaggaaggcatagccttaatatttttctttctttctaaaggactcgtttcacccacgtgcttgatgaaagtttaaatataaaatgcctgagatgaaaatgtatattaatatttttctgtctttccaggtagatctgctgacctccttcttgtgctaaatctattaacaagcaaataaagctgaggtccttagatcagtactatagccaagagatactaatagtacccatcaaaatcagatgttaagcctgtccagagagctcctggcaacctgagagactaagctgacatgggcattcctctgaccaccaacaatggaaaacaggatcaaacatatccaaaataaatcttataatgtgatctgaaattaagagaaagataggaggttctcagaagccatgaataaatacagaagtaaaagtcaggaatatgaggtggacctgggctgcatgcgacatcccaaaggtgtatttttcaagaatacaggccctagaggctgggcctggagtcctggccttgggctgtggcccagcagagaacctaaactagatacttgacccatgagggctgcacaggctttgaggagaggattgggaaacccccaacgcagcccagggggctgaagcaaagcttagtttctactgtaaatatataaattattaaagatgttaaacagtagtcaaaaagaggtttagaagtgagatttgccagaatccatcttaaatttcaactgttccagaatatagaaaaacaaattagccaaagtttctgttatgacctcaatacccaaaagataacataaactaagcaaaaagagaaaccacagactgaaagagaataagtgaatgtaggtaagacacagataactagtctccaaaatacataaagaacttacaaaagtcaggaaaagaaagccaaacaatcccatataaaaatgaacaaaggatatatattaatacttcactagcaaaatgattctaaaatctagtaagtagattaaaagatgctcaacttcaataataatcagagaaatgtaaaatgactaacaacgtgatgtcatttcacatccaccaggttgagaagtattaataactcaactgtgagttaagatatggggaagcttttatatccttctggtgggtgaggaagttggtaccaatcttttggggaagagaatgaaaatatctagtaaaggtgaagatgcagaggccatagatctataaattacatgtgtagatgtttactctagggaaaccctgacaaaggtacacagggagccatgcaagaatgtcccctgcagaaatattcacaatcgcaaaaaaatacaaaacctaaatattaataaataagcaattaataaatacatggtggtatattccaatttatagcattttatttctttataaaaggaaaatctctatgttacaaatatttctattacttaatcagagtgatggatatagaagtttttatttgtgttttctgtattttaaaacattattttatacaggttgagcatccctaatctgaaagtttgaaatccaaaattctccaaaattcaaaactttttgattgccatcatggtgtcacaagtagaaaattccacacctgacataagacaggttgcagtcaaaacacagtcgaaactttgtttcatgcccaaaattgttaaaacatactgtataaaactgccttcagtctatacatataaggtggacatgaaacaaatgaatttcatgtttatacttgtgtcccatccccaagatatgtcattatgtatatgcaaatattctaacatttgaaagaaattgaaatccaaagcacttctggtcccaggcatttcagataagggatatacaacctataattaacatttaaataaaaatatattataaagtctacctagagctatacattttgtcaagggaagttatatctccccatccctatgtagagatgcacacataaaggcctggaagaatacacagaattattaatagtgtaacttagggaagaaagtagaacagtagaagaccaaagaggaaattttccctttactctgcctaattctgtgtttttcacatatttatgaacacatattcatgtgttcaatgtgattgcagtgaagcctcaattaatgtccttcctacatccacaccctttgccctgtaattttgcattcttccttctgattctggctggccctgtgagttggtttggcctacagaatacaaatgaaatgttgatgtgccaactacaaggttaggtctcaagagactgtcatggttttccttgatctccctcttgcagttagacttaaacactcttagaaaaagtctggacttggctaggcatagtggctcatgcctgtaatcccagaacattgggaggccaaggcaggaggttcacttgagtccaggagttcaagaccagcttgagcaacatagtgagacccccccatctctacaaaatattacaaatgtagcccagtgtggtgccacctgtggttggagctacttgggagactgagatcagaggatcacttgggcctaataaattgaggctccaatgagcctgagctgtgtgccactgtacttcagcctgggtgacagagtaaaactcagaaaaggaggggaggcagaaaaggaaagaaaaagtcaaaagaaaggaaagaaagaccaggacttgccagctggatagtgataaaccatgttcaggagaggctagttatcctagccaaagctattctataccaacctgtagatacaagagtgccaagtcatgatcaacagatctgcctacctgacccacagtgactacagacccaaactgagaccagagaaatatccagcagacctataaactcatgagcaatagtaaatgcttattatgttaagccattgagttttgggatggttttgttatacctcaatagttaattcatacattcatcagatgtaaaatttttaagagtggaaaacaggtccatccatttgagaaaaggtgacctgctgattcatacctagacacaatatataacaattccaagcctttatgattcatgtcatcattagagtttgacatcagaacttgctctatattgcccacacactgtccagtttcttatctggaagatgtgtccttcatcttccatgaagctggagccccactaactgaggcttaagtgggttattttagcacatcttctagcatggtgtgtcatgtcaagtaccctttatgaggcttcatttactcttcatttaccctttgtgatgctattcaaattgatgtaggaaaaaagacaacaaacaacaaattgtccattaacttgtgctgcatttggcaggaaagtccaagccaatatgaacataaagagtaatcaaaggtgtttaatatgtcattaagtattctccgtactgagccaactgtgaaacagaagcttggagagtaacattaatactttgccccttgtatatattatcagtcaatattattcaacatattgttttagttgtagagatcaaatgcttggtgcagcagaagggtacaaactggagactccagaggctgcattctgcttcagaccagtgctgggattttgagcaagtaacttaatttatattttaagtataacttgtttatcttaatgtatatatattgtatatatatgcacacacatacacacatatatatgtatgtgtatatatatacatatatatgtatatatgaagtaaagaggctattggacttatttcttaggttcctcccaatatgaacattccaagagcctgtgacagtgaaacaagccccgaggccttcctatcataaaacaaccttttcattccattttggtctccatagatttcagtgtcctttctctcagtcgaaatcactcacttcaaaaacttggactaacatcaagattttagccagaagcaagctgaaaagtagttgccattggagactccttaatacctcattgttaaactggctaatggtgctctaaggatgagccgttagaggaaatggtcaagatcttcatctcaagggtgaggaagctaaggtcctgaaaggtcctgtgatttgccaaatgtcagacagcatcctagcaaagagggtaagttctacttttaaggtttgtgattccagatccatccgttaatccactcatgtaagatttgtcgaacacttacagacactatgctaggcgctagggatgcacagttccaagacaaacctgttgccctcatggagctcacagctcggtggaagtaaaaaataagagaaacactattgaatcttgtcacacatgattagacaggaatttatgggatgctctgagaatccagaggaaagaataccttactctgcatgaagagacagggaatttttcatggaggaggatataattgagctgcattttgaaaaataaggagttttgaggcacacaatacataagaggaaagggcacagaacacaggacatgcaaaggcatttaaacacacaaatgtacacacagatgtgtttgggagactgtaagcagctggatatgcttccatctaggatgcaggctgggaatgtcaggaggcataaaggaagaaataggcaagaacagatgatgccaaggaaaggagttttgacttttgtctagggagatgaaggagccactaaaagacaggtagcaggcatggctatccttgctttcaacagacagcatgtccctaaagaagagaagatgagaggacccagttaggaaaggaaggatagcagtgggcggctagtccgtgcctgctgctctttcctctagtctctgttggatttccttcactccagcctcaatgtgccattcatcatcaatgacgccatcccctggggaagcgctgtagacactcgggattctcagatgggccagcccaaggaccacagcctactgccactcatggctggctcagtgcgtaaatgctgtcctgaacccaagagaagcatgaacttgggggaaccccagagacccacagtaagattcaaccacagatgagtgtggttgagtgacactaaggtagtaaatattctaacagatataggttaaatttcaacaggtggtttactaacttggtaactgtgtgacttcaacaaggttatttcacttctccaagtctgaaggtcctcacctatcaaatggagataacactaacacctaccttgtatcctggatttattgaaagaaattatgcaattaattatatttcatctgtgcattcctggaacatggcaaatactcagtaatccataattataattattaacatttagcatcatgcagtcaagcaccttgcctatttctagagaagcttggaacctgagacatggtcctaaaagaactctcctcaatatcacactcccattctctcccctccagagacctcgaagacaaaacattacatttaaaggcctcttccctgatccacagcagcatttcttagattcttatgaagcatatttaggttaagataaataaaatatcagatctacccttggagtagctaataaaaaattttaaagtgattttcttccttctacctccaagaagaccctcttttaaaaggtgcaatgagtaccagaatcaaaatatatattacaggtttatttttcatatggcaaaagcagtatgcctatctctgtcctcgaatatctccatggttttgtgagttaagaattggagttaagaatgtccctttagatggaaactttgctgaaattttatccactcatttattgcccacatgagtttaaaaatgagaataaagctagatcttttacatcactggaaattttcttatgtctcagcaccatccagaatgttggcaatattaacagaccagcaatacttcttgcataatggagccagaggaataaggaagggtggggaggaggaagggagcagaggagagctttgggagactttccctgactaattcttcttcaaaactgtgaaacttacaatttctaaaaaccatagtcatgatgaaaatgcctcctttaaaactgcagccttagaggaagcctgtaggcttctgtcgagtattttagatcaaagacgtgggtttgaagttgaggttaattccctcactttgcagtaccactaaaatgaacatcacaaataaggcctgaaaagcaatggctcgattccttgaattaactctatcgtttctaggtaagtacttggaaaacactgcatttacaaaatatatagctggttgaggacccaggtgattcaaacattaaaatttactgagatttctgcttagtttgcctgtctgcttattcaattttgtttcacacttgattaatcagaccttaggttgaaatagccaaatgatctgatagagctttctggtaagaagaatagtactgcagaaaaatattcacaataaaaattgagatgaatgattcaggtatgtggaatataacattctgtttaaattatacatctgttgtcaaaagatacatactttgtaaataagtatagaaaattatctggaagaattggtactagtatattaacagcaactttctctggttagtaaaattggggatcattttcattttatttttatctatttctctctctctctcagtatcgctttgaaataaagacagctatttttttaattccaagtgttttcaattgtgtatataaaccaaagcatcaaaaacttcagcttagagtaaaaattagtacatttaagagcaattggaaacacaataatgattatagccagttttagcttccatgttccataccccatgctaagcatttcccatggcttgtctgtaaccctatgaggtaggtattcttatcattcctattgtataaattagagaaacttaggcatgaggatgttaaataacttacccaaattcaccgtactagtaagttgtaaaagtcaaaaacttttggtggtccagaccatctgattaacttctattttgttctacctggattgatcctaaatgcagcagctacatgtagcagctttgtccaagtcttttttttttttaactgtcttattcttgcttcttttataataatattaaacttccttagtctgttaacgtggcacacctatctgcaagggaaagtggtacataaagaagatattgtcatatatctccaaaatggagtacaataatgctgtaaaaaagattaatgaagatctctttgaattgttacaggctaacttccaggatgtactgttaaggtaaaaaaagctaagtgcaaaagagtatctatattatgttactccttgtataagaaaagtgattataagaaaacacatacataactgcccatttgtacaaagaaaatatggaaggaactcaccagaaactaaagaaactatctacagagggcaggtgtcaaagagctggaaagaagacggaaatggttatgtgtatcaagacaggatggagtgacagatactgccttgggtgcatcattttgtaaagctctggctcttagaaccacagttatgattcatatttttcacatgcccctaagcaatcaacaactaaaactaacaatgatgaggatccaaaatgcaatacaaaaataacaaataagcctgttacaaatgagttacaaaactacactgaaaggatggggaatagtaacactaacctaaataactacagaaaacagtatcttgactggataccatgaagctaaagacaaatacaaatgcataaatgctagaatttagtcagtaaatatgtttctcgcaggggcataggatagcaattctaaaactatgtgttcactagaatcaaacaaagaagtaaacatatcatggaaaataagcagatttctcactatttgagaaataaattacaaataaagacaggaaaaagctaaaagtgaaccctgagtttacagtatttagtataaattgtatagtacaaatggctttaaatatctatatagacatatagataaagaaatatagaggtgtgtatatgtgcaggttattcatatgcatatatttcctggctctgcctgctgagaaggcttagagcaatgacatcccagtagtaataagcacatctagcatgaagatctcagtttctaaacaccattctctgatttaaaaaaaagaaagaaagaaagaaagaaaaaagcttggacaagtgattgatttcaggactagagcaggaggaaaaaaataagcttagaatatagtgtgaagcaaaaaagtaagaaagtgttcaaaaaaataaataagggcttaataagagagcacaaacactaaatgaaaataagctcctaacagccaaagctggaacaaattaaacaagttaaataataatattagaatatgacccataaaaccaaataaatatatataagttcatacacatggatataaataatctattatctaaataggagagaaagacagctcttccatggctgtagaatcccaattaatacatgttgaaagaaagaaggaagtggaaaatcaccattaagcaaacaccataataacaattgtaactagaatcaaaatccatggatgtatgctgaaatcatttgttcacagtctaaagagaaacaggatttgcacagtcttaaagcatgtcccccaagatctttcttaacagtaggagaaaagatactaactataaagtggagaacccagcagaaaccaccttaatcaagtggtcatgatcaacaccaccactaataaaaaatattggcatcacaaatcccatgacatgatgtgctgagaagaacacatcatttctgtggaattcttgccaaaaacacataacctcaaaccaagcatgagaaaacaccagacaagcccaaattgaggggaatttggcaaaataagtattctatactcttcaaaaatataaggtcttaaaagttaaggaaagatgagaaactgttacagatttcaggagactaaggagaaataacaacaaaatgtgacatgggatcctgaacagaatcctggagaataataacaatgaaatattgatgaaaaaactggtagaatttgaataagatttttgtttaattattggtattatatcaatgttaatttctgggttctgataattgcactccagttaagattttaatactgagggaggctagggcagggatatgtgaaaattctccgttccatttttgcaacttttctttaaaagtagtttgaaatttaaagttaaaagaaaaggtattgcctttacttcaacataattaaaaatgctttttggaaaagtaaatctcctttgaagagaaagaccaggttgggggagaaaaaaaccactgatgtgaaaattataccggggaaaccacactttgttaagtttccacttttggatacttatgatgacttaagaatctatatcaacaattctgtcccttgaattcaacacactgaggttttattcctcagctataatcgatcttaatttttcagtttcaacagaaagacatctttccctcttgcaaagaccgtggccttaaaaagcttttgtcatttctcagttgtttgcaactccaacagtgaaataccgccactacatttgatttttggcttaaagaaactctattgctaagatggacgacttgggcagtgtatttcacttttgtttgctgatgtgttgcatttatttgctttcacttatcaagaaaagagccaagtttttttttcttcttcttctttttctactcctccacctcattctctcctgtttaaccatgtgtgtcagaaggagagctatcaaaaggaagctatgcaagttaatcagtcagggcctgagagtgcccaggaaccgtttgttacaacagcaaagggaatgaagcctccaagcaacaaactaattaatacctctctcttctttgaagaaaatgacccaatattgaactccagtggattatacaacattttaatttactatctgctaaatggatgactactttataatatgcatttctacttattcatttactgacaacaccagtagtcattcaaattgaaccccctggccaaggtctaagagaaacctaactaggactagaagatatttaatatacactattatatactcatgcctcttgtttctaccaaacgagatgccatatggaaagaatgttgcacaacgctggcacacagagcagccaggaacttttccttgttgctttcttcttccctgcctctacttctcttcatgttgttattggtaaactgtttgctaagatgtactttccagataacaattcagaaaacaggtaggagacacacacccttagaaatatcaaaggcaaacttccttggaagtcaagtgaaaaactgctgaggagttaaaaaggcagcatggcaaggtcataaatctcactttattgccagtcacggggacatgaaaatctgaagacccttaagcctttcccctgaatcctaagacagtagggctacatgccctggaaataacttctggctcaaaatggactctgcaaataatccaatgtgttcctagggttgctaagtctagcaaatagcaatatagggtgtccatgtcccaggcgatatttgggacatacttatactaaaaattatttgttatctgaaattcaaatctaacctgtattttaattggtatttcccttcccccttatgagaaataggtgactaatgctacaatttaatttccagacctggacttttatatagattcattactttctaactgtgctactgaagcaatttaatgtccttactgtacatgtcctcatctgtcaactgagataataataacaataactttctcatagagtggttgtgaagagtaaatcaaataatctatacagtacctggaatatactatgtattcaatacatgcttgcttttattgtaattactgcagtattactgtttgcattaaaaatatttgttgaaagaggaaacaggttaataaacaaagtttagattttatcggaaagacagtatctttgctaagcaaggtagagaaagaagaagagtctgtgaataaattaagaatctctaaattacactgtaagattttcctgtaatccccaaataataattactgtcaggcttcagaatgaggagagcttgcagaattttcttgcagtgttttacacatttcatttttcatttcaattcagaataaaaggcaaaagaataagagtgaaacaactaagataagcccaaacaaaaatgaggaaaaggtgtatatgtaaattaagaacacatttattactagccttttttaaaaaaggaatgacagtgacctctagtaaaatatttctgtctagaggcaagattacccatgcctggataacagccaatgtttaagctcttctcttagaagtgtcctatctacctctcccaccttcatttcttcaagaagtcagctaagaacccatcaacaccaatacaaaggctgtaaaataacattttcctcttggctggatgcaaaaactagaactgcagaaaagttctcaataaaaattgtttgaatcgctatcaactcattctttctgctgactaggaagttaaataaataaataaataaaagggactccaagtcaccagttacgccagcagtttgcaaaaactattctctcttttgcaggagcaagggtcaacataaatgatttattgtctttatagctagtatttataggtatttgagggtgttccataggctcaaatgggttccttttctttatctggcctcaagagattaattattcctgtcaattcaaatctatcttcctgttaacaaatcccaatgggtcttttcccctactcaatcagataaactccagattctaacattttaatgatttttttctgcattacagtgctgcttaattgtatagtgtttaaagaatatgtggatctcgataggagtttttttatttccttaataagagagcctgacaactttgtcaacttaatgagtacacactgatgtttgctatgggggattttcctagtgattataggacttcttttctagagatgatattcccattttaaatgtttttttaaaaaagaacttggatggtcaagttcaagagtgagtaaattaaatggcaccctttgcacatgtatatgtgatgtgtccaacagaaagcacgaatttgacgtgtccaacagagagggaccaattttggtatattatcaactacctaaaatataaacagcactttaaagctttgggaacaaaaatgtatatgtaaaatattttaatctatgtttatcactctaaaattgggatactgtcagttttaagaaaaaggagaagaaacatgcatatatgaccacctttaatgtttgaaggtgtccaaagaggcaatgatgagaaaaaaagatcatgtattgtggaattacaaggatccactatatcacttactattatattatttctctgagcctcagtttcattggaaaaagacaaataaccaagcctatctcaccagttttgtttgattacacacagcattatgaataagaatagtgtctgacagtaggtattcaataaatgctaagtttcaatttgctctttttcaacattcccttttttttattatactttaagttttagggtacatgtgcacaacgtgcaggtttgttacatatatatacatgtgccatgttggtgtgctgcacccattaactcgtcatttaacattagatatatctcctaatgctatccctcccctctcccccttaaaatgaagagagaactgaagaggctacaacttgacttctttattattttctaatactttcattattaacctgacaggaacatgaacagggaaaaacaataagcacaaaataggaagagatcaatagcttgtgatgagaagacatgaatcttgtcagaattcagcatagaacacatgagaagcaaactttattctttcaacttacaaaatttatcttttcttctgataatggaacatttcactcaatacagagccgactattaccatgaattagttataaacacagatgtagaaaaagaaaaataatctacgcaatgaaagaccttctaatgagtacatgaatgtttttcaactctaggtaacaaatcagaagcccagggacaggaccacggtgtgaacacttttttaaagttccacagctgattctggagcctaataaagttagactactacactggtacagacatagatgctgcaatgtatctactacattgatgtagagggagcttgtgcctggaaggtaaggaagatctcaatcacagagttaaaaaaaaaattaataagcactaaagcatggtaactgaaaaaaaagtcaaaaacctttaatataaaagtctcttccactttcccccaacaattacataaccatgaggtctcttcctgatggcagcagcagcctgtctggagcagctgtggcagggacaccagctgagtggggaaggctccgcaggaataggtgggagccccatcccctaccgagttggagtcccatgcttctgggcgcagctgcagccacccagctgcagctccagactgggcatccctgctctctcaggggcatgggagtaccccacgacccccgcaggctcagaagtgcctgctcctgatccctggcctctctctgctcccagcaccggctcgagtgcagagtaaagttgcagctgagcccaggcactgttgcaactcagctgggtatgcgtgcactgaaagcagcactgacatgccaggcccctgctgcctcagccccctctggactttgggcaccaacaagcataggagggaggctgggggatggcggtggctcagtgtgggcctgcaggcacccctcggcatgaatagcctgggtaccacgaacagaggcaggaagcagacaggctgagagcagaaaggggtggatcctcgcccacttacaagccagggatgccctgaagcccgggggcagggctgcccattccaggtggagtccgcagccagaagtgacaacttaggtcctttttctgggcccatccatggccacccatggaccaaccagcacacacttcctcccttctgtgcccataaaaactcctggactcagccagtcttagacagacattgggattaccaactgcaggaaggagccacctacttggtgtctcgggtctcaggggtctcctcaacttgttgaggtgacctgcctgcagaaaggagctaccctcctgagagctgctttgttgctcaatgaagctcctctctgccttgctcatcctccagtagtccacatacttcattcttcctggatgtgggacaagaactcaggacccaccgaatggtgggactgaaagagctgtaccacagacagggctgaaaaacgccccccactcaccacattgcaggcggtgagaagagctgcagcccttcggggagcccagacctaggggctccctgagccaggggctctgcagttcctagtgtctccaagctttcaagtgccaccacgttccacttgcccaaataccagtgcccacagcagaagccgcttgcggtatgtctggtccagccgcagccttgcacagagctggcgcctggagctgcctgccccactgcggcagccagcgcgcctggctgtgcgcagtggctggatccaacgctcgcttgttcacacaccccctgccactcctcgcccggcccgcccttagcaggtgtgggatccagactggtagcgtgggccgagctcagcctatcaggacaagtgggcataacaggccctgtgggagcaagtaatactcaggcagaaggcaccacccaccactgaggcttccggctggcaaagtgacaccccaaggatcctgtgacattcccttaaagaataatctaaagggaaaagatccaaatctattattatattaagggttttctctacttcttccccgctctcaatctcatgtgcagatataccaaataatcaacactctacccagtttatttcatatataagtacattcagtaaagctgcccaatgttatcaaaactgtgaggggttgtaaccatcacaaaggatatacttaaactcatatttcattttgttgactctctaacaagcttcagaaacatggaaaaaatttaacctgggtagaaggaaggagaaatctggaagataaaaggagatgaggccaatgagctttaacagagtaaccctgggaaaaagactttgaagcagagagtgaagactattagctgtaatacacagggtcttgtgaatccacaaaaattttaaagactgacttggtagaacctataattgaaagaaaaacaccacaataataagaggcaataaggacagtctgcagagagtagtgcccaatgctacaatactacagaaagaaaactacaattgaccaaaccagacatggaagtccccgagctaaagccacattagagaagtagaagagagggatagaggagtgtttagaagcaaaatttggcagcagtgaacttgaggaataaaggagatgatttaaagactatttttgattgcttatttgagagataataacactgtacagggtttagaagtcatggaaatttatatattcatcatatttagcttgaacaatggaaatgggactcagcttttgcaaggaaaatgtatactttctggggttgacaggtgcagagatttcaagcaaaaagggctaccttcaagggaaaaaaatctaaaactcacctgcaaaaatttgcttaccaattattacttaattatttgcacacatttattttttcctttaaaggaccctaaattccttgtggtctttgcatcccccatgattcctagtaaagcagtaggctcagatatcttgaatttaatttgatcctaagtcataatttgatcagaagccatctggcctgggttctgaagtcagataaacctaaggcaaaaccagtttcatcacttgttagctgcatggcactgaataaattaattatcctctctaaactcagcttcctcatctgtaagagccagttgttgcaaagattaaaagagataatgtgtatgaagtaattattacaatgcctatcaaactgtaagcattagaaagggtagaatttattatttttgttattgagctctttattttttcttcacacacacataatccatagcacctgatgctacacattcatcagccagccagaaacccaggtaaatcaatgaaaaagaaaacgacactaatcaatcttccaatttttctactctgacaagattctggcaactagtggtgagggaaaaaaaagaaatctcctgcaaatatatatcatctttgtcatcaaaacagactcaggtaaagtcacaattagcataagtctgtacaaatgaaaaccaatttactaatgcaatactgttttattcaggcttcttcgaaaatccaggggaaaaaaatactccctctaaaaaacacaattcagatgacttgggttttgaaactatgcagaaaacagaaaaatagttttcattatcaaaaggtagacaatgttttgtttcaacaagaatgaacaaacaataaactaacattatggcccaaagactatactattcttagaatgttggtttagaattgaataaaacttattgtataaagtaatatgttcaaaggagatcctatcaggggagaaggagaggcaatcatctttattttgggcagacataagaaaataattttgtagccttagactaatacctagatttggctttgttctagacccagaaaaactatttttggatgctatttccccagatacatgtaaaaaagatttgaattcaaatatgcaaatggtattggactatgtcattttgaagcagttaagtttttaaaatccaggctattcctgttttgaaagcagtgccatttaatattgttcttttcttgctattcccactttctatatgaattgagtgggatctcaaatccccttgctaaatggtttagcaatacttaaaattcagcaaagaacattcccaccttcaggagacacctctcctttatcattatggatgactgacatataaacaaatgtgatgcccagaactggagtcagttctgctcttgaaaatattcatacatcaaacaattctccttcttcattttcataaagacagttctgaccatattatcatagctaaaggacaaagtgtatagctctcaaaactcaattgatcttagttatctaagtcttactttaaatgaagataacagaaatcctttctctatgtaaaaaggttaagcttgggaaaaaaaagtgaaagattttctggttcatcctaaataggctttggagaaagaattgctaagtgtgaaactcctcacctactgcatttcattgatcaaagggttttgtaaaacaagcaaatgcagaattttgagaggcatttaaagggcttgtcttttggaagttaataccctttgcttaatttatcattgatttccattctcttttcttctcttataccatcaccgtgtgtaagtgaatataacaagagtctcatttgtctagaataaagcttgaattgtttatgctacagatactcatggggcctgtaaactatgggatgtgtgcgttcattctagtcctgtcagcaccatgggatcctactatgtgccacactctgcttaagtggcctgctgctggctctactcctgcctcaccacagagcaggtgctctcagacacagcagatcccaagaacggatgctttgtacatgttctgttttcatactatctctccggcagcatatgagtagaggcccaggagcctgaaggaaagcacttgtgcccatcacaagcctcgtgggaggagagagagaagtgcttatttcttcacacattttttgattggacatctgatagtcaggcaaagctgaggcctgttctccagttaaaggagaatcacccagtactgctgttcctcctctctcaactgtactggttctaagtatttctctgtatccagcatagaggagacttgatccctccaatggctccaactagaaatgaagcagctttctttgctgttgccatgggctcccttctcccctctcctaaccttcttccctacactctttctctcctccttccaaaccctgggaccagaaaaataatattgttcatatatacaatgttcattttaattacattttctattatacaaaactaactgtcctgctcagaatgcttttcaaccttgtaaaaaaaataaaacaacaattatgtgctaagcaatacattttatattttctcccttaacatccctgtaagggtaggtattagggtcaagcaaattgaggcttggatagattaagtgacttggccaaagtcaaacaatcagtagtagagacactattcagaccaggtatgttcaaatgccaaagcccagctttttacaatgcccccatgctgctgcatatggtcaagatgtgaaaagcaaagcaaaaataagattatagcaccaggaatttgttgaatacaaatttgtttcccttcaagcttaccagaaaattatttcaatatatttcaacaaaaaacaaacactataaaattagttaaagtagcttaaacatttgatttgtattactgtgagtagaacacacagaagtttatgtttaaatgaatactggcaatggagtagaatataatgcaccttaattgatttatagatactgtgccttttaatagctcagttagcaatttccaattttaaccaatcctcttcaataagagcttgctcaaaacacttaacattgttttctttgaatacctacagctagagcaaatgttgcccaccatgataacatgatcagctaagcccgcagtaaatgttttactaccacaacccacatatttgctctggccagtggtttgccctataggtcagattgttcccgtgcacttacccgcagaaactaagttttgtgcttagtactcaagacggttatgttctctaaagtcttcaattctgtagtcacctctccactaatgaaaacttagagatctttgaccctaacttctcttcctatatgtctctgtccaactttgtaaatatacatatacattacctgtgtttacatcaatgaatttattcaactattctgcatgcaaaccaaataactcactgagttttgtttgtttgtttttcaagacaggatagactctagtttagaaaaaaatattttacttgccttatcgtgagaccataatgacaaaaataaggctctctatattatcaatttctctttattttggccagattcaagtgactattcatttccaattgcatattctatttcatttttgcatatctgataccatacaatcatcagtttatttctgtttccataatgaacattatttcttttcttagcccagtaatttccccaacacatgcaatcaataactatcaattgaatctgaattattttaaatatacataactagaaagagatgacatgattatatatttagaaaaccccttcgtctcagctcgaaatctccttaagctgataagcagcttcagcagtctcaggatacaaaatcaatgtgcaaaagtcacaagcattcctatataccagtaacatacagagagccaaatcatgagtgaactcccattcacaattgctacaaagaaaataaaatacctagaaatacaacttacaagggatatgaaggacctcttcaaggagaaaaaccaatgctcaaggaaataagagaggacacaaataaatggaaagacattccatgctcatggataggaagaatcaatatcatgaaaatggccatactgcccaaagtaatttatagattcaatgctatacccattaagctatcattgactttcttcacggaactggagaaaactactgttaatttcatatggaaccaaaaaagagcccacatagccaagacaatccaaagcaaaaagaacaaagctggaggcatcacactgcctgacttcaaactatactacaaggatacaggaaccaaaacaacatagtactagtactaaaacagatatatagaccaatggaacagtacagaggcctcagaaataacaccaaacatctacgaccatcaggtctttgacaaacgtgacaaaaacaagaaatggggaaagaattccctatttaataaatggtgctgggaaaactggctagccatatgcagaaaactgaaactggaccccttcattacaccttatacaaaaattaactcaagatggattaaagacttaaatgtaagacctaaaaccataaaaactctagaagaaaacctaggcaataccattgaggacataggcatgggcaaagacttcatgactaaaacaccaaaagcaatggcaacaaaagccaaaattgacaaatgagatctaattaaagagcttctgcacagcagaagaaactatcatcagagtgaacaggcagcctacagaatgggaaaaaatttttgcaatctactcatctaacaaagggctaatatccagaatctacaaagaacttaaacaaatttacaagaaaacaagcaaccccttcaaaaagtgggcaaaggatatgaacagacacttctcaaaagaagacatttatgcagccaacaaacatatgaaaaaaagctcatcatcactggtcattagagaaatgcaaatcaaaaccacaatgagataccatctcacactagttagaatggcaatcattaaaaagtcaggaaacaacagatgctggaaaagatgtggagaaataggaatgcttttaccctgttggtggtagggtaaattagttcaaccattgtggaagacagtgtggcaattcctcaaggatctagaaccagaaatatcatttgacccagcaattccattactgggtatatacccaaacgattataaatcattctactgtaaacacacatgcacacatgtgtttaatgtggcactattcccaatagcaaagacttggaaccaacccaaatgcccatcaatgataaactggattaagaaaatgtggcacatatacaccatggaatactatgtagccataaaaaggatgagttcatgtcttttgcagggacatggataaagctggaaaccatcattctcagcaaactaacacaagaacagaaaaccaaacaccacatgttctcactcataaatgggagtagaacaatgagaacacatggacacagggtgggggaatatcacataccaggtcctgtcaggcggttggggggtcagaggagggatagcattaggagaaatacctaatttagatgacaggttgatgggtacagcaaaccaccatgacacgaatatacttatgtaacaaacctgcacattctgcacatgtaccccagaacttaaattttaaaaaaaagaaagaggaaacatttgtaccaaatattatagaaaacatagacactatcaattaattggtcagaaagtatttattaagcaattattttgttaaacactgtcccctccattaaaaatatatctagactagtgttctgcaatagcaatctgatacaagtcatgtatgtaactttatatttcctagtagtcacattttaaaaagtttttaaaaaggttaaaagttttcattattatttaaatttttagtataataaagttattttatttgacccaagatacctgaaatatcactttaatatgtaataattatgaaactattattgactggagttcctacaccctctctaccataagggttttttccctaatatatctttatttccttattttctcaaaaaaattcagtaaagttcagtatactcctcctctatgaagccttccctgaccactggcatccccactgaccccacactctgagtcacttggcacactgtggacattagtaattacacataagtaagtgtaattagcttctcattacacttatgcatataaataaataagcagaaaattgagtgattttttttttcttgccagactgtgagctacctaaaggccagtccatgtcttttcatcttcctgtctccagtccctagcacaatgtgtggccataggaagtattcaaaaaatatcattcaaattatataaaaacagaagaaatagcactctctaaaaccaaaagagagccaaaatatatctccataagaatataagaaatgatttatgggtataggaggaggtacagagatttcttttgttgctgttcttttttttgttttgaggcaaagtctggctctatctcccaggctggaatgcagtggcatgatcttggttcactgcaacttctgcctcctgggttcaagccatcctcccacctcagccccacaagtagctgggactacaggcatgtaccaccacacccagttaatttttgtatttttagtagagatggggcctcactatgttgtccaggctggtctagaactcataagttcaagtgatccgcctgcctcagcctcccaaagtgctgggattacagtcatgagccactgcgcctggccagagatttcctcaagttgtttgcaattatttcaccttaaaaggaaaggaaaacaatagtaggcatcagcttgcatgctggaaattttcatacagaataatattatgatgaccttcccatgaaagagagaaagagagaaatatatataaagtgatatatgtataatgatttctatacttagatttagggagtagacatgttttattctaatagcaaaataattaaagatactgttatactggtctttaactggcccagccagaaaactttttatttactaaactcatcttctcaatgaaacaaaacaactgggccaacagaaataatttgctactcaactcgctcctagatgttcagaaaaaaatgagtcaattaaaaacagaattgtatttggaaaggatagtgatggacctgaattgtgattctggtctgctctgatggacaaaagtcatggggcaggaacagcggtagagagggaaggtgaagcacccattgttcaaaaactggggctgctagctttgtaatacaatattgtaatgtcccctttaggcccaaccccaccttctctgatctccccaggacagaaaaagataagaactttgcatctattgttagatttattcatcctgagagatagaatgcctaggccataacataacctatattaggatcatgggtgacagatgggtttctggtagttgttggcactgccttgtttactctgtgtgtgtgtttgtgtgtgtgtgtgtacacctttctccctttatatatcatgtatcaagattattggatttgatcaaatacatggttagaccaggaaagatttgaatacacttataaacttgacttaaacaaattccaaatccatttaacagcaatggaagatgaaattcttccactttttactttgttcatgtcaattcagagacaccactggttattaagacttcctcctatgactcacatcatcaaagctacatattcacacacatttttcaaagggaaaataacccacactttatttctgtaaagttcaatggataacagtaatctgtgcaagaataaatgcctcacaagcttggattatgtgaaaacctcttaaatctacatcccttgagaaaaaaaaaagtacagcactctcagatgcattacatggaccttgcttcttcatttttgactttcattaggaaatcgtctcttccatttgcccccaaatgcaaatgcttcttcaaaaacattttaaaatgttcaatcacataaaacagaaagcagccttcatgattagaaacttacaaggtttcagatgttatttctttaatccaattcatcaaatcttaaataggtccaaaattcatatacagtcctaataagctttgaaaagaatagtcctcgcttcaaacagaacagtactattaatatacaactggttaagtttaaaccagtaagtcataatgaagcaaaagtaggttttgaggaaactgccttaagcctccatgactttacaattccatattgagcactaataataaatcccaattcatatgtgtgactacataaatattcatgcagagttaaatgtgcacctataaatgtacacgatacatatgcagatgtaaatgcattttatgatttcagcttatgaaaatgtcttatctgttggttttggagaaactatcactttgatatccattagatgtaatatatgagtttatcattgtatcaccatcatgttataatgccattgtctgagatttatctattaaacaactcagaagtatgtaaatgctcttaaaatgaaaagaaaattgtgaagctattaaatcatggtcaataaaatatttctatgccagtcattatctaatcatctgactccatcaagtcttaactgcaatgatttccaaacccacttaagtacttttgcctcttcctctgcatccttgttataagaatggtaaattgcttagattagttgactgctgctgtaaggccaagcaacagccaagtttgaaaccaaaccaatgattatgtctataaagttaccctaattaacaaggaagcaatcctaagcattaaatggttaagctttagtattacctgagttctgctatttactcaacttaggaagtcagaaccacggaattaaacatttgtattttgatacagtttcttccataaaaatcatcacaaaattttaggagaaacactcctaaaaagctttttcttattgcataagattaaggaaaccatttgattcaaaggctcaatgctgataagctttagcagataataataaactctctaaagaaattatttgattcatactaatttgcattggtcttataaatggcaggatatggatggttgtgggatggaagtagcctagactagccaacagggaaactgttaagtgtataagggaatgcatatgttaaatagcttgatttagtcaccccacaatgtatacaggcatagctcagagatgtcacaggttctatttcagaccactgcaattaagtgaatattgcaataaagtgagtcatgtgaacttttttatttcctagtgcatataaaagtaatgtttaggctatattgtattccactgagtatgcaacagcactgtatcaaaaaatgtacacacattaactttaaaatattttattgctaaaaatgcaaagaatcatctgaaccttcagaaaagcataatatttttgctggtggagggtcttgccccaatgttgatggctgctgactgatcagggtggtggttgctgataaatggagtggctgtggcaattttgtaaaataaaacaacaataaaacttacttcattgactgactcttcctttcacaagaaatttcttggtagcatgtgatgctgttacagcattttacccacagtaaaagttctttcaaaattggaatcactcctttcagaccctgccactgcttcatcaactaagtttatgtaatattctaaatcctttgttatttcaacaatgttcacagcatcttcaccaggagtagattccacctcaagaaattactttctttgctcatccataagaaataactcttcatccattcaagttttatgagattgaagcaattcagtcacatcatcaaattccacttctaattctagttctcttcttatttccaccacatctgcagttatttcctctactacagtcttgaacccctcaaagccatccctaagggttggcatcaacttcttccaaacttcctgttaatgttgctatttttacctcctcccatgaatcacaaatgttcttactggcatttagaatgatgaattttttccaggagtcttcatttactttgcccggatacatacaggtatcgctatctaggaaacctataaccttaaaaaaatgtatttcctaaataatgagacttgagaggttaagttactccttgatccatgggctgcagaatggatgttgtgttagttgtcataaaaacattaatttccttgtgtatgtccatctgagcccttggaagactaggtgtgttctcaatgagcagtactatcttgaaaggaatcttttttttttctgagcagcaggtcttaagagtgagcacaaaatattcattaaaccatgctataaagacatgtactgtaatccaagttttattctaattatagggcataagcagagtagatttaacatacttcttaagggccctagggttttcaagatggtaaatgagcattggcttccacttaaagtcatcagctgcactagcacctaacaggagggtcagcctgtcctgtgaagccagcattgacttctcctccctagctatcaaagtcctagacaacatcttccaatagaaggctgctttgtctacattgaaaacctcttgtttaacatagccaccttcatcaatgctcttcactaaatctcctagataagttgcttcagcttctacattagcaccttctgctttacctggcatttctggttatggaaacagcttctttcctgaaacctcagattctttttctgcagcttcttcacctctctcccttcctttataaaattgaggagagtcagggccttgctctggattaggttttggcttatgggaatgttgtggctggtttgatcttctatccaaaccacaaaaactttctctatatcagcagtaaggctgttttgctttcttatcattcatgtgttcactggagtagcattttcaattcccttcaagaactttccagttgcattcacaatttggctgtttggcataagaggcttagctttcagtctgtctcagctttcgacctgctttcctcaccaagcttcatcatttctagcttttaattgaaagacagaggtatgaatcttccttccacttgataacatagggaccactgtagggttattaattgacctaattccaatattgttgtgtctcagggcatagggaggtccaaagagagggacagagatgagggaatgcctggtcagtgtagcagtaagaaaatatataacatttttcaatcaagttcactgtctaaacaatcacaatagtaacatcaaagatcaccataacagatataataatagtaaaaataatttgaaatatcgggaaaattaccaaaatgtgacacagagatactaagtgaacacacgctgttggaaaaatgtcaccaatagacttgctcaatgtagggttgccacaaaatttcaatttgtaaaaaaaaaaaaaaaaaaaaaaaaaaacactatctgtaaagtacaataaagtgaggtgagcctgtacatataaacatcatgttgtacatcataaacacacaatttttagagatccaggccagtttatatatacagggactgggtggtaacaatgttaaaaacaaataaccaaagaataggagggaaataataataacaatggtaaaaacatgttgaactctatccttgcattaggctttgctaactgccttaaacatatcctattttatgttcgtcagtgtttcactcattcaaatatattcatatacatctcactgaatataaagtagataaggaaactgaagcccagaaagttactccagatttcacaatcactgaattgttgataggggcttcaattaaaggtcagtcttatgaatgcacttaactattacactacaatggtagccaccttcatcaaggaacttagctgaatcttctaggagggctatgagtccatgaggagaactaatatccatttataagagattagttaaaatggaggttgtcggcaggttttgagtttggacaggtggtttggactcccagtatagagaccaaatagcaacaggagcacaggcagcaataagatccgggtgtataaggcaaaagtccaaagatttattcaaggcagaaagacccaggaggaaatagcttttgggtataaatcaggtaacattttgaaattcaagccacacatcagaaacaggtatcacaaagaaagcatttcaagatctgcaacaaggccttcaatccctttgccgtatttataagacaccaatctgcactaataagtgtgcacaattccgtggaggtagagacagggtctgcaggtcactgtagccgaataacaggtccctaggctgagtagtgctcatgcttctaaaatttccacttccaagttccaaatgctatgctttccccttttccaattaccactatcttcatccccatacatgtctattaggaaaaaacaacaataagacatctacttagttcagtcatctgggaaatgctgtggataatacagtactgtgggtcaaataacacattcaagaaccagtcaatttggtgaaaaaagaaaaatcaaattgcttattttgcatcatgcagagcaaaaaaattactatttgaatgttgtgcttttcaaatagttgtactgatgttgagtagacacaatcatattcaccaggcatctctacactgtcactttggtatattattttttacactgccttttctcttctcggaatcaaatttagttatcctttggggatgcttaattccttaatgtcaatcaccttttttttttaactaagcaagcaggttctttattttttcaactaaattctttaatcagcttttgttcagaaactgtttatttctatctgcattacaaatgctagatttaaccaatctatcaaaccaggataatacaaggaaggatattgtcagttcatcctttcctcttaggaacaaagatgccgtattttgtgctttaaaagaaaagaaataataggattagactaagattgaggacaagaggatgtcaaaccaaagaaaagcatgtggtccttctaaagctctcccaactagtatggggaattgtaatccattcatgctaagtgctttgactatgctcattatgcaaaaaccattagagcctagtatatttagttaccatagttctgcctactgggaactataattaaagcacatttgagcaaatgcaattttatttgttattaagcaactaaaagcttagtcaaccttgcaaatatggcattatcttaagattacaatatgagccagacagctatccaataaactttattaggtcctatctttattagctatgtcttgtattcctattgcaggagcattgtatgctgtacaacagtggtcttaataggtctaatagtttaggatgcaccagaaacacctggaaaagcttgtaaaaacacattactgggccccactctcagagtttctcataccttaggtctgcagtagggccccaaaatttgcatttctaacacatccccagaggatgctgatgctgctggtctgcagaccacactttacaaaccattgctttgctgtataaaatagtggttagagctttggagtgaaacccacctgggctcatgtacttgctcttctactaatacatacatgtccttggacaggttacttcatgtctccaagcctgtatcttaatccatatagtagggataataacatctatccaataggttggttgggataattaaataagattaaaagtatagaaagtgcttagcccaggtcctggcaagagagaaaccaatgaatgtcagtgataagtttattattgttgttaattttaaaaatatgccaagatctaggtcaacatatttataaccaatggtgtgcatcagactcaactgtagggcttttgtaaaattcacacagtgagacaccatccccctcagagatgttgatgcaatcaatatttcattgattctaagatgccattgatcataagatacaccattattttatgtatcactaagaaagataaggcagaaattaacccatgattattctcagtgaaataaatgaaacatagaaaaatactgcataatctctcttatatgtggagtctaaataaaaaacgtcaactatacagagagagtagcagttaactaggatgcacaggtccagaaatataatgaacaacatgaggattatgtaggttgagtatccctaatccaaagatctaaaatccaaaatgctccaaaatctggaactttctgagcacagacatgatgctacacaggtacctgagatagtggcaacactgccttctgatcattcaacatacacaaactttgtttcatgaacaaaattatttaagatattgaataaaaattacttttaggctatatgtatacggtgtaataaaacataaattttgtgtttaggcttggatcccatcccccagatatctcactatgtatgtgtaaatattccaaaatacagaaaaaggcccaaatctgaaacacttctggcctcaagtattttggataaaagatacacaacctgtagttaataaaattgtattgtattgggcatttgcgttaaataagtagatttagttgcctgcttttgtcatcaaaaaagtaactccatgagatgatagatatgttagtttgcttcactatagtaaacaccttactgtctacatgtatcccataacatcacgttgtaagcctcacatatgcacaataaaatttatcttaaaaaagtttgatcaaactaatgtaaagcacatccagatttcaaaaatgagaaaatatggggaaaaaagtacatactggaactgatgaaataaggtagctggagatataagtgtgggcttgcttcccaggttattgtgatgtgcaattctgattaaaaaccactaacttggctggccacagtggctcacacctataattaatcccagcactttgggaggctagatgggcagatcacgaggtcaggagattgagaccatcctggctaacacggtgaaatcctgtctctactaaaaatattttaaaaaattggccagtcatggtggcaggcacctgtagtcccagcttctcaggaggctgaggcaggagaatgtcgtgaactcgggaggcggagcttgcagtgagccaaaatcgcgccactgcgctccagcctgggtgacagagcgagactcttgtctcaaaaaaaaaaaaaaaaaaaaaaaaaaaaaaaaccactaacttagtcaatgtgacagctgcaagtgggactcaaagttcagatgcctcaaagctgagagggctcataggttggaatccccattcttagaacaagaatataacccaatatcataatcaaccacctaattccatagactgtttatgaaacaaaaaatatttcctcttggtgtaagagcacccaccctctaaacttagaagaagacttctcccactgaatagcacttacccacatgaactggtcatgttcatgaccagaacacatcagtcaatcagatcaaaggagagtatagcacagttagaaggaaggtgtcaagctgttagaccaagataggtttttcttcttaaacatgaattccaatcttgagatttgaggattatttagggagacaaaacatgatttacatttcagggagaagggaggatgatgaaggtcacatatgttaccaggacgtggccctagtaggcttctattttccgtcttgagttttaaattgcagtttgtaatttgtttcaaaacaaagaaagtagattttgtataatctgtttgtcttatcaagtttatggccactcccatttgccttcactctgggaatcttggatgaaggtggggaaggcatgcgcctaccctcaactttatgctaacactcctgcccataggaaatgcattaattctgtaagccatcacagaacaggacaagatcttatgacagttttatttgggagctcagaatttctaataacttcaataattatctccggtagtctccatgcacatgagttaattataacaagaaaataaaatacttatttcagcttctaaaaattctaagaatgtaaatctctaatgaagtgttgagataatacatagctgtttttacaaactttcaactaagaaaatttcattttaactcctgcctacctcatgaccacccagtcctctctttattattacttatgttaatattaatttaattattattaattttctaaccagggctcaacccagatggacaaacaaacatgaaatcagggactgccaaggacatttcttcaaggtccaaatagttacaaattgtagtgataatgaagttgaaaaacacatggatatggatgactttctcattttctcactatactggaaacacacacataaactatcaatgaaatctatacttcaaaaaatatattttcaaaccttagatacctcttctggtcctggtccatattgaattcctttctaaaatcagaaattaaagctttatcataatactctttttaaaactacgatgttcttaaatttttatgcttccaattggagaatggaacatacaaagtattggccgggcgcagtggctcacgcctataatcccagcactttgggaggccgaagggggcggatcacaagatcaggatattaagatcatcctggctaatatggtgaaacccgtctctactaaaaatacaaaaaattagctgagcatggtggtgggcatctgtggtcccagctactcgggaggctgaggcaggacaatcgcttgaacctaggaggcggagcttgcagtgaaccgagatggcgccactgcactccagcctgggcaacagagcgagactctgtctcaaaacaacaacaacaacaaaaaaaacgaaaatacaaagtatcatgaaatttaacaaaaaatggtcttatgtttccaaaaggataacactgattttattaaaatgtctacataatttaaatgactgcacatgtggaataaaatttaatataaaactcagtcacctgaataatgacaacttagaaacagtcacactggtcatagagagtatctgtcgacttgaaggagaaggaagcagccatgtctttataggaaactagttcctgttttactatagagatgacagggggttggggttttattttcattatttttttttttttacagattttaccttgatttagttgcataatgaatgcaacacctattttccacataagaagataaagactgatttgaaatttttcaattctgtccatcactgttgtatccaactgacttattagcatacaccttgctgcaagggttttatttttactgagggattcttcgtgtgcctcctcattttcaccaaaatgtatataaatctcctgaattttcatgacactgatgtggctaaaaattttaaatattttcagttctttgaaaatacaagaaaaaccttcagaaataagaattagccatggttcagaggttctgatttgttttaacaaaaacatcaattatttcaagttctctgctgactagaaaatagtggatttcatttgatatggcaaagcaacttgttatgttttgtgctaccataaaatgcatcacaatttatagtaattacctgaatattcagtttgtttctggtaccctcctctcagtcctacgtgtctgttagagaatcaaagggtactgcttgtctaagaaatatgctaaagagaggacaacacaatatctggagaaggaaataagaatcatcaaatgccctttccttctttgatataattcctaagattacagaaattgaagataacctagcacacatcacctccaaagagaacagaagaaggtcttttaacttaatcttgtagataaaatggattacaggagctgagtgcccagactgtgaggcagatcagtaacagtttcaacagctatattcaaacggtgttaactagtgcatcagcatcaacctagttctaaatctcagaatcatagaattcttttctgggttccatttgtttcaccatgttactcaatgtcctggaagaaaatagagcggacatcataaaatttgtagaagggagagtggccatgtggatgactgaatggggttggaagctgacaggttggagacaaggactatatcttaaattaataaaaataaattttaaagtacttatagaaatgaagtatccacaaatgaaaagtaataatagaaataaattgaaaagaaatagaagtaaatgtaaaatgatgtgattaagtccaaaaggacaattgttttgtacagaatggagatgtggcatagtagcaatacaggcaactaagacttagagattttagtctacagaaaggttaatgtgaatcaacagtaaatggaatatttttgagtgaatgaataaatgtaatgtattataggaggggagaggagggaaggagaaaaagagtagggaagcggaggggaggaaaagacaggagaggagaggaaggagaggaaaaggagaagagaatctgtataaaaggaagcaaaagccccacttatctctatatagcctggacaacccatgaagtactgcaatacaagcatggagaaactgagcacattcaagcatgacctgagatgtacaaacaatcaaatcaataatatccaagaattcctcgaagtacttgagcatatttaccctggagatctgatcagcatgctcaaatatcctaataacttcactgggaaaaagaattagaggtgttgtgtttgaccccagtggttacaagtaggacagatgtattagactctctaagggtaccttggtgtcaaagtcctctaaggacagaatggctcagcttgggagctactgatcactctctctcctgaagatgctgaaaccctgattggatgacccttggtaagacttttgcaaaaccaagtcaagtgttagataggtggcaggattagatgatctttgaaagtccctccaaaccttaagattccaatatgtaaacattttcctgtggtgcacattaaatccttacaaaagactttctctcataaagacaatgaaaacaaatggttagcctaagggaggtgaaccaatcttcagaaaaccctaagagactcccctattttcttgcttgtttgctcgttagagaactaatctcctataaaacaggaatttattaatatttctttgtcctctgctatactggccgactttgggaatttgcacacagcacactttatcttgctaaatataatagtctgtctggcattcttcctttgtgagaaatccttattcacttgcataaattatgtgtaaagatctgaagcatactttcctttcttcaatacagactattcccagaagtagcctgacacatgccaaacatctgctcccacatgcagctcaatacatgatattgatatgtattatcactgggtgaattctaaatacaaagccaatttagcacactcctgaacaattccctccttctctcccggccaagctgcagggagctcaaggaaatcagaataattctaatacttgcctaagcaagctataaccaggtaaatctgctaaaacaaaaaccacagtataacatttcaaaatctaataaaaattagatacacatgataaatataaatgttcatctaatttaatacatagctaaatacatagaagtattttttagtatctgctatacttacagtattgaaagacgttgctttcctcaactgtgaattcctgggtgtcttgagtgtttgttaagcatttatatgagcctagtccgtcttttaatgatcgaatgcaattatcgttcatgtggtacaaagaaaggtgaccagaatccctaaatcttgaagtttttctagtcatctatgaaagcctctagttctctaacaggtattttcacaaagaccttcagagtaaactcatttttactgctaactagggctttggacccaaacacctctctgctctctttccctggtgaagtaacctggatctcacataagcttggcagacagctcctatcccttgggctaaggattaataaaaccagccccagcagtgaatccgttatttccttcccaagtcccacactgcttctggcccctggcaaagccactgccctggcacaggttacatctgcccagaagaggcaggtttcctaactggtgaagtcattatacacatctgcattgcccaatacagtagccacaagctgcatgtggcaattagttcctcagatgtacaagccacatttcaactgctccatagccatatgtggctagtatacagaatattttcatcatgcgctactggacagtgtgccctaggattccattttgttctcaatttgggcaaacattgttcttggacttgggcagactttatctcccacttaaggtcagagtatgcaagggtttattcatttattcattcaacaaatatttatcaatcccttgtctaactactgaacatataaccacaaataaaacagacatggcacctactctcatggagcttacattctggtcagaaaaaaattaacgataaacaagtcaacacctaatggaaatgattctttcagctatgaatttcagtattagtttgtatcatttttagcttcatggtaacaagatattttggtttcattcaagtggatccatccccacagcagctggcctgctttctcttgattttcttcagatgacagtaactaatggttttaatatttacttgaatctagagtttcttcacctttgtttctttagaacttttactcaaagcttaattcttgcctctgtccttgattctgtcttgaaaggttctccaaactttaacttttcaatcatcagttttaaatgtaactcttaactatttatattctcaaatagtacaacaaactactaggcattcgcccttggaagataccacctcctcagctccttaaccttggcgatagttcttcagaatttctcttgaactattacctttctttcattcccagtgggccatactaactaagctgtcatttctcatacatgaatctctaaaacaacctccccaaaaggtttattgtctcaattttgtttccttacaattggtcatgcacactaaatcacaactactttaaaaactacttttaaaagtgccagtcattgcctctctcaaccttctctgcactagggaagctcccttgccccagtctttcacccctgaaaatgtacacctgtgccaagtgtgttcccacctttctctgtttgagagcacctgtcaggtgctaagcccaccactctctgcagtagttctcaagcaaccagagacactaacagatgagagcttcagcagtttggcagccccacatcccccgacctcacttaaccctagtcacagcttccaaaccagcaccacttcaagggatattggcatagcagccaagttcattggggctaggacttccaaagtcaggacagctggctctggggctaaaattgcagctgtgtttgggagcctcaccattgattatgccaagaaccctgtctgaagcaacaagtcttctcctatgccattctggggctttgcactctatatatgtcagttttttgctgcttagaacatctgaaaatgggtaatttatttttaaataatttatttcttacagtttaaggagaacttgagtccaaagttaagagaccatatctggtggacactctctacagtcctaaggtagtgcatggtatcacatagcgaggaagttgagcatgctaaagtgctagctcaagtcactcttcctcttcttataatgccaccagttaatccattaactcattaatccatggatagactaatctattcctatggacagatctctcatgagccaatcacctcttaaagtccctacttctcaataccgacacactgggtattaagtttcaactttggagggaaaaaatatttaaaccatagcaccctcttagaggccatggagttctttggcctaagggtggcttttctcatcctcttcaccatgtaaagaagctgtccccaccattaatagttctttcctccatgtctcatctatcttgtatgttcttttccctatacctttctcaggcaatctgagaaaagtggttggctcaaggtttgacagagggaagacaaataaatactgcatcttattagtcggggttctctagagtgacaaaactaataggataaatacatctatatctatatctatatctatatctatctatttatctatctagggagtttattaagtagtattaactcacatgatcacaaggtcccacaataggctgtctgcaagctgaggagcaaggaagccagtctgagtcccaaagctgaagaatttgcagtccgacgttcaagggcagggagcatccagtaaaggagaaagatgtaggctgggaggctaagccagtctaaccttttcatgcttttctgcccactttatattctggccatgctggcagctgattagatggtgcctatccagattagggtgggtctgcctttcccagcccactgactcaaatgttaatctcctttggcaacaccctcacagacacacccaggatcaatactttgagtccttcaatccaatcaagttgacactcagtattaactatcacaagtccaccccttgacaacttgaacctatacacgtctcctgagatcatacataatcttcaaataaagacaataatgaggtcataattacacctaatataatacaactatcctttatacaactagaaacgcaccaatccccaacccaaatgctattccatagagttaacaatacttaaatactgacatggatatgaggtcaataaatcttatgtcacatgataaaggaaaaaggaaatgaagatattttcttagtacaagtgtgtacatgcacaaacatgtttttaacaaagaaggaagaaatatgacaattacagtcctcatttctgcaactggtcacgtggtcatagctggtattgatgactaccttcttctactacccattctgtattccctttgcctttagcaagcacctcagcaggtcatggtttttttcctggagtgacccaaaccttcattcctgaagggtctgagccatctgcagtcctgcctggattgggctgctgtagtttcccattgaccttaatcacagggcatggtaatactaagagatgccctaatgaatctcctatattccctgcatacccttccttacctctgttgtgtagtagtagactgatttcgtcttgatagtctgggtcaatcaccccagacagcactgtaacccccttcttagcctgttgacttaaaggtaggaggagcccaaagtgtccaggtggcaatcttaacttccagttcaaaggaatcattgttgtgtctcctggtgttcctccctctggaactaagacttctaggccagcagaacataatattgtgggaacaggaagcaaaattttgctagtgggtcactaggagtaatggtgagtggtgccatcaaaaggccatcctgaagcatctggattgaaaggataatagaattgcctttggaagtcagaattaaaatgccaactaagtgacaatactttgcagggctggggcaaagttctccagaaggctgtgtatgctctgagccagcttccaatatacggtactgcttttcccatagccaggatatgcagagtccaggaatcaggggtggaagtggaagtggcacctcttattatcacccctagtgacccactagcaaaatttttgctacctggacacttggggttcctcctacctttaagtcaacaggctaagaagggagttacaatgttggctggggtgactgacccagactatcaagatgaaaccagtctactactccacaacggaggtaaggaagggtatgcgtggaatacaggagatccattagggcatctcttagtattaccatgccctctgattaaggttaatgggaaactacaatagcccaatccaggcaggactacaaatgacccagacacttcaggaataaaggtttgggtcactccaccaggaaaaaaacccacggcctgctaaggtgcttgctaaaggcaaagggaatacagaatgggtaggagaagagtgtagtcatcaataccagctatgaccacgtgaccaactgcagaaacaaggactgtaattgtcatgagtatttcctcctccttttgctaaaaacatgtttgttcaggtatacagaaaatatcttcatttgtaccaagaaaatatcttcattttatttcctttttcctttatcatgtgacataagatttattgacttcatatccatatcagtatttaagtattgttaactctatggaatagcatttggcttggggattggtgtgtttccagttgcatgaaggatagttgtattatgttaggcataattatgaccttattattgtctttatttgaagattacatatgatctcaggatgtgtatgggttcaagttggcaagggtggacttgtgatggttaatattgagtgtcaacttgatgggattgaaggactcaaagtatggatcctgggtgtgtctgtgaggatgttgccaaaggagattaacatttgaatcagtgggctgggaaaggcagacccaccctcaatcaggggttcacctaattagctgccagcacagtcagaatataaagtgggcagaaaaatgtgaaaagctagactggcctagcctcccagcctatatctttctcccgtgctagatgcttcctgcccttgaacaccagactccaaattcttcagctttgggactcggactggcttccttgctcctcagcttgcagacagcctattgtgggaccttgtgatcatgtgagttaatactacttaataaactcccctttatatatagatataaatatgtcctattagttctgtcactctagagaaccctgcctaatatagattttgtcattaccctactcagtaatacattatgactccctattatctatggaatcaagtttcttttttatgaagttattgccttgaaaagataaccctaaaattgaataattctgttatttttaccattttacttaggagtaagaattataacctgtttggttctgaaaatgattttagacctttcaggcggatgcaccttttggttcatgtgatatatacctgcatatgcctcattttatgtaattaaaagtttcctgataattatactcccagtttccaataaattcttccaccacacacacacacaacacacacacacatgcatgaagtagaagaaaagcttttagagatcatttactgagcttattgacacaaatgagagttttaagaagcacaagcaaacaattttagcatattttggccaactttatatatattaatatttcccatttccttgtcacgtgcatgaagcccacatcatgtctttttccacagggtataaggccctatgctcaatagcttgaattagtcacagaatgtctttctgttggcaacttttggattaacatccacaaattaaaatcagctcaacctcaaactaaagtatctggttatcattaataacttcgccactggacagaatgataaaaaataaaaagagaaaactcattaatttattatgatctcaaactaaatgtttttctcttatgtattttaaagatctgagaagcaaaattacaatttgagtttattagtaactatctgagtccactttctgttgcttataacagaatacctgaaactggttaatttatatggaaaataatttatttcttacagttatggaggccgagaagtctccaaagtcaagggaccatgtctggtgagagccatcttgctggcagggattctctgtggggtctcaaggcagtgcagggcagggcatcacatggggaggaaactgagcatgcttactcaggtctctcttcctcttctgataaaaccaccagtcacttctgatgacaacccatttatctattaagccatgaatacattaatcagttaataaaggcaggttcctcactatccaatcacatcttaaaggccccacctctcaatagtgacatactggggattaagtttcaacataagttttggaggggacatttaaatcatagcagtaactgaagcagaactactaaaagattgttaaaatattctaatcaccttttcaaaaatatataattcctttttcatgagggttaaatgtataaaaattcaaaaattcaagtcatttttttttttagacagggtcttgttctattgtcccagctggagtccagtggtacaatcatcagtctctgcagcctccacacttcctgggctcaagtgatccttccacctcaacttcctgagtagctgggactaaaagcatgtgccaccacccctgactaatttttttaaaacattttttgtagagacagggtctttcaaccctggtctcaaacttctaagctcaaatgatcctcctgcctctgcctcccaaagtgctgggattacaggcttgagtcaccacacacaggctgtaatcccaagtcacttttattatcataacctgctttagtaatcaagagaaagaaaattctttttatccttatgtcatattttattatggttgaattaattcttatagttagagtacatcctaaatacaactaaagaagttaactgatgcttaaagttactaaagcccaaattatttttacttttcttttcttcataataatgtctgtttctgttatcataaatgtagtggtctctgagaagctatgcacttttatatttgttactcagacctcttgaaaaatgttcaaaattattaatatacacaaatgtatagaaaatatccatatacattaatatacagaaataatttcctctcagtagaggagactagatcatagtgaatcaatgtttaacccatttcccaacaccatttaacatgagcttcaggccactagaattacctccattgacttagaaaagtacagaagacataagtcatatcaaagacaacaggaaaatgtttaattgtgtttaagtgcttctatatttgtatgacaatatttatttaacaaacattgatatagcacttgctacatcaggcaatgtttcaagcttttttaataaatattaattcatctaatcctcataacaaccttatgagttaggtaatatcatccctatttttcaaatgggaaaactgcgcgtaaaagaagtatcttgcctaaatccctagaatcaataaatggcaaagtcagaatttgaacctatgagtctggctccagagtctgagctttcaagcactactccatcaggctacctctcaatattctaaatcatttccatatttggaatctgatttaatataaaggtgttatagcttttagtcgtgtaaaaaacttttctttttgagatctgaaagtgacttcagatctcaaacacctaaggagacgtgctggtagagatctgaaagtgatttcactatgtggctgctcccacacaaacacccaatgtctccttgactctcatcccactagctcatgtacctcctgctcggcatccaccaaactctgttttctcctatagcaacacctaccacaatatttgtatattaagtgttacgttctttaaggacaagaagcatatcttgttcacagtttttttttttgttttttgtttgtttgttttttgagacagagtctcgctctctcgtccaggctggagtgcagtggtgcaatctcggcttactgcaagctccgcctcccaggttcacgccattctcctgcctcagcctcccgagtacctgggagtataggtgcctgccaccacgcccggctaattttttgtattttttttagtagagatggggtttcaccatgttagccaggatggtctcgatctcctgacctcgtgattcgcccgcctcggcctcccaaagtgctgggattacaggcgtgagccacggcgcccggccttcttgtttacagttttatctccaacacatgtacctgagcagacaaagcatgattataaattactcaacagccagagagttaaactaacttcttatcaaattacaacacctaaaataaataggtttcttctctatacctatgggagtaggtactcattccaattttaaaattagcatgtgtgtggaaataatcttgtgatttaaagaaaatgacactgcagaaaactacattaatgaatggtcctctccatcttggcacagagatttaaaatttgggtgtttcaaaattaaagacactaaagctcttcgtttaaaaaaaaaaaatgacaacacagatgcactgagcttttcaaactaaaagtcaggaatatatatcaagctactatcacaaaacacttccatcaaaaccctgcaggaagcaaacaattgccagctagcacatcacccttcatgcgaaatgacgtgcgtcattttgtgcaaaggacatcaaaagaacttgtcagttaaacagaggatttagatataccatgagaaaactttcatgcaccactttacatatttccagcaaaattgctatagaagcacttaaggcacaataatttgaacctaacttgacttaagtaaccaacacaaactacttttctaaaatgtctcctattttcataagtgatagaatttagttataaaagtcctactaactcttgtaaaataatctacagagacatggtgattcatttgctttcattcagcagcatttgcttgtaaaattattaattatgtgcctattatgtgctaggtactctattgggtgttcttgtacaaatcatttttctgccagcaaagccatatttttttgagttagtaattcccagatttttgtcaaattcaacagcattatgcaatgagttcttagtatgtacagtaaggaagagcagaattttagttgatgtaagtaattctacattttattttggataacaggaacatacaaactatatacatgcaacctgaatattcttattaactgttcattttgcatttctgtccaatttgaccagtgaattcactcaaatagtcaagttggctttggcatttaggtaggaccagtaggtccataaagtgagagagtcaaatgggtaatggaagacaaactccctcctagatcacaagctcctgagaataagaactgtgacttctatagtactggggccaaatgtatttcctggcacagactatgcattaatatatgattgtttgaatgaaagaatgacctcactaaacttctcccaaacatataaaactatatcccatctgtaaaaatttccagagggaccagacatgatgatggtcatttggtcattatccttattaatattaaccttcctaagtacagagatcccatagaggctcttagggtacaataaatcaaacctaagtacattaattaaccaatacaagttataactttactaacagttattattttccgttaaatttcctaaattctcttaatcttttatcactgaatctgtttttttaaacttttttcttatcttttaaattattctgattattaagttaaaggttaacaagataataaatcataactctgcttcaaagcttgccagcttaaattctattaacaatgcctgattattcaagcttatctcctttttataactttgaaaataagctgaaatctgcacctctaatcacagtgtcctgtaccctttcaactatacgtttgccttgccttccactaaatcctaaactagagcaggggtcaggttcttgttcctctttcttgccatcctctcaccctgacacgcactactgtatccacttcaagggcatgttcaggaaagataatatagcactgcaaaaatgggctactgggggctgggcacggtggctcatgcctatgatcccagcactttgggaggccaaggcaggcagattgcttgaacccagatgtttgagaccagcctgggcaacatggcaaaaccccatctttacaaaatgtacagaaaataaataaaaataaaaataaatagccaggcatggtggtgcgtgcctgtggtcccagctactccagagactgaggtgggaggatcacctgagcccaggaggtagaggttgcagtgagccactgcactccagcctgggtgacagagcaagaccctgactcaaaaaaaaaatgggggataggaaggcagagaaaagcaccccgaagccctcgggcggaaaattggattaaaaccttaaagagaagtaaaatattctcctttactgtctccatttcagtcattgcctttaaaattcatacatatattccactagtgctaacctaagagaatcagcattatttaatatccattgcctcagacactgttgtttggccaaccatactcattcccaggccccagccaccttcttctgtggctaggaacactaaatacttatttttcctgcttctcttgcagctaagcattgccctggacacagttctggctgatgagatacaagcaaaacccaccagagggttccctgaaaagattttgctttcatgattaaaaaaaaaaaaaggagaaatatggctggcattgtcacttctcccttcatcatgtcctgaacatacaatacctaggcttgcattatgtattttgcaaccgtgaaataaaaagcatgaaaatgaaaaacaaactcaatgggaatggtggaacagaggattaaacaggattattaagcaactaaacctatgcaaacaatcccctgttttcagatagcttgatgtgggaataaaagattgttgacgttaccgttacttacagacaaatgctttccaatggagatgctacttaagacagccatggtttaaatcctggttctgccttttactgtgtgaccttgggcaacttaataaacttttccaagcctccatttctcatctgtaaatgggcataagtgaaattgctacaatagcattgttgtgaaaaatataaaataatgcatttcaagtacttggcattgaatttggcacaaagcatttctctcaaacattaaaagcacattttaatactaaacacaatagaaatgttttaaaaataaatgttgcttttttctccaaataattacatataaaaattaaacatttagggtgttagagaagtcaattctttatttttaaaatcatcattatatatagtttaacttaagacaatttacaataagaattaaaatgtataatgtaaatgtaaaatgtacatttgtgtaattaggtagtacaaatattaactaataattgctatgtggattaaattttttatattattctaattattgtgatacaaaataagccatttcctccagcacaagatagactgaaatgactggcagtaacctcacaacttcttgttgccataccacccagaaacctgagacatgtgaatctttactgttccacttactaggttattttcaggacattcaatcatttctctttaatcattgaaggaaacagcaaatctctgtttgttgtttcgctttgttttagtcagaagcatttttgcttcacttcaacaagatcatcactccaattgtttctctttagcagcttatcttacaaggccagtaaaagactgtgttccgaagcctagagactttccatttatagctttccattaagcctcttaaaagtaggtatttacacaaattaattacttaaaaggtagggccttttatgaaatagcttttttattaattcaaagagattataatttttaatctaaacctttttaaaaaggatttgagtcgacttacaacaaaagacataaatagattaagattgttaaaataaaccaaaacatatgcaaatactgggaaaaaaggatgcaaataaaaaaatcatgatggccacaattatgcaaaacatttaactgtgaacttctactaaagcaaaaatggaaacagagttgatttttaaaatctcattatgttagagggaaagtgtatggtctatatttttatatgctgatactcagtgtagccttagtactaaaatttcagtaggaatttctctcatggcccttccccaagaaaaattaagttccataatacacagtgttttcatcagtgaggttcagtggctgctttgaactttaataaaagtcaatagcatgacattataccagtaattttaaaatgattttaagctatggaatctgaaaaaaatatgcagcagctaaatatataaaattatagataaataagaacttctctaattgaaacagagttaaagtgcctaaagctactataaccagtgattacagaatctgagtaaggaaaaaaactgtagccaataaactgatcacagtgccttgcttagttacaaatatacaaatgcaaatacaatgtcctaagctcttatgctctcctgacaaggttggggatgaggcaagaatgtctactctcattgctcttattgaacattatactgcaagtcccagttcaataaagcaaaaagaaaaaatgacacataaggaagacaggaagaaataaaactgtctttattcagaaagagtgtattgtgcatgtagaaaatcttaaaaatctacaaaaagccactaaatctaataagttaattgagcaagattgcaggatacaagttcaatagaaaacaaccatttgtatttctatatattaacaataggcaattggaaataaaacaaaatatattcacaacagcatcaaaaatcatgtaaaactaaggattaaatctaacaacaggtgggcacaggcagttcattaaaaattacaaattattaccaagaaaaattaaagaaaaattaaataaggatatttctatggagtgaattttgtccccttctctacttcagtttatatgttgaaaccctcaatgtgacagtattataaatgggtactttgataggtaattaggtttacatgaggccatgaggatgggccctcataattaattagtgtctttataagaagaaacaccagagagcgtgccatctctctctccgtgtgtgtgtgtgtgtgtgtgtatgtgtgtgtgtgtgtgtgtgtgtgtacacaaagaggtcatgtgagcacacagtgagatggtggccacctgcaagctaagagaagggacttcaaaataaaacttaccttcccagcacctttatcttggacttcccaacatccgtaactatgagaaaataaatttctattatttcagctacccagtctatgatattttgttatggcatcccaagctgactaagacagagatatacagtgctcatggatcagacgacttgaggttaaaatttaagatacgaattcactgcagatttttctataaactcagtataatcagaaataaaatcccactaggcctatatgacccaagaattccatttgtaggcatatacataataaaaaacagggactcatacagatatttttatcattgctggataattcacaataggcaaaagttaaaaacaacccaagagtcaatcaacaggtaaatggataaacaaaatgtggtatatacatacaatagaatgtcattcagccatgaaaaggaatggagttctgacatatgctacgacatagatgaatcttgaaaatattatgctgagggtggagcaagatggccaaataaaagtctccacaaattgtctcacctaaaaggaacaccacattttaacaactgactacacacaataaaagcaccttcataaaaaacaaaaatcaggtaagcaatcacagtacctggtttatattgctgacagaggaactaaatgggtaggaaagacaggcttaaatcactgagaccacccctctcacattccccagaaataattacatggcatagaaagagaatctgtacacttgggggagggagagcacagtgactgggggactttgcattgaactgagttttgccctgtcacagtggaaagcaaaagcgtgatgaactcagccagtgcccacacatgaagggagcatttggaccagacctaaccagagaggaagtgcccatctcaatggtctgaacctgagtttctctgcaagtcttgctactgcaggctaaactgctctgggatcctaggtgaacttgaaaggcagtcgaggacacaaggactgcaattcttagggaagtcctgatgctgtgctggacttagagccagtggattggggtggcacatggcctagaaagacaccagatgggccagctaggggagtgcttgtgcaactcctcccacaaccacaggcaggaaagcttgcagcaataaaaggactccttccttctacttgaggagaggagacagaagagcaaagagactttgtcttgcaccttggatgccagctaaaccaacatagggtagatcagtgggcagagtagtgaggcctgcatcctaggccctacctcccagatgacatttctagacacactctcggccagaagagaaacatcttccttgaagggaatgaacaagtactggcagaattcatcaccttctgactaaagagcccccgaaccctgaatcaccaacagcaatactcaggtggtataccactggccttgggtaagactctgagacatgctggcttcagctaccagctcagccatagtagcgcagagcaccaagtgggctcttagggatccctgaatccaggaataggctattggatggcacttatagacctgccctaggccaaaggggagcccacttccctgaagagtgagccccaggcctggcagcattgaccacaatctgactgaagagcccctgggccttaagtgaatcttagtggtggcctggaaaaactccctatgggctagtggtggtggtggcaacagggaaaggcttctctgcctgtggaaaggggaaagaagaatggaaagagctttgtcttatggtctgagtaccagcttagccacaatgcaacagaacaccaggtagatttctaagttttttttttaattctaatccctggctcccagacagcatctctagacctgcatgggttctggggaaactgactgccctgaaggaaatgacaaaatctgtggcttccccacctactgattgtagatccctagaatcttgagagaatataggtcgtagtcaggtagcaaatatagtggaccttgtgtgagactcagtactgtgctggcttcaggtctgacctgggatagtcccagtggtggtggccacaggggtgcttgaatcatgccatccccagctccaggtggttcagcacagcaagaaagacttcatttgtttaaaagaaagtagcagaagataacgagaatttcttcctggtaatccagggaattcttccagaccttatctaagaccacctaggtggtatctttatgagtctgtattactcggcttggaacccaagtctcttttgaatatctagaaagccttcccaagaagaatgagcatagagcatagacaagctcagactgagaagactacaataaatacccaactctttaatgcccagacacagacaaacatccagaagtatcaagaccatctaggaaaacatgacctcaccatacaaactaaataagggaccagggaccaatcctggagaaacagagatatgtggcctttcaggcagagaattcaaaatagctctttcgaggaaactcaaagaaattcaacataacacaaagaagaattcagaattctatcagatacatttaacaaagagattgaaataattaaaaagaatcaagcagaaattctatagttgaaaatgcaactgatgtattgaagaatgtcttagagtctcttaataacataactgctcaacaaaaagaaagaattaatgagcttgaagacaggctccttggtaatatactgtcaaaggagacaaaataaaaaggaataaaaaataataaagtaagcctacagaatctagaaaatagcttcaaaagggcaaatctaagagttcttggccttaaagaggaagtagagaaagagatgagggtagcaagtttattcaatgggataatataaaagaacttccaaacttagagaaatatataaatattcaagtacaagaaggttatagaacaccaagcagattttacccaaagaagactacctaaaggcatttaataatcaaattcaaagataaagaatcctaaaagcagcaagagaaaaaaaacacacacacaatagaactttaatgcatctgtaagcagacttttcagtagaaaccttactggccagaagagagtggcatgacatacttaaagtacagaaggataaaaacgttttaccctggaatagtatattctgtgaaaatatccttcaagcatgaaggagaaataaagactttcctagacaaacaaaagctgaaggatttcatcaataccagacctgccctaaaagaaaggttaatgggagttcttcaatctgaaagagaaggacaataagcaataagaaatcatctgaaggtacaaaaatcagatagtagaaagcagaccgaaaaacacagaatactataacactgtaattgtggtgtgtaaactatgtttatcttaagtcaaaagactaaatgatgaaccagtcaaaaataacaacaactttttaagacacaaacagtacaacaagacaaagaaaaacaacagaaagtccttacttgtcaataacaacataaaatgtaaatgaactaaactctgtaatcaaaaagcatagaatggctgaatgaatttttaaaaaaagacccaatgatctgctgcttataaaaaacatacttcaactataaagatacacatagactaaaaacaaataaatggaatatttcatggcaatgtaaaccaaaaaagaacaggagtagctacagttatatctcataaaataaatttaaagacaaaaactataagaagagacaacattgttatacaatggcaaatgggtcaattcagcaagaggatataacaattgtaaatagatatgtacccaacacttgaacacccagatatataaagtaaatattattagagctaaggagagagacagacctcagtacaatagtagctggagatttcaacatcccactttcaacattgttgattttctgcctgggaaatctgtccaaagaaacatcagacttaatccagactatagaacaaacgcatctaatagatatttacagaatgtttcatccaatggctacagaataaaaattcttcaactcagcatcattctcacagacagaccatatgtcaggctacaaaacaagtcttaaaacattcaaaaacaattgaaattgaaataatataaaacatattctctgaccacaatgaaattaaactacccatcagtaacaacaggaattttgtacactaaaaaaaaaaacatgaaaattgaatcatatgctcctgaatgaccagtgggtcaatgaagaaataaagaaggaaactgaaaaatttcttgaaataaatgataatggaaacacaacataccacaactcataagatacagcaaaagcagtactaagaggaaaatatatagctttaagtgcctatatcaaaaaaagaaaaacttaaacagcctgatgatgcatcttaaaaaattagaaaagctagaacaaaccaaaccccaaattattagaagaaaaaaataaacatcagagcagaaataaatgaaattgaaatgaagaaaacataaaagataaacaaaaccagaagtttgttttttttaaagataagcaaaattggcaaacctttagccagactaagaaaaaaaaaaaaagagacgatccaaacaaataaaatcagagagaaaaaagaagacattacaactgatacaacaggaatttaaaggatcattagtgactactatgagcaattatatgctaataaattggaatatgtggaggaaacggataaattcctaggctcaaacaacctacccagattgaaccatgaagaaacccaaaaatggaacagaccaataacaaagtaacaagattgaagctgtaatgaaaagcctgccagtaaagaaaagcctgggaaccaatggcttcagtgctgaattccaccagacatgtaaagaactaataccaatcttactcaaactatttcaaaaatggaggaataaatacttccgaattcattctataaatccagtattatcctgataccaaaatcagacaaagacacatcaaaaaagaaaactataggccaatatccccgacgaatgttgatagaaaaatcctcacaaaatactagcaagctgaattcaacaatacattaaaaagatcattcatcatgaccaagtggggtttatcccagtttcaacatatgctaatcaatcaatgtgatatatcatatcaacagaatgaaggataaaaactatatgatcatttcgattgatgctgaaaaaccttttgctaaaattcaacatcttcttatgattaaaaccctcaagaactgtatatagaaagaacatacctcaacagagtaaaatccatgtataacagacccacagttagtgttatacagaatgggaaaaaactgaaagcctttcctctaagctctagaacacaacaaagaactccaatgtcaccactggtattcaacatagtactgaagtccttcctagctagagctgttttctgtttgaaaagagaaagaaatacatggtgtccaaattggaaaggaaaaaatcaaattgtccttacttgcagatggtattatattatatttggtaaagcctaaacacttcaccataaaactgttagaactgataaacaaattcagtaaagatgcagaataaaaaatcaatataaatagtagcatttgtgtatgccaacatgaaacaatctgaaaaagaaaaaaagttcttccatttaatatagctacaaataaaacgaaatacaaaggaattaacttaaagaactgaaaaaaactctacaatgaaaattataaaacactgataaaagacattgaagatacaaaaaaaatgaagacattccatgttcaaggattgaaggaatcaatattgctaaaatgtccatactacccaaagcaatctacagattcaatgtaatccttgtcaaaataccaatgacattatttacaaaagtagaaaaagtaatcctatgatttatatggaactacaaaagaccccaactagccaaagatatcctgagcaaaaagaacaaaactggagaaaccacattacctgactttaaattatactacagggcaataacaaataaaacagcagggtgctggcataaaaacagatacctagaccaatggaacagaatagataacccagaaacaaatccttattttcaacaaagctgccaagaacatatattggagaaaaatcatctctttaataaatgatgctgggaaaagtggatatccatatgcaaaagaatgaaactagacccctatctcttgctatatgcaaaaatcaaatcaaaagggattaaaaacttaaatctaagacctcaaaccatgaaattactataagaaaacattggggaaaatcttcaggacattggactaggcaaagattttttgaataatactgcacaagcacaggcaaccaaagcaaaaatgggcaaatgggatcacatcagttaaaaagcttctgcatactaaaggaaacaatcaacaaagtgaaaagataacccacagaataggagaagatatttataaactacccatatgatgagaaactaataaccaaaatatagcagtagctataaaaactctataggaaaaaatacaataatctgatgttaaaaaggggaaaatatctgaacagacatttctcaaaagaagacaaatggcagacgggcatacgaaaaggtgctcaatgtcactgatcatcagagaaatgtaaatcaaaactgcaatgatatatcatctcacaccagttaaagtggcttatatccaaaagacaagcagtaacaaatgctggagagaatgtcaagaaaagggagccctggtacactgtcggtgagaatgtgaattattacaactgctatggagaacagtgtgaaaattcctcaaaaactgaaaatagagtgactatgcgatctagaaatcccacccctgggtatatacccaaaagaaaagaaatcagtatatcaaagggatagcttcactcccatgtttgttgcagcactgttcacaatagccaatagccaatatctggaagcaacctaagtgtccatcaacagatgaatgaataaagaaaatgtggtacatatacacaatggagtactggagccataagaaagaataagatcctgtcatttgcagcaacatggatgagactggaggtaattatgttaagtgaaataagccaggcacagaaatataaactttgcatgttctcacttatttgtgggaactaaaaattaaaacaattgaactcatggagagagcagaaggatggttaccagaaactgggaatggtagtggggatgtggtggggcagggagtgggaattgttaatgggtgaaaaaaataattagaaacaatgaataagacctagtatttgatagcacaaaagggtgactatagtcaataataacttaattgtacattgttaaataactaaaataatataattggattgtttctaacacaaaggataaatcttaaggggatggatatcccatttactatgacgatatacattgcatgcctgtatcaaagtatttcacatgccccataaatatatacacttactatgtacctacaaaaattaaaaataaaaaacattttaagaaccattacactaggtggcatacgccagatgcaaaaagaaaatattgtatgattccacttatatggtgtataaatacctagaattggaaaatttccctagaataggctcattcacagaaataaagtagattacagattaccaggggctggagggaatgaggagttattgcttaatatgtacagagtttctgtatggggtgatggaaaattctggaaatattggtgacacgacgatgcaaatgtaattaatgccactgaattgaatacttaaagatggttaaaatagcaaattttatattttttttactatactaaaacacccttatttacaaaacaaaaccctaggagacttttttatgaaatctacaaattgattgtgaaatacatattaaaatgtaaaggatccacaatagccaaaatcatttgaaaagaactaagttgcatgatttgatctgaagactcacagaaacactacaataatcaagacagcatagtattggtgttaaccgtagatgtattgatcaatagatgacagaatgtcagaaatagacacatatatgatcaattagcttctgacaaagtgccaagataatttaataggaagaaaaatgttttcaacatattgtatggaacatcaagatatgcatatgaatacataaactctgacctttcctcagatcatatacaaaattaacttatcaattacagacctaaatgtaaaaaatctcctaaaaggagaaaactttgcaaaaaaacccaaaagtgataaattatatcaattcgttaatatagaaatatagactataattacatgtgtttgtatacatacatgtgtccagaacttaataacctgaatcttagcaacaagaggacaaaaactcatttaaaaaactgtcaaaagatttgaacagacacttcataaaaatacaaaggccactaagtacatcaaaaaatgcacatttaaaccacatttagttaccattacaaagtcattagaatggctaaaaattaaaaggctagaacgagtggaattctcatacaatgctagttgcaaagtaaaatattgccactactttgtaaatctgtttggcagattcttataacgttgaacacatgtctgccatatgacccaacaattccaagagtaataatcatatgccaaccctgccacaataaccatatcagatttattcatagtagccacaaaactggaaaaaaacccaactatccatcagtatgtcaatggatagcccagttgtgatacatcctttcaatggaatactactaggcaatgataagagaatagagtattgttattatcattacatgcaattacatgaatgaatttcaaaaacatttttctgagcaaaaaaagataggcacactgtatcattccatttatatgaaactctaaaataagcaaaactaatctgtaatgacagagcacacatcattgattgcctggggttgtggctggtaggagagaggtgtgactacaaagtggcagaaagaacatttttggataataaaaagggtctatatctttatagtggtggtggttacataagtgtatacatttgtcaaaactcatcaaactagaatggatgcatgttgttaaatgtaaatcatgcctcagtaaagaagattttaagagtagaaataaggatctatacccattactgaatctacattatatacttgctgaggctgtgacagagtgcatcatcaacgcaatatggctaagcttacccacaagtaagctggaatgtgggtataaatcaagtttaaggataagcagaataccaggtaactggcaacaccagaaaaaatttcttcctcctacccagctgggaaatatccacagtcttttctactgcaatgtacatatcccagattaaacaagtttgagagtcaggagaacactatatgacatcttcctcctaaaagatgacaactgctcttggcagtgggtacttgagacagaatttaggaaacctctgccatggctagctctcgaagtataataattagtaaaccactttatctgggagtgataataagattttgtgcatttttgttactgccattgcctccttgaccaggacagtccactaatactcagtcttccacctccaaggtagtcctttaagaatttgttcagaaaccctaggtttcagccaggaatgattttaaaacattgaaagcataaccaagtgatggtgtatatattcctctttgcacagatataaatttattgtgcagtttttctatgttgtttaataaagttcactttctctagtgatcttacaggcaacttctaatactactactaccattaatactaatactatggttctcaaacactgcatgttcttaagtcaaattcccagaggtctggggaattggggtctaagatctggtctaacctctctctggtgatcctagtacagatagccttcaaacaatttgagaaacactgcactgttccattgctctgccagggacacttaactttttagtcctccagttaggtgggagtgagttgactgacaggctagataacaaccaaatacataatcaaaatcaaatgtatcataatgtactttcaacaagttgtccctcatgaagacatagcatgattatttttgcatgggacactttacaactgatggttgatgtttacttcgttaaatgaattttaaatacaagtggcattgattctataaacagcaacatcttaggaaaacatcctgtaaagaatctccacacttagctcctagagaatggtgacaaggactgcttaaaagaacatgaaatagtttggtgctatagattaaatttcttctgagaaaaagtgtgaattttacaggtggcatccagatggagaattagtcccttcccacccacatgaagaaagtctataaaacctcttccacaacaggagaagaaagggaggacattttgtgccaagaaatttttgcaatttgtgtactagaagagtactgcaactctctggagcactccatattatgtgtagctgtgtcgtgtcaaatagaacagatactaaactacagaaattgagttaatgaagaggtaacacgtcaaagtctaaacttgaacaatggtagacagactaattgttttctacaattatatctgcttttagttttgaaaatgaccaatccagcatgagccagcatgggtcagcataggatacagaagattactaaatagatgggaactaagaccataacagagagataatccaactacaaccagctagagatattcttagaatcttgtggttaagggttttaccaacaccttgacaattaactccaaaacaatatgtaggtgtatctgtacactatttatgaatttttctgtatatatacttacattaattaattgtttagttcaattttaacagttcattttgctgagtggagcccttcattctcagtaaattttttaaggactttataaacacatacattattaataaaaagtactcaaactaggcgaatccaatcaatagttgcaattatgatcagataagagcacttatttaaatagtggctcttaccttttaaaaatatttttatgaaaattcaccacaaatactttaataaaatgagttatatggatatgaattcaattactatagctctagaaccaggtgatgaaataacaaaatgaaacagaaagattgcagaagtaataaaacagagtgagtggcaaaagaatatcattaataaaataataagatcaaagaaatgaatagacaaggttgaaaactaaattactcactagaggaaacatttgagaaacatcacagtaatgcagataaaagacacagaaacaaaaacaattatttaaaagtaatatatacagaagatagaaaagataggtaagacaataaatgtgacagaaaatgtattaaaagatatggtacaacaaagcttcaccgatattgaggtaaaaaataaacctgtatattgaaaggacacgagaaattcctggaaaaatttataaatgatcatctgtaagaaagtgctttagtgaaattgtttttccccaactttaaggatgaagaaaaataacttggctatcagttcttgctatccatccttttacctatacatataaacacagagagatttccagaatcgtaaccttcaaaattataatgattatgtctagtaggtgaaatttgagttattacatgtttctctggactttcctctattgcttgtatatttataatgaacatatgttacttttataaaagcaatacagtcattaacttaaaaaattaaagaaggaaagaaagggatgaagaagaaaagaaggaaagagacaattattgatttgcctagatactattttatcactttcttagttacctaatcattacgaaagaggaagaaaaggaggagaaagaagaagaagataaagaggaaaaaaaccatcattttgtgctgatcacagattacgtatgtgaagtcttgggaatttctgcttatgtctgatatattacaactttactgctaggaacttttttttttttttttttggcctagtattttgaagtatctgaaagagaactccatatttgtagaagcccaactgggctactgttaaaaggggtttatattccataaatatttacattctgctctacaagagctgagaaacaacttgatgtgcctgttgttcccatttaaacaacaacaaaaaaaataaattgtgaatctttctctacatctagtatcttttctaccaggtctctggtagaatgtcaattccctgaaaacacagattgtgcttttgctttgttccagacaatatgtgtctttttagggtagaagtactaaaaaatgaaaaataaaatgctaagctaattgatggttatgatatattgtttcaatccccctaaggccaggctgtgaactatttcaaccagacatagtctccacaaagttgtagatctgagtgactctgccaagcatgattctatttgcaataagtcttttacagttatctactattttctcaatcactcccttgcatttaaggtttagcaactagttcactgtatacctctccacgactactccatgcactagctttagtaactccaatattccttatcctctttttctcctgtgttcacctaacaaactgaaactctgttaaaacccaactttctatctgctccctacttgcacctcagcagctggaagtagtcaaagaaaaacattcatttgaattaactgattttatgtaaacttttaggaaagaattttaagaaatgccttcattttcttaaatttatgaccacaaatcttagaaagacctccccaccacccagcatccttctatgtttccataacaaattcattttcccactctctcaaaaatttgttttacgtattttcctctggcctcaaagcctccctcaatactccctccttccaccgtccttcactctcatatgatgaccttgacttctgtttaactgaaaaactaaaagtaatcagaagaacatctcctgattttcccatcaccaaatcttctaacttacttgtaactgacccattcacttcatttttcctcctaatatgagggatgaaatctccttggtccatataaaccaactcttcacagcgcactgaattccagcaccaacatttaagaactttgcaactggaattttcccctcctttgctgcttcctcttcagttttcctctctcaattggatcatttccatttgcatgtaaacatgttgtaaaaagactctcaccttgcaaagcaaacaaacaaaacaaacttccttaattctatttgccccttcagcttccgtccatttatctgcttctttggcaaagggtatctactctacccgctttttctttaatccactccaatcagacgtctgtctccactactcccatgaactgttcgaatcaaggtcattaacaacctctatcttgccatatttgtgtctcaattattcagtctctcaagagtattaacttaatggagaatagcattgttgtcaaacactagctttgcttgacttcctgtgaagagtgctttactggttttcctcttcattctctggcattttcttttttcctcagtttccattgctggatcctcctctcaatattctccagagttcagtccttgaacgtcttctcttctttatacttagttctcaccagatagtctcaagttccattgtattatatgatatatacgcatcccctatttgatctgtttccctgaggagccctgactaatacaataacctttcctctttgcctcctatggagctctggaatcaactcaatgtggaagatgtctcaccagtgtcaatcctttccttctttcttagtaacagtcttttattttacgtagccagcctcagtctgtcaactgaagtcgagtagacactgggatccttgatggaaggtggaacccatctttccctaaaattctacgttggagagaaacaattccaattcctccccctagcaaaggcaaagagctgcaaactctttacccctttctttcagggccattattttccccagataatctcagaaatatttatatataaaattaatacaaattgctggttggcatggtagatacagtacttgttttcatttatgctaatgagttgccatttttgtttaattacccctcacctttttaaaactagagaatacattcatcactcatgactgtaggagagatttttatcttaatatggggggtaaaaatataagggtttctagtctgttttatgctctacttctttaaaaattttaattcttccataagaaaacatgttaccccttagggaaaaatccttgattcttcccatcactctgctttactttatattaataacttgtttcattaatttttactattaacttttgacttctagcaatgttttatcactagtggattgtttcagaccaccatagggtaatgtggtaaggattaacaccttaataaaagataataaatttttcgcattttttgaaagttcaggccaagacaattttcatgtaatcatagttagagaaagctttttcacctggcttttataaagatgccaagtgaaactctatattaaaatatgttatcaagtatctccttaacttaaactgatacacatagctgttacttaagaactccaacagaattataggactcagaagtcagagatgccccaatctagaagtcattgtaacagagctcctgttaaaactcctaacttccagtagttattgcagattaacaatgttcagagcattgccaagcttctacattgccataaaacactgtatttatacctaaaagagtcaatttaccagatcctcttaaaattataataggcacccagatcctgaaaatcacccacactacttgtcaggattaattgtttctttggctttcatacgaaagtgtaaaaacaatgaaacaaagaaagacaagcaagcagaggaaagtcagacttaagaggtacagtctctaccagttgctccatttttatctttctggcagaggctttaaataggtatttgattatatgatacaaagagtatagggttctttctagaatttctcatgtagacccaaatatccagccagggttgaacactatcttttcaacattaacatgataggtagaattttaaccataaccctcatgttgcaccacttagcaactgactgattcaaataatgagcttccttttagaaaatcttagaaacacttggatataagaatatgaaagaagaagaaaacatgccaaatgtcaaccatctatattttaaagtaaattcatgcttataaatactattaaaattctccctcatgcctcaggacctgggcactaaattgtttgcaatgcatttgtgaaaagtatgtgctgttctctaaattatttcaaactgtttgtgttttatgttgaaatttaatctcagtgtttgttcagacaaactattaaaagtaaaacatttacctaagccttgtttttgtcttgtaatggcatttctgcttgatttaatttaaatctgttatttttaagtcaattagtagtacaaaaacaatattcaaaagttccatggccattttaaaaacagcctctgttcccaggattataaagcatcaatcattggtcatgacagtatattctatatagttgaaggctgctttctatatagtgaaagtaaaatatatatccgttgctcatcaaagatgtcaactgctttgacttttccgcttttcaaatatgtttttatctacatcagtgtaataaatcatttataaaattctcattaagaagcattacataacacatgccaccatcttatctaacatttctaaatcatacacttcatttgcattctttcttcttttagtttgccaggctatgttgagccacataacttttcctgtagtgacaggggaaaccaatgatccagttttttttttttccatccctgcacaaaatcagtttgactttgattaatgtgacaccagtgggggcttgactaaattaactactactttacttgttaagaaatcaattctttcagctgagaatcaaactgattgtgtttcaagtatgacctagagtgatctttatcaacattaagagaaccagtccaaagcaatagctaaagaataaagtattttaaaaatggcctaaaaactcattagctgtatttacattaatttggaattttgatcatttatacctatgctcttctgagtttgttccataagacgctaaagtgttaatgaaacactttactcacatgtgtattgtaactatgtgggcacttcctagaatgacattctttacaaagcattaatgatacagaaagtataaacctgactcagtaagtggtacctcatagaaaacctcaacattgctcatgtaacccactgagcaggaaataaatgcaccgcaggaaaatggaagcttcactctaacctatgttcttaattctgagtatgttttaaagaaaagtaaaaatgaacagaaaatttttactttatcacaaaaattacagagtgctaaaatgtcacaaattactgccctactgatttggaattgtgaaaaatccagattttttttttctttgttgaagtttgtatttgatccagtatagaaagaagtcattctcctttaaattcttttcaacccgtatagcatggtcagaaataaggcttagtttagtatctatatgtctttttttttctttttgccatggagttgcactctgtcacccaggctggactgcagtggtgtgatcttggctcactgcaacctctgcttcctgggttcaaggatccccctgcctcagcctcccaagtaggtgggactacaggcatgcaccaccacacccaactaatttttgtatttttagtagtgtcagggtttcaccatgttggccaggctggtctcgaactcctgacctgaagtgatccgactgcctcagcctcccaaagtgctgggattataggcatgagccaccacacctggcttatatgtcttttatgttaatacttctctaatatttgccaaactctctttaagaaaatttatctcagcctcaatctccctcaaggcaacagaactggccaatatttaataatgtcattttcatcacattatattgatttttatagttgccttctgtttgcaacagagaatactggttttctgttcacggtactaatataagttttctctttaaatgaatttagattgcaaagtgaatcaatttaaagagaatattgggaaataaccgtacaggtggtaagcaagtatgtcaaaaaatcatgaaagtagtaaaaatggctggatgtcaggaagtaactatatataaaaccaaacaagaaaaaatatatacaaaactgtaaagagaaaaccatctatttgaacaaattaatttcaatccttttcccagtatttgcataatatcatgtttaattctaaatgatgtatttattaaagtgggaccattaaaacctttacccaacaacattgtgatagtttctcactcagtacaatataaactcaaaaactgtaaaattcagctccttagtgaaaaaattctgtaattcagaaacttcattgaacaaatgcttatcaatcactcagtatacccaacacagtgagccagatttgaggagggacaaaaacatttaggtatccactcattaattcaaaagctgttttttgagtagatatgatattcaaagccacttgttgtgtaggatttaatgaaagaaagagaaagaggagcagaaggaggaagaggaaaaggagggagaagaggaagagaaggaggaggaaagtaattattaaataagggtcctgaactcaaagagattaccatctagttcattattacttattattgtccttgagttttacttattatactatatcattttctcacatattatctcttttttaaaatccatgtattactcagtctgtggtaatatttaggagacatttcttttgaccatcagattctatgaaactcaataacaaattcatggaatacaaaatagcacaaccttaaaactcacagcaatacttacgaaattggacacccttggcctttcacatattctttgtgaaaggggagatgctgccccagaaaaagtagtcaacattcagtaaaataaactcactgtggtaacttgaacatatgcatttaatgagaatccacatgcaaagcataacttgaaggtttaactacataaattaaaattgttctaagctgttatccttcacaaatatagtgcttccaatttttactaaatttatacatctcacttaggatgtgcagttgtgatcatgatatataatgtttattaaactacttgcatatatagccgcctcttcttcctctttactctgtgcctgaagcctaatgaagacttctacaaaaaaagacaaaacctattgtgttctaaggaatagttgtagttttttaaaatatgaaaatagattgtgatgttcaacacttaaagcaaatttttcatttctgattcactgaagacagatttccaacaaaagctttataccatatgtactcacatatcactatttttaaaaattaaaatcttacagaaagattacaagacttccttcatatcctaaactttgtgtgatagtactttcttaccttctcagcctagaatgccttccttctgtattttaagtggatgatgcaactggcatgaatgctacagctgccctctaatccagcctctcatttgaattactttgtaccttccacaccaaaaaacttgagctggcaaatactaatatcagccacctgtgaatcgacattaatcatttcataacttaattgtcaccaacagtattgaaggaaaaacaacatttggtgtcaaagagactgaaccagaaaactggccctaaggaaatgtgagtgtagtgatcctagctgggaagctctctgcgcttaactgtcaactcacctggattctgggctaactctgtttcctctgcagaaaatgaaaaaatatgagatccaagcacctgcaactcctcaaatccacctgaagccaatccatctgtgttccaataacccaggcctaggtttccttctgacaagatcgatttctacttggttctatagttctactatatgcatcctttgctgtcttttcttctcattctgtatacccggtgtgcccaatactgtgctagcaataagaaacaaagaagagcaagtctctcagagcagggatgcacactaattcctaggatttcagtatcttatgtgacagctttatctaattttcctttccataaaagtataaatattttaattttttgcaatgtgaaaaaaatttaaatactccataattgcaggcatttgggccttccgctctacttaaatagcatttttactgccttggatgtcataatgaaagcatttgcttatttttcttgcaatgtttttccttcagttcacatcacagcttctatgatggtcttgggttgctggcttccttaatggtgccatcatatagaatcactggagtttcctggtaattggaaataaatacttcaaaattattttaccatgaagctatttttaatattctgtaagatttgtcacttcccttttattccttttacaccttatttaaggagaaaataatatccttgcttcaggaaaaagaaaaaagagaagatttccattgtttctatcacaaatccaaaatattctcaagggtttagaaggtgtattagcatcttattgtttagtcctactgcagccttcttgcagccagaaggggaaacactattcacacacagagggtggcagagaggggacgagaaacagcttggggtcattgaggtcattgctaagacagtgaaccagctctgggcctcttatttctagactttctgttaagtaaatgataatgatccttgtggttgaaaccacttttaatcaggaatgcttttacctgatacccaaagttaccctgatatccctataaacacagcttgatcagttaactagttcaatcaaggatgggtgggaggactcacaggctggagcagagaggcggccagtttcaagtgatgcccattctgggcttcccaatccagttttctctgagctgttttctgtagttgggttttctacagtgaacataaactgtcaacctctgctcagagagtcatgacagcagaggcatggagaccagcagaatgacctcacctccaccttctcccctagtgtaaacacttgacccatggctactacctaatccacaaaggggaaaggaaggcaggtgcctgtggaccacatttcctatggaaatgctataaacaggagtgtcctggctaactggctctctggtggggatgggggatgggggatgggggatgggggcagtgggcagggatgaagagttaccctgatgtgtagcctttcccaagttttgtggtataagtaatcttaccatagatgtcaaactgctaacagatcagtaacctgctgacaatattcctgaacatttaactattgactctggaaagccagataataatttaatgagttctttttcaggagctgtttttgtttttgagagaatcctgtgaactaagagggaactctactgaaggaatgtcaagcataaaacctataatcaaatcctctcttcatggagcttatagtccagctgcaagttcagcaacatgcaatacagaagcaagaatcacttgcttataaggtaagatgattataaatgcaaattaatgtaaagcaaattgacatataagcacctaagacaaagtgcatcagcccatctcataaggtggctgaaaggtccaaatgagattgtagatgagaagactcttggtgagttatgggccacagcagaaatgtaaaggatcattcctcttggtgtgcagtgaggataatcagacaaggcaccatctggattcccagaacatggtaattgataatgacaaggtcaaagatggaaaggcagaatgcctggggatactgagaagacagagaagcaaataggggccgctggcctcaaagacagtggagcaaattgtgttcaccgatccaaattattttctagcacaccatcgctgcctttttcatcccatttattatataaccatgaccaagactttaacttatctagtactcaaaagctccacctgcgaaagtgtcttcaaggggctgcttttaggatattcaggatgaagacctaaatgatcttcagaatagccttctacaaattcaatgtctcatcatgacttagtaggttagcagcacggcctttgggactgaattctgactctgccacttgctagctgtgtgccttgtgtaagtaacttaaactctcagtgcctcagtttcctcatctgtaaatggagatggtaatatttaactcataatacggttgtgcagattaaacagacataaatataaattacctaggacaatgcctagcacatagtaagaactctatagctgatagatattattggtattgattttaagagtataacattcaaaatttggcttaaaattcttaaatggtaaagaaattataggcaattaaattagttttgccacctgcctttaaataagatggttctaaattggctaggatgctttctttctgccacttagagtgtcaacttcaacttaagtgtggccttcctgtgaaggaaagtcagttgacgagtagcaagaaccgcttcatacttcaggcacatccaacatgggaggggagaaaggaaagagaaggagagagagagagagagaaagagagagagaagaagaagaagaggaagaagaaggagaagaggaagaagaagaagaaagaagaagaagaagaagaagaagaagaagaagaagaagaagaagaagaagaagaagaagaagaagaaagaaagaaggagaagaaggagaagaaggagaaggagaaggaagaaggagaagaaggagaaggagaaggaagaaggaagaaggaagaaggagaaggagaaggagaaggagaagaagaagaagaagaagaagaagaagaagaagaagaagaagaagaagaagaagaagaagaagaagaagaagaagaagaagaaaagagagagagagagagagagagaatgaacatgaaccaaagaagaaagaggaagagtcattctgagcatccaatatatgtgtcctcctattacatcacatagaccaaaccactgtgtccagagatttgtgatatgctgataggatggagctggaatgtttctttgggaaaacggaggttcaagtaggaagagaaaaaggtaaggggatggatactaggctgttaacctacaaatggcaagtatagttttaaagccattttctgtattcatctgttgaccttaaaccataaggtacaggctattcaacaataggcatgatttgtactttcactgttcgcaattccgaccactaccctattacatctaaaacatgaatctggctgcttatccttggattttctacctccataaaatgataaagagaatgttccttatatacagaatacctgagctttaccagcaccaggactggttgttactctatgtttttgatagagctgattttcctatttcattagggagacatatatcaacatacagaaggttgatgtataaaaaagaaataagcccaaccagctgaaagaggaagaacttaatttattgctgaatagtgacaatcaattcaaatgattttagttgaactgacattaaattataacctcttggtttaagacatttgagagaatgagatccaaagaaaaagattgggcatatttttaaaaattccttgaatatctcttattcactgtttttgccatacaaacaagcttagatatttgacttaacactgccctagttctcaagcctctagtttctcttcatgacagtagctttctattatgatagatgaaaacccaaataacatttattctatcctattggaaaacacatgaaaatgtccaggggagaagcatctctaaaaataataaatgaaatacatccaccaataaagaggaatagaatcgtggtctctgatctcctttttgaggcactattcctcccacgggagttagactgtagcagaaatctaagcatggccctaattcctacattccaatcctagatacactaaaaggagcagaaccaggtgaagtaaacttaaaaggaaacaaagtctttatgcattccaaaaacaacacttttctctgtgtgtaatccccataatcaaattgatgcttgaatgacaaagcaagaaaaatgatataaaattggggaaattaagaatgatataatcgtgttactgcctctgtgccctatatatctaaatatgtatctatcaaaaaacctctccaacagaacatggtgacagagataaatttcagtttgacaaatgcaccaaacaaaaaatgaaatgtatcataaaccattgctctttctcaatccaaacagaaaaaaattcctaaagaaacctgcattctttataataactagggtaatgtatgatgtgttctctcaatttctgaaatactatgtaagtcacgaatctaaagccatgcaaaagttatacattcacaatatgcttgtagaagattcatgttaaatgtggctttgctcatagttttttaaaactggtagttttgactacaaatactaaaataaagtttattaaaattttttcacttttcaaacaatcatcttagtatagagacactgccttattcatttattcattcaatatattcagataattcactattttctataaaagaaaaatgcccatcttgattaatgagatcatctatgaagcaattgtgctaactttcctaagtttcatacctattaatttcaaaaaatttccactaatttctgcattataagatcgattgaatgggaacatctaatctgtctttacaaaaccctttattactgcaactataatctgtagattttaatactgttttctgatattttcatcaatactgcagaagttgtccatatctatcacaaaattcacgacctattttaagtagctaagttctcttaaattttactacaaagtaatcccaaattatctaaattgattattccatgagtcatgagcaccaaaacatggtatataaatgagtgtactgcttgatggagaacattgatcagctgactcctgttcacccttgatcttgccatcccacatgtaccagcacccacaaccctacacgttgtactcctaggtgatggcaataagaatacagaacagctagagctatttgccaagctgcagaaatagcccttggtgatataaataaatgatgtcacaaatgacaccaagttttcaagcttaagtagctagaagaaggtgtcatcattttcaaagaagaaggtgtcatctttttcagaggctagaaaattgagatggggagctgatgcatgtcatttggaacttcttgagtgtggggtgatggagaggcattccagttaaaaagcagtaggcagtcagatgtgtgataactgaaacctgagtaagaaaactgggatggaaatgtaaagataatactcatctgagagaggggaagattaatccagagagagagaagcagggacagaaaaatagaaatataaatgaatggatgaatattaacgaaaatacttaaataatgcttaaagtgagaacagagtaagaggatgaaaagaaatgcatttttttaaaaaagaaaaaacaggaaagaaaatccaacaaaatatattcattattaatttattcaaatatttattgagaatccactttatcctaggcaccgtgttagacactggggcaaggaggaatatacagattcaaagtaaatatggccgctggcctcaaggaatttatagcctagtgaagaacagagcaaagcactggacaaataacacacacatacacacatacagaccaataagagtaattgtaataaatacgcaaaaaagaaaaaaatcaaaaacaaaaacaaggtccaggtgctgggcatatataaagggcagctgcctcactttgcctggagtgttagagaaagttacactaagaaaatgacatacctggcaaatgagtaataaaaaataataataaggaaaagtgatcaccaaagtcagagggagcagagtcagcaaaacaccaaggaagagaagaggaaaacacacaatggagagcaataaagagccccctgaaaatcttaaagtggctttttttttttttttttaccatttcctcctccatttaccatcctagtccaaaagccaagtgtaagcaggcagttcagggctagggtttgggtcagggtggacactgctaacttgttacccaatacacattcaccagttctacctactaacagaaccccacattttttaaggtagcaatgagcctagacaaattactaattttgccggcctgccttgtagctaggggtgactatgacaactcagaccaaaaagtcatatgcaggaggctgctaaggattaccaggaagttttgctttcccaatggtaacacagcccctttctgcttgacacctgattttctttttcttaccttgaacaacaggttggaagtggatcagtcatcttgtaacatgaggcaaccataagaatgaaagccacgtactaaggaagacaaaagggaaaaacagacgacactagagctttgagggcatcctggagccactgcatcagttccagactgtctagctgtacactttgttacgtgagaaaagcagactcctatatggttaagtcagtgtagaccagtttcttttacttgaaatcaaatacaatccctagctgatacagggttgtagtgggatgggaggaggagttattattgttaaggaagtgatcaaagtagggatgacatatacagaaacaaaaatagaaaccatttcaagtccctttttacaatatagacacagttactacacaaacacatgggataatcaaactatacaatgaatgtgttaccttatttaggataaggctttagaattataaacgttatctcttggaagctttgtagctttaaactattgaaaactggtatatttaaagacacagttgtcacatcataacattgtccttaaaaacaaactttctccattgctgtatatgactcaagaccatctgagaaggtaatgggagtgttgttctgagagctcagccaggtgctatagcaaatggttagacatttaaatagcattatttatcataagtaacatgaaagaattatcttacagtctgattccaaaatgtatgtcaatttggcagtaaaccagtgcctttttaattataaagcataaatagatttctaacatttttcttttcctaattatacacactgatttgtcatgacactgccattttgcaggatatgtaaaaatcagctctggccagcttgaacaagtattacaaacaccaagaatcattacacgggcacactctataacattgtccattgccgcacaaatttcactgtaaggtgtgtccaatctgatacagctttgaagtcaaaaaccttaagatttgaatcttatctctattgaatgctaattatgttacccaaagcaagtcacccaatctgtctgagctttggtttcctgaatacctatattttgtgagtattaaatgagatcctttataaacaaacacaatgagcacaaaggcctatctacaccactgcaagctctctgcaaacattatctcctttctcttttgccctttctctacactgaactacatttgaggaattttcattaaaagaaacagaagtaaaagctagtaaaattcattcctacagaacagatcccaacctaattaagtgtaacacaaaaagtgagtttctacttaaattctgaggcaaagattataaatacacagaagcccaaatgtggcaattgtgcctattatcagaatagcatgcagaccataaaaagaatattttaaggactgtttccattttcaaaaggctagtaagttagtattatgtaatcacaaagctatgctagaaaagaactttcagcagtcactctcattttcccaaaaatacagtgtgggtcatatgcctgggcacagccctgagcagagagaggttgcacttgggggtagtgctccctgatgaattcaccctgctctcatctttctgtgatctctcacattcacagctgtccatctccctcaccttgaaccagcacagaaataaagaaaacaaacatctcccctaggagagcagccagaagccccttaccaagcatcacctccctgatgagttgtctttctgactatttcacttcttttagggcagtctggcaggcaagggacagtaagaacaaaatgtttataactctagtgataaaacagtagccacaatcatggatacttagaattcatattttcctgcaggaactaggtgtgaatggtatcatcatcttggccaagctcaaaaatgcccattcatttaatacaaatgtgttacctcactggttccctcctaagaaggtgaggggaagaaccatcatcacctagccttgtaattattcagattacatttcgttttatgtgacagtggtcaaatttgtattattcttctgttgccctaattatcatcataaatcaggaaacaagaatctcaatgtccaattaccattcagaatagatagagataggaaattaaagctccttttaagtgggagaaagggcaattccacagagcttcccttagctaagggaatggatactgtgctgaatagtacattattgaagaagagataagcgattgtgtgatgtgcaattgccaacactttctattctttcaactttagttttaaatgcttacaaggaataacatcttcacatttttcaaaaggctgctacaggagaaagccacttatgctcacttatattcacaagtattgcaaatacagcaaattattacttaaagaagaaagaggaagagacacagagaccaaaagaaacagaaagactctgaagtcttggcttccacactgtataggactttggccaggaatgttttccactgaaaccctgccctcactactatcctacacctccccagctgcttcctttaaggaactgaagccagaaaggtactgcagagggaaattttttttaaagaaatcaacttctcagaaatataataagcccaagcctaaactgttgttttctctccttggtaatttttatttttctaatgataaaagtggctactaagtgatgatactaatttccagcaatttaactatatgttacttctcaatgtactcattacagctatgtcactgtaggtggtataaaaaggtgagtcaatccagttgtttggacagttcaatcaatgactcaaagtggtagatcttgtaactctgtttaattacacctaaattaaatatccctagtagactttattcagaaaaagacaatacacatctgtgatgtcactagaaaaatctacttgccatgctcttaaaacagggacctcagctattgacataaaaacatttttagaaaaaagatttagccacacaactagtaatagttattaagtttgttagactgaatccaaccatttttaaggtggtaaatacaagattagattcagattagaaaggatactagaaaatacaatgaaaagatatgtgcaatttttatgtctctgactttagaggattttttaacaattttgtgtccttccatttcagtttcataattgagttgaatgccgatgaaacaatatgtcatccaaacctaagtcctatgttgtaggtgattaataattgatgacaatattaaaactgctcttatcagttctaacttttctggctaggaactagctggctcacagcccaaacatcatagtaagccatagttaaaactgcctttggatcttattagaataacaccacttattttcttcctttgaactgataatgtttctttttttttttttccaatacaaattttattatggcagcacaggtcactgtgtggtaactgtctgaactctaagcaatcttggaagcagtggttcttaagtatagttccaatgtggtctgtaaggatcttctagatgtttgaaggatttgtccaaaatttaattcatttaaaaatggagatgtatttaaatatataaatcagtttccattgcaaatgtcaacttataaaagacaaaatattatttttttaaatttaatgactataataattctttaccctacccaaagcaccacagaccactcatgcacccaaccctgacaggggaagagagatggagaggcatgggggtggagggaggaatggggtggggaatgaagggagaataagggatttcgcttcaggccaaaaggtatgtaagaataggttgggtccacagtttccaagatcatgacttctaggaagaagcatatgaatcaggaaagaaagacatcagagacagaaagagaatactttttactaatcaaaaaaatctcattaattgtaatgcaagagtattatacttgtaatgcaagagtattatacttttctgtacattttgtttcaccaatcacctaaattttacagctttttacaataactagaaggcagtgtagcatagtgacttcagtccaaaacccagttctcccacttaatttctctaagcttcagtttccccatctataaaatgagagcaagatctatattatgagaacatgtttttaaatacctagcaagatgctcaattgacggtagtaacataataaattagagtaggtgactttctagaaacccagctatgccccctcgccttagtcttgtgtggtctagcattggtgtgaagtaactgcacacttccacttacagggtgatttttctaataccctgaaaggatacttttatgttttcggtagtactttggttttcccaactgttttcttcataacgggttttctcggcttttatcacaggtgttttttctttatttagaagaaaatttaaacaattataaaacgttgtttattcatccattatttatagtttattattatggcaaatctatttttaaggctttgttatgaattagtgccaacaaccctcagaacaaaatttaaacaattataaaatgttctttattcatccattatttatagtttcttattatggcaaaacctatttttaagtctttgttatcaattagtgccaacaaccctcatgttattcatagaaccacacagtatgcaaaagggacagacactgaaaatactttccaactgtacataaaagaggttaattttcaaacccggacagtggtatttaaggagaaaatttgtctccaaatactcacaacagctagtcatattctaaaacctaaaaccatgattatttctcctttaagttttaaactattaattttacatttcaaagggatgttagcttagagccaaaaggttttgatcatttcatcaactaaaaactgtaaaactgaattcatggaaacaaaccccccaaaaatctccttggctgacaaaaatttccaatttcaaatccacagtcatccttcattcagtgtttgcacagctccatggaatcttgtttgctcattaaagtgaggccctccataaatagaaaaactacattggaacccactatgtaacacaaaatttctaaatattaaaagccataccatctgaagggcattttagaaaatgatcagtaatttttctaagatgtattcctgacactgcctgtaacttcaaaatatctctgcatgtagggaggactatttcacgtgttccttttgatattaaagtcttttctccaaggctaggcctgtaaataaagtaataaagtagcttttttaaaagagggaatttagtcaaatatggaactggttttacatcactgcactgctactcatttgcttgacgaaattgatagcttgtcaagtcttgtatttggctattaacagctgccacctcttctacagcattgctggtgcatattcttataaggattaaataaggtaagattaattaatatgcctggcccagggcatggcacttagtgagcactgaggacatgacagctgttaatattttaatagcaattatttcacaattgctatgaagctaagggagacagaaagatttgtccagcattcaccatcaggggtttccactgttttctggggcctattctgtattcatcattaacaatgacaacaacaattgagatgttaatacgatagtcagaaaatagagctagttactgtggaactgggtctccctgtttccacactcgtcctgtcctctccattcttcatatgtcactcaaaagcatccttctaacacacaagagacgacatctctttgctgactgaaaccctccagagacttcacactgagaataaaataaaatccaaactttcctgtggcccacaaggtctcccagaaattgatccctgacctcatcacatatcaggtcttccctccttcgagtcacactggacttatattcctggttttagcacctgctgttgcctttgcctgcagagctcactcatgttttcacatggctgggtccttcttttcatgcagacatcagctccaaaaggccacctcctcagggcaaccccaccacaccctacctagaaaagcctcatccctcccactccactgccctgcccttcatacgatctcaccaattccattttatttccttcacttcctcctatgtttttgttgttgtttttatttatgtaataattttatggaaaaatctctgcttacgaggacataaacataaggccatttcccctaacagtgctatgtcaactcccccttcctgagaggaatcagctcctttgtagaaacttggccaaatcctatagcttctcagccacttgagcctaagagcagtcccactttgacatttaagacttggccctattcattttaaaatatccatctcaaaatttattcaaatctaggctcttcctgttcccagaacaaggtagactacagggtcttttgatagagagtggagtgaaatcccctctttttacacacttcttttcataatctccttaaacttcttactcttctttcctcagacactagacccttggggaccatcaataccagccaccatacccaggagaaaagctgcatgaaggaagagactctttattttctattttgcttgactgctatgaaacaacaatattgtcccccatccttttccttgccaaagtgcagtgttttagctccgctatgtgctagtttagagactgggagctgcctctcttttagtcccacagtccatttgttcatttattcacatgaacaaacatgtactggatgctttgtatgtgccaggccctgtgctaggtgcaggaacaaacatttcttggagtttcctgtatcttcaatatttacatttattttttttcaagttgtgtaccactcactggaagtcaatatcctgtccagagacagtccacaagggagctggcgaaaagcagactctattttctctattagctgtatcattgtcattctgaaaaatagaggagctaggcttgctcccagtagaagcaactagagctactttaatttaacaattagaatcatatcatttctaggtgatttatatatatatactttaagttctagggtacatgggcacaaggtgaaggtttgttacataggtatacatgtaccatgttggtttgctgcacccatcaactcatcatttacattaggtatttctcctaatgttatccctcccccagccccctgccccctgacaggccctgatgtgtgatgttcccctccctgtgtccttgtgttctcattgttcaactcccagttatgagtgagaacatgtggtgcttggttttctgtccttgtgatattttgctgagaatggtttccagctacatccatgtccgtgcaaaggacacaaactcatccttttatatggctgcatagtattccatggtgtatatgtgccacattttctttatccagtctatcattgttggacatttgggttggttccaagtctttgctattgggaatagtgccacaataaacatacgtgtgcatgtgtctttatagtagaatgatttataatcctttgggtatatacccagtaatgagattgctgggtcaaatggtatttctagttctagatccctgaggaatcgccacactgtcttccacaatggttgaactaatttacactcccaccaacagtgtaaaagcattcccatttctccacattctctccagcatctgttgtttcctgacgttttaatgattgccattctaactggcatgagatggtatctcattgtggttttgatttgcctttctctgatgaccagtgatgatgagcattttttcatgtgttttttggctgcataaatgtcttcttttgagaagtgtctgttcatatcctttgcccactttttgatggttttttcttgtaaatttgtttaagttctttgtagattctggatattagtgccttgccagatgggtggattgcaaaacttttctcccattctgtaggttgcctgttcactctgatgatagttgcttctgctgtgcagaagctctttaattagatcccatttgtcaattttggcttttgtcatcattgcttttggtgttttagtcatgaagtctttgcccatgcctatgtcctgaatggtattgtctaggttttcttctacggtttttatggttttaggtcttacatttaagtctttaatccatcttgaattaatttttgtataaggtataaggaaggaatccagtttcagctttctacatatggctagccagttttcctagcaccacttattaaatagggaatcctttccccattgcttgttttcaacaggtttgtcaaagatcagatggttgtagatgtgtggtgttatttctgaggactttgttctgtcccattggtctatatatctgttttggtaccagtaccatgctgttttggttaccgcagccttgtagtatagtttgaagtcaggtagcgtgatgcctccagctttgttctttttgcttaggattgtcttggctatgcaggctcttttttggttccatatgaaatttaaagtagttttttccaattctttgaagaaagtcagtggtagcttgacagggatagcattgaatctataaatcaccttgggcagtatggcctttttcacaatattaattcttcctatccatgagcatggaatgttcttccatttgtttgtgttctcttttacttcatcgatcagtggtttgtaattctccttgaagaagtccttcacattccttctaagtttgattcctaggtattttattctctttgaagcaattgtgaatgggagttcactcacgatttggctgtttgtctgttattggtttataggagtgcttgtgatttttgcacattgattttgtatgctgagactttgctgaagttgcttatcagcttaaggagattttgggctgagactatgggattttctaaatatacaatcatgtcatctgcaaacagagacaaattgacttcctcttttcctaattgaatagtctttatttctttctcttgcctgattgccctggccagaacttccaatattatgttgaatatgagtggtgagagaggtcctccttgtcttgtgttggttttcaaagggaatgactccagtttttgcccattcactacaatattggctgtgggtctgtcataaatagctcttattttgagatacattacctccatacctagtttattgagaatttttagcatgaaaggctgttgaattttgtcaaaggacttttctgcatctactgagataatcatgtggtttttgtcattggttctgtttatgtgacagattatgtttattgatttttgaatgttgaaccagccttgcttgcatcccagggatgaagccaacttgatcatggcagataagctctttgatgtgctgctggattcagtttgccagtattttattaaggattttcgcattgatgttcatcagggatattggcctaaaatcctctttttttgttgtgtctctgccaggctttgttgtcaggatgatgctggcctcataaaatgagttagggaggattccctctttttctattgattggaatagtttcagaaggagtggtaccagctcttctttgtacctgtggtagaatttggctgtgaatctgtctggtcctggactttttttggttggtaggctattaatgattgcctcaatttcagaacctgttattggtctattcagagatccaacttcttcctggtttagtcttgggaaggtatatgtgtccaggaatttatcgatttcttctagattttctagtttatttgcatagaggtgtttatagtattctctgatgatagtttgtatttctgtgggattggtggtgatatccccttttatcattttttattgcatctatttgatccttctttcttttcttattagtcttgctagcagtctatcaattttgttgatcttttcaaaaacccacctcctggattcattgattttttgaagggttttttttgtgtgtctctatctcctttcagttctgctctgatcttagttatttcttgtcttctgctagcttttgaatttgtttgctcttgcttctctagttcttttaattgtgatgttagggtgtcaattttagatctttcctgctttcttttgtgggcatttagtgctataaatttccctctacacactgctttaaatgtgtcccagagattctggtacgttgtgtctttgttctcattggtttcaaagaacatctttatttctgtcttcatttcattatttacccagtagttattcaggagcagattgttcagtttccatgtatctgtgtggttttgagtgagtttcttaatcctgagttctaatttgattgaactgcggtcggacagacagtttgttatgatttctcttcttttgcatttgctgaggagtgttttacttccaattatgtggtcaattttagaataagtgcaatgtggtgctgagaatgtatattctgttgatttgaggtggagagatctgtagatgtctattaggtctgcttggcgcagagctgagttcaagtcctggatatccttgttaattttctgtctcattgatctgtctaatattgacagtggtgtgttaaagtctcccattattattgtgtgggagtctaagtctctttgtaggtctctaagaacttgctttatgaatctgggtgctcctgtattgggtgcatatatatttaggatagttagctcttcttgttgaatggatccctttaccattatttaatgcccttctttgcctcttttgatctttgttggtttaaagtctgttttatcagagaccaggattgcaacctctgcttttttttttctttccatttgcttggtagatcttcctccatccctttattttgagcctatgtttgtctttgcatttgagatgggtctcctgaatacagcacaccagtgggtcttgactctttacccaatttgccaggctgagagatggggagcctccttgttagataaagttccatttttaatagactttattttttagagttttagttttacagcacaattgatcaaaaagtacagagttcttatatgtcctctgtcccccaacctcaccatacaacaaacacacaacctaccccattatcaacactcaaaagattctttttatgtgcctggcgaataaaaggtgttcaaggttttatgctgagtcagtatagtcttgaccaagaaatctgcccaggtgaggagtggggttttctgaaggcagcaccctctctgctacccttccagggggtggcgatgattcttttgcctttcctcaagttgagtgcttcaaactcctactcctacacattggtccagctcctgcaccttggccactccccagatgcctacaagtggagctgctctaacacctgaggtcttctccctcatgggaggaaaggggatagctcagctctgaaaaagcactccccagaaggttcacccctcccagtcttcttatactgactggtgcaggtgggcttagtggtaaggttggttcttacccagtgcctctcaataaatacttcaagagagctattccaggggccagtagcaccttcaacttagaaaaaggggcacttaattttctggtcctcaactttgagccaaagccccaattctaggactaacgggggaataccgttgatatgtatcagtttactctctgtttatctcaactcattcttttattaatcttcaccatctcagtctatcctcagcacctagaacagtgtctgacacataatagtactcattaaagatctgttaaatgaattctatttggaacacttctaaaccagggaattaactacatcctaatgaaacccataacatgctgaatagtactggtagttcaaaataaaaagaatctcgtgtccatttagctaaaatgtgcatctatttaacctatttcggccaacttaacaacaggaaaactactttttttcctacatgacatcccttttaaatgttcttggatagaaaggatgtccccgactcctctttttcaccaggcttctaatgttacatggtttccagacccactgaccatcttggctgaccctctctgaagaattaatattacttttaagatgtggtctaccagtgaagagcagctggactataacttcctaagagctggacaatcctcttctgttaatgcaggttgcacttgcattaggtttggggcatttgttatataggattaatttcttcagcagaggaaccacacagttggttcacatcaagccaactgtgtggtcaacacaaaccccaggttttctttatgtagattactgtcaaatcagacctccacatcctgtattggttcaagtcacttcctgaaatataaatgctgaatcttaaatttagctccactacatttcttccttttgtttttttccccttgtttcagtatctagaggctttaaaaatgttggtatcatattatttgtcattatctgcaaatttgacaaacatatttctctatgtccctatttatactatttttttaaattatttattttcaattacctgaagagaatggagccaaccaagagccctgaaatgttctagagacctccatctggattggccctttttgaacatggctgctcctcccactgcaaatccacctaaatccatctaatggtgccctcatgcagttcacatttttattgtatctctctgttacaaactctaaagcttttaagaaatactctgttgaaataaaaatacagtacatcaacaaattaataagatcaccttattctcaaaggtatgtttatgttagtgcaatatatgtatagagttcacttattttcttcataaaaaaatcatcgagttatctgctaaagcactaaaaactatcctaacatcaatactgttgttctgaacttccaaaaatctttgtacctttgttgaaaatctcaatacctctccatcttcagattcttcttaagctccataagtgcctgcagaactccaccatttccagggccaaatcttcacattctttaatacctaagaagttctacatctgtgtctggggcagtgacagtgcctagaccttctattttctcctcatctaccttaggaattaattagttgttcatattcatatgtcttgtcctccctgtcccaatttgaagattattagctcttctagaaagaaaaaaatagaagtaaatgaagatgtgaattggtctttcttttctccatatctatcctatcacaccatcatgtccaagtggtgaacctattcttttactattcctgttattccaaatttaaatctaaaatatatttcatggttcagcacttttcaaagctacagtttgttctctttgtgaggcccagtgacaccactgtgctcatcccaggaacttaatcctcacagacatgctccaacagctctcacactttctactttagcgtttcctgtaactgtgcattgctatttccctcaggactcctgctccaggacactgtcacattcaactcactttcactggttgggtgactggcctctagcagcatttcagaggagtgagctctttttgcccatccgtccacacccccatcaggtcacactcctgggacactcaaattgtgcagtctaccaccaaagaagactattccaaccatctttctagcaatgctctgctccttatagaaaattgaagccctgtactttgtaaaggttcatttactgtctcaatttggggtacttaaaaaatcaatagcaatcttaattcccaccagagataaatagcccaaatctttaactatgcatgaacaggggaaatttaagaaaatataaaaagaccacatagccctcaaatcatccattccctttgcagaactccaactctccccagtatggatctcttccagatttgggtacaagaggggatgactaacagcttgtggtttttttctataagataagaaggataaaagttttctatttttaaattttatttttgcttttttgttgttgttatttctactaaatgctgaattgaaaagcatcttttgctgtacaatctagagagaaaggcttctatctaaaacttctcccaaaggccattctagatatccttaatcagtggatctccagaaactaccctgaggcctttcgtttccttttttttttttttctaacatggtatcttgttttaataatattttcttgagcatagtgacaagaattttttcagatgttatttttgtctcctggtctgttgctttatttttttaactcaatttacaatgtttcctccacttaaaaattataaaaatcttcttctgtgttaacttctaattcttttgatctatagacctacgtaacatatgctttaatcagattgaatagcaatattctctttctttggcttcatttctccagcctaaaaatcttcagcttttaatttttttttaagtttttcccaatgttccatattacaagccttacattattcttgagacttactccaaataatctctatggcccctatgtcagattaggacacctatatctctagtaataatattaattataattgtaagtagtagaaatatctaaacatttattgagcacctatgtaccatgaactgatcagctcattttacctgtaccacttcatttaaaccttacaaaaattttattttacagatgagaaaactgaagatttaaaaggttaagtagtttgctcaaagttatagaaatcatgtatgttagaaccagaattcaaacctggaaagctgggttctttctccaaatctcatgtacctcatcatggctttctattgattatgcagaacactatatacacttctcccacaaacctttagatagaagggactttcctaagtattaaaccacaactcctatgttttaagagatatagagaacaatcaccctcatataaattctggacacataaaaagaatagactccattaataatgaaagctaaaatcacatgtgtaaacacattgcttttaatctattcaattatttccccataagcactaactgtgcatcacaaattatggtgtctaaaagacataccacaagagttaaagctgggaagattcattgtcattctctaatggaatagttttctgaaagaatgaaaattctgaatctctaagatggaatgcctccatccactgtttctttatcctgtttatcaaattggggaaggaaatgcaagacaaactacacagtgatatcactgcataattaattggtacatctctaccagttacatataaatacattttcttttcatgtactttaatttaggagttgcaaaccaaccatgctaagcagccaaattcagcctgcagaaaagccttaattgtcttacacaaatgcatggacagtctccagtttgccattggcaatactattccctattgtgtcacagctggcctgttatgatatgtttatatagcttgtaacaaccactataggcatttgagtttatgacccttgagcagatcaaatgactacagacagtaagataaaagcccatattacagacctcattatctgtactacaggtacactgccccaaaataaacttaagaggtaaagcagctaatccactgcacaaaaaaccaacagttgctctgctatactaaccttattccccctgttccttcccttttccctcttcatatccagacctaaatggcaaagtttatctttgtgcttgttgttgactcaagttcagactaggaggctgcagagtcagattacaaaattggttatacaatctatgtcacagaggtacatccctgaccttacacaaattcagtgttttcactagtacaagctccaggggataaaagcaaaattgtactcactttatccctcaaataactctgaacattgctgtagagtagatcatggagacaaaattggttttttggaaaagaaaagaactaaatatcattctttcctccctaaaaatagcactactgtaggaaatctcataaaactctgaactttcactcaagccatttcaaaagtgattggttggggtgggcatgaaaaaaaatatctgcagagctttaaaagcaaatatttttaaaagctaggaaagtgagcatggtcataaacgaaagcagctcagtttagattggttgccagtaaatagccagaaaaagaacttcagccttcaaaaagagatttcaaatacatctttgtatcactgaaataatgccaatgttggaaatatttgaaaatatttgcagagctgtattttagacaacgaatgatactccataaaaaacaattcttttcccactgtggggcagaatgtcaaaacatgacaagatcactagcccagatcccctggaaaacaccatagaatcatttcaaaggcaagagattacaatgatatttgccttgttaaggctgtgtctatacggtgccagcaaacccttgattaggttgattcactcaagcaaccagtcgatttcgtgaaacatttactcaggcctgtgtagtttgcataaattaaccaagtgattgattgactggctggttggattggttggatacttggctggacttcaactgactgctctcccacatccgcttcagccacttggagcgcccagccacagtagtctcttcccaattccactctccacaaggctattacttgtttctcagcttatctctctaactaaatactgagctcctcaaaaggcaggggcagcttcctctctatcttccaccttcagcacagtgatgagcatcagactccacatagtgtgagaaatcagtcaatggtgtggcaacttacaagctgccctttgacataattggaatctgtgatgtttcttaatccccacagatttcatcatgcctagagggacctattaaaaaatgttagttaattcttcccgtagaggagccacacaggctcccatccccatactgcttccctctcagatggcttttttcactctgttctcctcttgagcctctccctcttctaattccacatgtcacgacttccaccaagcattccctgacaatatgacaggtatttctctcttctgacttccgctgttacttgcccccaacatttgggcttttaattaccaactactggcttgctctatatttatcagtattattgcgtttcactcgcctcaaagattatgaagccctttgagatttggaccagtatatttgttaagctaattccagttggctttcttgtgaataattaacaagtcataactatcagttgtccagtgttctacactttatttcactcaattggtataagtgcagttctaattcttatacctacaccatattaaaaaaaaactgaggtatagaggagctaaggaatctgcttatgatacaactagtaaatctcccttgtacccttcttaatggaagtggggtatctttctgttcagtcgcatatcctaacaaaaactcttcagttttcctgcaagaaaactgcaaccctttctccagcattattgttaaggaagatgactgttaacacagaatccacaattttaatgcaaactcatggctacccaatctgtatcctcaactaggtggaaggaatcctttgtatttgatggcctgcctggagcacctatatattgcccaaatactcaaaactttaatgcccattttgcaaggaagagcagcagatccccaccctgggatccccatagtattggccctaataggattgcttgtattgagttgctactttgaaagttgccatttggtttggtcaatcatagagccaaatgtggggtttgaccatgggtccatggctaggagattgtaaggacactgcttgttacgccgcacagagtgcccttcattatgattctggggagagagccctgtctggttttagtactaaggacagacttttcccagagcaattgttctgtcttttcttctggatcctacggcattttcaactaaccaggtttttctttttggttagagctaaatttatgacctatcctaagcaagtaaacaggttttatagtcatcttaatcttgctcctggttctatttaatgacccacatttacctttccttttaattttctcctgcttttaatttaaaatagacaaacagaaggataagagccagagagacagaatattgcttacccctcagcttctctcagtgcctttgctcaaccccacacttcctcccacataatcagctcaaaaaactgatttaagaaaatcattttacatgatggtgaaatggtttttaaccaatgtttgaatcatagatccctttgctaagggtatagatcttctcactaggaaaaaaatatacaaccctatcaaaaatatttcaggaactcatggatctctgaggctgaagccatgtctatggattccagagaacaaacccttgcttgggtgcatacacaaggcttctggtatccccaatttgcctcccaggacttgctccaagcccagaagacttgggggaattttccaagctactgtcaccaaggaagagcccaggtctctcacctgtctgagcctctccctcccccaacctcacttctttcctccctgaccaaagactgtgacatgctggtccctcttgctctgttcttgcccccactttatgccacaacttacctggcattctggacactcatctgcttcctttctctcaaagtattaccatcctgctgcatccatcagcccaggctgcaaaccccaaagttttgctgtctcacaatttcaaaggaggatagagggagcaaggagtgggggctactaggaccttttaaattagaggacaaagaggttaaaggagaagcctgcagaaccacaaacaatagcggagatatctcagccctgcagaacacaggatcacaaggagtcatagctagtcagatgctgaattccagacatgtgcatgcacgtgcatgcgcatccgtgtgtgtgtgtgtgtgtgtgtgtgtgtgtgtttagttacactatatatagtgtcaggaaaaaactgccaacttggatgcttttaatatgtacctcagaattaatgaagaaaaagtgaaaacatggtttgactatgtaaaagaaatgccaattacagttacatatgaaatacatgtatcatttttgactattaattcgtatggcagtatacatatctaccactaatttttattataaattgcacttgatttgcatactgaatgttgttttctgtcagttgagcctcaaaatttgctgctcacaatttccaacattaaaggagacgttgacaggaatcatagcttatactccttttgtttttcccttagcatctaaataacatagcaagatatgcctggaaattgataatctagctgtggagaccagagtttgtacacatacctgaagccactgaagaaaaatataagacaatacgtaagaaagttacagtacacatgatttatagaaaaatacgagaggagaggatgggccaaagtaagaaaacaacatgaagaaaatgagctttgaacttacccttaaagaaaatatagcatataaatttggtgaaaggacattccagtccaggcagaaaaattgttttctctgacacacaagatatttaagatctaaagaactgtttatttcatattagtgtgctcattacattataataagcttcgagtgaactcacataaagaacttaaaaagattattttttaaatttatttacctacaagtatattcttgtcagttaaaagaaagagaaaataaaaaattcagaagacagaaagctacctataaaactttaataaaaataatccattgtaaaaatggaaaaataaaatctccaccagtgaatgacatacaaaactttatattatctgctaaaatggagtggtaggtatttctttatcttcttggtttgaacctaatagaacaatggctgtatttgaccaactaacaactagaaataatgacagtggatagtgaattcatttaatcatggtaaccatagccaaacttattataacatataaagtgaaatgcctgaaagacaaagttaaagctaaagactttgggaaacctccaaaataggtaggaggtcaaagagagccctcaccccacagttgtctctgaggcttagcaaacttagtgcactgcaatctgaaatcagagggacccattatggaggctgggtatattggcccacttcctctaaaaagtaaaggttaatacaggattaaacatgaaagtagtttagtaggtgttatgggatgcactaaacattcatatgttgaagttccaacctccagtagctcagaatgtggctgtatttagtgacaaggtctttagaaaggttaaaggactaataagttaaaatgcagtcattatgacgggcccagtccaataggactggtgttcttataagaacaggaaattgggacacagacacagagagaagaccaaccgaagacacagggagaaaagaaccatctaaaagccagagagggaggcctcagaaaaaagcaaccctgccaacgccttgatctcaggcttttaacatccagaattttgggaaaacgaatttctgttccttaagccactgagtctgtggtatttgttgtggtagtcccagcagactaatttatttgggggaaactccttggggaggaaatgaggagggagcctgtggagggtgggaaaactgtgagtccacaatgctggtctggtctgctcttgagtgagaaggggaaggggaaggagaaggggaaggggaagggcaagagaggggaaggggaagggcaagagaggggaaggggaagggcaagagaggggaaggggaagagcaagagaggggaaggggaaggacaagagaggggaaggagaagggtaagagaggggaaggggaagggcaagagatgggagtgggaaggggaagtggaagggagaagaaggggaagggagaggaaggggacggggaagggagggggaaggcgagggggaagggagggggaaggcgagggggaaggtgagggggaaggtgaaggggaagggagggggaaggggaagggaggggaggggatggggaaggggtatggaggggaaaggggaaggggaagggaggggagggtgaggagggaggggagggtgaggagggaggggagggtgaggagggtggggaggagggaagaaggggagatgggtgggggaggagggaggggaggagggaagaaggggagatgggtgggggaggagggatactatagtccaggtctaaggcaagttttgcaagactatagaggagtcctgtatctccaggaatgggctgctttagtctccctgccatgctgagtcagcaaccaagaacagttcacgggcagcattggtgatgggtttcagagcagagctgttgggtttgtcagtttattacattccaatacctgagaggcacattctcatggccaccacactggaagacctccatcactgtggacagtgcccagcaaggactttacactcagatgccacaaatgcccatccaaatttccactgaatgaaccacgtttcctattcagttaccgatgtgaaactacagaatcatctcattttctctcaaggacaaatatttcatgctctacaagagtaaaaccagtgtagccaaaccccactgactgaagaattatagctacataaaagataactgtcctgcaagttacttctgtattccttgtgaaaaaaaaaaaaaagagactggctacccaaattaataatgtaaataaggacagtgatggccccactgaggcttgtccaaagcaaggcccagtttactaaccccggaatgggaagatcaaacctggtgttgggagtttggtcccaagttaccacacaaactcattctgcttctcacctttcaagcctaccttctttcctttggatggggaatcaaaatgcctctttcttaaagctacgagctgtctaatatgctacatgaggaagagaatgggaaaaacaaacagtacatgaatagaaaaatgtgctggatttaaagcaaaaagatataactaatctgacatgtaagtccaatccttgcatctccaatatgtagcatagtggttgatagcaggtgttcaattcatgtttgagaaataaataatggcaaacgcattgaattagagttttatagtgattaataataaatgaaagtagttcctttaaatgatagtaattagcatgtctgtggtcaggcaaggagggggtaaattacccagagcataaagttgcagtgaggctcttcttaagttctctgaatcaagggccagtcccaaaagcaggggaacaaaatggggcatagacagtggactgggatcagcaggtttcagggcaggtttgcatctgtaggagagaggaggctgaggtgttccattttacttcctttacaatgccggtgcagggtaacgtttaggcagggaaggctgaaatatatgacatatgggctcccacaaatcatcatcacctcaactcaaaatttatcagtgtcttccttgtacttataaaatagaagtttccattcactcattaattaattcattcatttagagccaatgatcagacgctatgctatttggggaaacacaaattaacaaaatgtattctctaccatttaagaggaagacaaatgtaccaacaggcaattatagtacaatgtatgagatatgctgacagagattatgttctatgaacaaaagttctctacaggaatatggaggaaacagactttattccagtgaacagtttggaaatcagagagacacagcctgctgtgtaaaatgaagctatgttccggagaacaatgagagtgttctgttttatagcaaaacctcctacccaggtttccagtcaggttggtttatgcaaatgaacgatggaaactagcttagtgctggttggctggcacagctgagttttgattgatcaatacagcttagccctgcttggttgatacagctgagccctgtttcatccagtcgagtcgagggagctctgattggttgagctctgattgagctctgtttggtttccaaacccaaaaccaggagtcttggctgatgtttctttctggtgagaggaggggggattgggcctccgttcatcttggcactaacaataggaactggtttagcttgattgtagaaagagaggtcctgtgatacttttacatctttctgagaacacaattaccattccttcccccagctaggaccacctggttctgttttaactttgagagcctcagcctcaaagattccattttcagtctgccaggggaatactttagagttcaaagggcctccagagcagagacaggggaaaatacctgtctgcagggtaagtaacaggattgcaacaggttggcatttgaactgggccaagtagagcaccagagagaaaggaaatgggttatatatctagacagaagagcaaagaaatggcaggtgccaaggcacagaggggtcatggttttgattaagatgaagtggggaggtgcaatcggtgataaggttttaggaagaaacggaaaaagaattttaaagataaaaccctttgcagattgacaaacctgacaaaaacaagaaatggggaaacaattccctatttaacaaatggtgctgggaaaactggctagccatatgtagaaagctgaaactggatcccttccttacaccttatacaaaaattaattcaagatggataaaagacttaaatgttacacctaaaaccataaaaaccctagaagaaaacctaggcaattccattcaggacataggcatgggcaaggacttcatgtctaaaacaccaaaagcaatggcaacaaaagccaaaattgacaaatgagatctaattaaactaaagcacttctgcacagcaaaagaaaccaccatcagagtgaacaggcaacctacagaatgggagaaactttttgcaatctactcatctgacaaagggctaatatccagaatctacaaagaactcaaacaaatttacaagaaaaaaacaaacaaccccatcaaaaaatgggtgaaggatatgaacagacacttctcaaaagaagacatttatgtagccaaaagacacatgaaaaaaggctcaatcatcactggccatcagataaatgcaaatcaaaaccacaatgagataccatctcacaccagttggaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttaacccagcaatcccattactgggtatatacccaaaggattataaatcatgctgctctaaagacacatgcacatgtatgtttattgtggcactattcacaatagcaaagacttggaacctagccaaatgtccaacaatgatagactggattaagaaaatgtggcacatatacactatggaatactatgcagccataaaaaaggatgagttcatgtcctttgtagggacatggatgaagctggaaaccatcattctcagcaaactatcacaagaacaaaaaaccaaacaccacatgttctcactcataggtgggaactgaacaatgagaacacatggattcaggaaggggaacatcacacacggggcctgttgtagggtgtggggagcggggagggatagcattaggagatatacctaatgttaaatgatgagttaatgggtgcagcacaccaacatggcacatgtatacatatgtaacaaacctgcacgttgtgcacatgtaccctaaaacttaaagtataataaaaaaaataaaataaaaaataaaaaaccctttgcggataggtggctctggagtcacctgcaggagatgctgggtagccaagggcatggtaaggcaatggacttctgaaagaacaatgaccaagaggtttctagagattagggggacaggagtcctaaagggggagctggagaataccaaagacaaacttgatttgttttacccttttcacacaagttacatatttttaaaacctcttcttaggacctaattttctcaagtcttgcttaatcccttgctcagaagggagaggtgaacagaggaaggggttcccccagcagcactgagctggctctctgatgaagtgggggcacctgtggaggggaagctcagagctcaccagatactgccaacagcagctgcacaggagggtatctgagaggaagctactgttcccagaataattaactctcttcagaaatcatgggcacagacacacaccctctctctgaagcagaaccaagctcaagggctggagatttcctgttccccaccatcaggtggacagcccactctccctactccacctgcctacagacaaggaagatcaatctgggtggctaacacaccttgccctagagtaaccaagattagaaagatgcatctacttttccacatgggacatgaaattgagtctatttaaaagttctggcacaatttagatattaaaattaattaaaataaatctgttactagcaatctacctaaattatgcatacaatgtttctcagtaggtactcttttgaactaccgtttagctaaaaaaaaaatcaatcaccaaggaatttaagtaccaaagtttggcttgaaacttcaaatccctccatgtcaagcaggaaagcagagctaatttagagggactgtccagccagggatggtgtcaggcaggctgagggcaatataatgattttgcagggaggtaattaaatgggacataacagcaattatagcagcaacggctaacatacactgaccacttccagtgggtcaggcaacaacatgctaagtgctttaagtgtattattttcttcaatctttttctttagtacacaaaaaaagtacaaaggaaaatatagcaaaacctacatatccaccacccaaaatttaaaaatgacattttgtcatatttgcttcagatttttttattttaaaaaagttgcaaatgaatttatactcccaaatcccatttccctctctgtttctcctcagaaacagccactatgtcatgaatgtggttcatattcagtgacattttcatattttaccatatttatatgtgcctataaatattatagagtattattttaggtttttatttcctgaaatcttttatcaactcaaatgcatgacttcaaagtctatcactgtggattaatttgttccattgcacttatcaactttgaacatactgtcagggaagaattttattttctgttttattaaataatgtataaatagtgtggcatattcatattctttgcccctgttttctatttcattatctggagttttttttttttcagtaatttgtaggagtctttgatctatcatatatcccaatatcttccaccaggatgtggtctagctttacctttgttttcggtcttcagtcattcaagagatgcctaactccaggcagtctaatccgttattttttccttacctgatatcataaaaatatccttttgtatctatatctacctatctatcctgtaactgtattctacatacagtcataaagtctcctttttttgcatttggtctctaatccatcttcaatttatttttttaaatggtgtagagacttaattatattttcatcaaccacaacaaaaaaatagattccattctttcttcactaattggcaatcccacctccaccatatacccagatcccacacgtgcataacttctcaagctacctcttctgttctctctatttgtctatccctgtgctaactccaaagccccatgtcatgtactgaagcttttttacaaatcaatatataggcaagtctttgttttttgcctgtttgcttgggtttcacaattgtctggctactctttcaattttatatttccatatgaattatagaatctgtcaaatctctcacacatacacaccacaaccagttgatatttaattggaatttcacaaaatgttttaattgattgtgactagacagcttttcaatacagaaacatcccacatatctaaataagcatagtattatctctctaatcatttcagacttttctctcaataacgtttatattttctattttttcctaagtaacatatagttttagttgatgttatgaaaagcattttttcaggtgggcggatcatgaggtcaggagatcgagaccatcctggctaacacggtgaaaccccgtctctactaaaaatacaaaaaaattagccaggcgtggtggtgggcgcctgtagtcccagctactcagaaggctgaggcaggagaatggcgtgaacccgggaggcggagcttgcagtgagccgaggtcgcaccactgcactccagcctgggcaacagagcgagactctgtctcaaaaaaaataaaaaataaaaaaaaaagaaaatcattttttctgttacatttttaatgagctagttctggtacagaagacagagttacttactagcaaatgtcactgtgggcaagctctttatctcgctgtgcctcagttttctcaaatttcaaatgggaataatagtgctacctaataaagttactgctggtgagagataaataagttaacacatgcctagtgcctggcacatagtaattaaatgcaaatgttagcttttattattaaaagaatattaatttgcatattgattttatatctaacggccttgaaaatttatgaattatcttgaattttcttttaaataatgatatactctgagtatgaacaaatttactttcttctttcttcttccttataaacatttctctttcttgccctattgtattacccaggactaacaatatcatgataaatggaaaaagaaatagcaacgttcctgtcttactctctttaaaagacatattctaaaattttcacctttactatttatgtttgctgtcatttttcgctaactataatactatttatcaggttaaggaaggccccttgcattcctagtttggtgtgcgatttcatcatgaataggtcttgacgaaggcatttgattttctctaatttaatccctacattgtagtctacactgaacatttagcaacaatatacattgggccaggggtcagcaaactacagcctacgcaacctgtttttgctgttaaaaattttttttaaaaagtttattggaaaacagccacacccatctgataacatattacccatggctgcttttaagccacagtgacatagttgagtagttgatacagaaaccatatggcccacaaagcctaaaatattgaccatttgaccccttacagaaaaaaactgctcaccctgatatacagcatattaaactgctcttgttacaactttcactctaaattgaggggttagtgaataagcaggaaaggaggccaaagagttttaagttttttttttctaacttctcctaatctctgttccttctaccttctttcatgtttacatttctctctttcctcttctctcttcttccccctttctttttccccttctcctttttttccccttgccattctacacttttaaaaagcaatgcagtccagatgcagtggctcatgcctataatccagcactttaggaggctgaggcaggagtatcagattgagcccaggagtctgagaccagcctgaacaacatagtgaaatctcatctctacaaaaaacagaaacacttagccaggcatggtgattcatacctatagtgccagctactggagcagctgaggtaggagaatcacatgagaaccagaggttgaggttaaggctgtagtgagcagtgatcacaccactacacatagcctgggtgacaaaatgagaccctgtttcaaaaaataaaaaataaaaaagcaatgcaaaatatcttcctttgattaaataaacaataaaactgtccaacatttttttcaatatgtagtgataaccaatatatagctaggtgctttactaagttactttaaaattcatttgctcaacaaacatctattgaatgctatttgcaaggcactgttctaggtgtctgaaatataacagtgaacaaacaatgattcctgcccttgggaagcttacattctaattgagggaaatgaacaataaaaatagagcaaatagtaagtgatgaaaaaaggaacacacagaaaatggtaagcgggaaggggaggggaaagaactacagttgtgtaaaggatattcagcaggcctctttgcaaaggtgccatctaaacaaagatttcaatgagagcatgaacccccaagcccatggcaggagcattcctggtgtgtccaggcaatggcagggagattgggatagctgggacagatgaagcagagagaataggaggtgagatcagagaggttatggagaccagattgcagaggccctggtgggctttactctgaccaaaatgagaagccactgaaagattttaaacagaggaataaggtggtctggcagatttttaaaggcttacctttggccattgtggtgagtacagtttatagaaactgcaaagccattcaagaggccatggcagtattgagaagaattcacgtcatttaatctctcagcagttggataagatatatactatgcccttcttccagatgcagaaagtaagatgtggaagtttaaataacttgccaagtcacacagctaatataaagcagagctggttttaaacctagagtccatccaaggtcaaaggttggtatctgaagttagactagtttggatttcaccttgtgaaaatgcttcataaactatttaatgtatgatattataattaagagtttcatgattttagactaatcatgtatattttatattttatgaatttttagataaatcatacttctaaaataaaaaactagttggatgctatagttccagactcctggattttgttcttgaatggcttatggataaaagcccctaagttttcacgtattagatttgcttcaaataaacctatagacttgggaatttatttactctagccctaggaactagaggctcgccattatattcttattctcccatagagtttcaaattatattctttaaaagacacttcatgactggagtgttgaatcttcttttttaagcctgctgactgataggtagattccatgttcaaatctcatcttgcacactgtaaatatcttccatcataattttagtaggtctagaaaaatcatctctctctctgttaaacatacacatacacacacacacagaggagcaacattactggcaagaatgataatatatatggaaggatttactaatgaaatatttctgtatattcttcagtgacaaactgggtggctttatgttaaacaacataaaagaaagtcatacaaatttgatctccagtttattcgtgttgagtttgtaaaccatgcacactgacgcaggtttacaagtaaatgatgttgagaaattcaaacacatacatatgtgtgtgcaatccatatgtggaaatgcagtcaataatttatatcaaccagccacaaatatttattgcaattattaaatggctcctaggcacaatcttaggtcttggggattcagtgctaagaataaatgggcaaggattcccatcctcattaagcttatagcctagtagggaaaccaaacaataaatacttagaagtattaggagagccatgagaaggagggaagatgtagagctgttcttaacatgggagcaaagccaggccagcatggtggagggacgatggtcacagaagacagccccatggaagtgatgcttaagctccacttgaaggacgggtacaggttatcaaggagaagagcaaagcagtgagggaggaaagaacttctcaaggaaagagaagggcttgtgcttgatagaggagaatccaatgccttaggagaaagaagaagtgggggagtctggtgtgcgtggtggaaagcagcacaaggtgggtgccacataaagtgatgctggagacaggcaagggccaggtcaggtagggctgaaagatatggatttaactttgaggacaatgagatgccacttaggaaggatttttagcagtagaatggcatatttagctcttattttttaaaggtcagtctggccactatgtgaagaatggactggaagggaacaagaatggagcacatttagaaggccattgcaatcacccagatgagaagtgcagtgatctggacagaagcagagacagggtagatgaaggtgaacagtttcaagtcaacagggactgactgtgcgtgggggatgtgtgaacagcaggagctgataaggagccctcattttcggacagggagggtaccaagaccattcagaagactggaaccatggaggaaatgctacttcacaccaggtacgaatccatttcaagtgtgttttagaggtagaggtaggagtgaaggtccattccagcaccaattctccctaccaacctgaattgtttattgcaaaagattttatttcattggtctctttttactgaaggtataaatggagtgtcatcttttcaaggagagagaaacagatgccctttgagaaggggagacggaaggggaaggaaagttctgaaggcagaggtgtccagagaagccgaagcatgcaatgggaggcacaggagtgagagtgaacttcaatagacacacactgacccaaaagagttgtgcatcaaagacacattctgataactctgcaacttttgcagagagccgatgacgttctaattgtaacatttccctttttactttttcttccttggtgaatggtggtagacctattgattacaccataaagataagagggaaaagaaggaatgactgcttttctcatataattatctttttaaagtccttgtcctggtttgcacactcaaaaaggaacacagaatttgcaattatagggaagttatttctgagcataattaaatgctctccatctttctctcacacaaaagcttgcaaattccaagctagtagatttttgaatcctatcaatcatttctatttttaaattatattccagatttattatatgatatactaattataatacaatatttgcaataatgaaaatgtatttgaatagtcaattggaacccacaagtcaactcctagatagatgccttagtggctctgaaaggtggtccccacttgggatttgttaaaatgcaaacacctgggccccactctgggtgtacagaatcagaaattcagggagtgaaactcaacagtctttttaataagccctccagttgattctgatacatgttaagattgagaaccacttcttcagcagtgtttcccaaccttttcccttcgtggcaaaaaaaaaacctgcacacgtaccctgaacctaaaataaaagtttaaacaaaagagaaaatgatggcatttgtacaataccccatgttaagtggataaggctgccagaggcttgccccagaccctatttgtgttggcctgagcagctcaccgtaaccttttcatgatccaccagcagaaaaactcagatctgaagaaactcacaccagtgcaaaaacaactatatatacattctttttgttaattatggcaccatttccaacaatgaaaaattatccaaatacaaattaacaaattgtgacatatttgtgcatagaaatactactcacagttacaatgaataaactggagttccatgtatcaacacagagaaatctcaaaaacataatgttgagcaaaaaaaaaaaaaaaaaaaaaaaaaagcaggttataaaacaatgcatacattttgataacatttatatagtatttataacatgctgaacaatactgaatattgtttgtggcatgcccacatgtagtaaaatcataaaggcatgcataagaatgatacatagcccttaggaaagaggaagaaggggaatcagggatgtgtattcatggggctttacccattttatttcttcaaatatctaaagaaaatatagcaattggttaagatgtgacctggggagaaagggaatagttacacatgggtttcttatatgacttgatgtatttttctgtatagttaaaatgtttcatgaaaatttttgataagaaaaaaaaatcagttggagtctgctatcaatttatccgagttgtaaacccaattttgtgttagctctttggtgttgggcagattactttctctctctgggccttcatttcccatttgcaaaatagaaggggctgagttcagtgacctctgaagctctctgcctcttgcaccctcttcaatatatattggtgctcaaatagaaatactcttagccccttctctttatcccctctatgcataggcaacaaccttctcagtagttgttccctgtccagctgtctaccttaatagccccttgtttacaatggccccagcaaatgggctggggactaataacacatcacaaagcaggaattgtagaacctgtgtttgaagatatattttaagacaaagagaataaaaataaaaccagaaaagtttggtacatagacaagcagtgtaggatttagaaaatgaccttgaatttgcaagcaacctttccttgaaggagaatcttttccctgagcaatgaatttcactaagtgaaagagaatttcaaatcaacattacagcaatgttcactactttattcctactctttaggcatcacctctatctccttatcgctcaccccaacattagatatgattcaatacaactaactagctttttcaatgaaagaaagcttagtttctcatgtttaggaactgattcctttgatcttccctcaagttacgacttacataggcaattccctttccaaataggctagtttgtagattctgtctttgaatgtgctcagtcatttcaacaatattaacatcataatattgatgaactatgcctacaaagggcgactgattttgactaatttattatttactacaaaatatttccaatgtacaaaaaatatactcaccatcaatatgtatttttaagttttactaatttgcacactcaaatcagcagaccaagttaaaatggcatcttctaccttgtgatttgtgacaccatatcacaagcttgagggttccatgctcctttttaggcacttggtgagtgtgatatggtaggaaacatatttaatgtatggttttagctctaaaattcactgactaagtggttttaggaaatcattcaacatctcttggcttcagtttcctaatctatgatatagacaaaatggactttgttatttacaaggtctccccatctttgaaaccccttggttctatggaatgacctaacaaatccattgatctggcattgtggccagtctcagtctaagttttgaactcttttggttgagaaatgataaactcattaatgagatgcaagctagattcaatgcagtgtgtatatgtgtgtgtttatacttacttatattgattatatacatatatgtgtatttcatttaacagaaggggctggatgcagtggctcatgcctgtaatcccggcactttgggaggccgtggcaggcggatcacaaggtcaggagttcaagaccagcctgaccaacatggagaaaccccgtctctcctaaaaatacaaaaattagctaggcgtagtggcgggtgcctgtagttccagctactcaggaggctgaggcaggagaatcacttgaacctgggaggcagaggttgcagtgagctaagaccacaccattacactctaacctgagtgacagagcgagactctgtctcaaaaaaaaaaaggggggggggaatatacatttcatcttggttattatacaaaaaattcccaatatctggcacataacagcatacagttaatacttactgaattaacaggattcattttaagttcatactatttgatatactatgctagtgacattaaatgacaatttctcttttaatccttacagtaactctgagaggtagatacttcttaactggtataggtttacagtactactaaatacgagtcaggattctaagtctgacttggcccatctcagtgataatattaatacccaaaagatagacatatgctttgtaaattaattttataagagcttcacccttgtatatctaattacttctaacaggcattcaacattgacctacaactttatatttcttccttagtactcccctgaaatttcttactattcactgttatgatgtgcctcgctgctgattaaaaaactaactcaaaactaaaataatgagggcccaaaatgagaattacttagtgggatccatccagaccttattcttatttaaataaatacagttgactttactacctgtgaatgactgactttggaaattatttgtggtacctattttatcccactaaactgcttaatatatcatattatgtacatcaacctcataactttctttgagggggttattagtctgtttggttataaaatgcagtcaataatatgcattgcattacagcaaaacatctgacagaaaacagaaaacaacatacccaaacagaaaagatggaaaaatgtagactggatgttagcgcaactagtaactcgttgaacatttgtacccaaaaggctagtgaataagagaagaacctcaacctggaaaaagaattgagccacaggattctgttctggacctctttctgttctcaaatattatcaatggcttagatagaaaacaaggtcctaaaaatgttaagacaaaaacactgagtgggataataaataggttgtataaaccaaaatagatatggtagtgtacagatatgggtcaagttgaacaaatcaaaatttaacagagataatcataagatcaaaaataataattctcaagtgcagaatgctaaaaaaaaaaaatagttggcagctacctagacagaaacatagaaactttggttggcaataaattcaatatgaaccaaccatatggtatgactacccataagctataccacctttaggtacaataatagaaacaagaaatttctgtaataatagaaataaaattttctcagagaggtgagattataggcctgctctccttgccaaagataacttaattccatgctgcagatggattttggtgttgaaccttaaagaaacagacaaactggatattcaatttcttataccagaagaagggaacatttttttaaatgatgtttttcgtctacagaaaagaaaactaaagaaggacatggcatctatctttaaatattttttaggtagtctatggaatgaaaatagtcttcatctgaaggatccaaagaggtcaaatgagaattaatacgctcaaataaaggagattgtgacttggcacaataaagaaatatatggtatggacttatcagaatgtgagttctcccatgttgggtagagggacaaaaggctgaacaaccaattagtagaatattgtatagggaattaagtcactagtgggagctttgtctgaatgaattttgaggtctcttgcaaacctgaaagaaaataaatccataatctacaaatggcctaaaagaaaggtgattgcaaaagacttattcacattactaacggtctcagcaagatatggtgtgaagtccaatctgctacccatccccaaatatttatatatacacacacacacactcacataacacacatatgcttcttatcaaggtggaaaaaacaccaaagccctcattagctcagattctactgtttcaaatgtgtaacaatgcagaagaaaataggatcaaggtttgctatctctaaggggaaaaaaaaaagtttgcgaagtgaattgctagggtaaacaagattctgggaggaagcttgaccttacaaccaaagtcaaaaaaacacaccattaaaaataaatagcttatgatttctgtacaaataaatcttcccaatttctcaatgacccattctttaactcagctcaggtatgactgaacagttataagtccttgctagcagtccttactgaatactacacacacttgaaaataataaagttattaaaattttgtttaattcagctttcctttgaactaggcattccccaagtttaaattaggtttcattaatttaagttatttcaggaaatttttgatgatatgttgctctacattattcttgagtacagataagcaagaaatggccatagatcattcccagccaacacaaagtaattattatctagaaagagataaaagtaatattataagtaaactattacctagaaagagataaaagtaagtaagtagtccaaaactaaccttaaagaagcaggagatcacacaaacaggccataaactgtagaagcacattaaatccaaagctgccaaattcatgacatgcctggcaggtctgcatgggtgcacaacctgagcagctgcccagggcctgtacacagaagggaggtacacttagctaatgatctactgtcaatgtcttaaaagtgtcaataatttttgaacactgggccccacagattatgcaggtggtcctggagactggcacataatggtgactgagatatgaaaagcaagcaagtaaaatgtatacacaccggcaaaatctaaaaatagctccatttattaatgaaaaacaatatcctgtaatcaagacacagcctgttggttaacgttataaagaattactttgcttgtttaatgtgtaaaccaatgataattcacaaatttgctaattgtttttctgtagatgtgagctgtcaaccggtggagcttaagtattcaaaagtaatcaaccaccatttcaaattccatcaaaaagtcatgtatcactttcaggagacatgaaattttggtacatttttactggagttgcagaaggagtgataaagcaaaagtgaattttaaaacaacaaagcaatctcctcacttcaccacagaaaattaaatgtagtgaagcagctttgtgacacttcagacttttccagtattctctggattgtgaactgacaaagctacatatgagtgaaaaaaaaaatttgaacttttgctcaaattatattcaccctaatgtggattgtaaagttcctttcaccagtgagaaacatacagctttatatccacgtttacagaagagaaagagttaccaaaactttaaatatcaaaaatatttttatgccactgtcttatatacttcagcataactcatttctaaacatgtaaatctagaaatgaagcaatcagagggaaaagttaagatgaagaatcaaacatcaaatccatcttggttctagtctaacaaatgtttccccactggatttcaagttcatgagtagagtctatgtagctctggagaaggtatttaatagtaacctagatttatataacaacatttgttccaaacaacatttgcatacatcatatagtttgtccatacaatatccctataaaaacaagaaaaaaaaagcatcctcatcattttaaagatggtagaactgaggcacaaaacatataaaggtttttccaagatttcacacatatacaaagtaaaacatatttgaaaatcatttctcctttttaacatatctctattattaaaatctgagtgcaagattattgttataaaatgtatgcccagaaaagatattagttacaatgtaatttcaattataaatcattttacctggcactctatgaggcactaaataatttttaacaaatatgcaaattaaaagattatattttctaaatctcattgtgaaattatgtttaaatttagcaccagctcatatcccacaaaaaaaaaaacctaatatagggaaaacttgtgatagaaacagtctattaaatgaaattatattttgatttctaaagctgccttgcaagaacagaggttacaatttctagaaggagccatatacaaatttaaaaagagccataattcatgcaaagaaacattttctaacctgtaatttatagttcagctgcctttctaaaatctcaagcttttagttaaataattgtagatttgttgctcagtttaaaaacccttctggaatcacgtctttaactggcgttgtgacgtcttacgtcatgatgttgcgtcaccacgtgatgacgctgtgccatcacaacacatcatcgcatattgacacaatgtcatggcataatatcatcaaattaaattcatcagcactccccacagcctggccccaggaagggcaagagagctttaaagtttctctttgttcttgtcaacacactcctggttggtaggcgagaacagcaactggacaaatcatttcctggtctattaaaacttcctagatctcaaattaggagaatttgaaagttacagcttagagttggaggaaatagttttcacggggatagatttcatggcttgttactcaccttgccccataactagttacacttgaatcccattttaaagataaacatttataaatgttagttcctcctttttttcccaggccctaaaataggatcatatttaggctggtgaaaaaaaaaattaatttgtttctaatttcttgccctcaatgtccaccttcctcaaattgttttccttcaccacaacattcctcttctataacattctgaaatagcaagtaatggaggataggaggcagatccagtcaatagttttgactacagacatttatataaggctggagggtgtgttgaaagctgtgagagagggccttttgccatcacaggcttggtgacaagcagagtctccgtgttagcaactatgataaacctgggcatttggatgaaacatttatctgaatgttatctgaattaacttatgaactcttccaaaaatatgtagttaccagttcattaaacataatgggcggtttgtgcagactgtcagtgtgtgacctctctttcattagttcatttgctgtgtgccagacactgttctaggtacaagggctcagatgaaacagaagaaacagtgtcaccttgaggtgctcacagagcaataagggagacaagtgagcaacagatttcaagacaacctgctaagggctctaatgatgatatgacagagtgttctgaggactcagaaaaggaaaggataatctagggttgccaagaagatcctataggggagagaacatatttttgtatcttgaaaaatgaataggcagagaagaaaaaaattccacattcaaatgcaagaattggacaagttggacatgtgggagacaccaaagtattagactaaatccgtcattttgtagatgttttctcaaaatgattggttcatataaattttttttttttgcttttttttttttttgttttttttgagatggagtcttgctctgtcacccaggctggagtgcagtggcgcaatctcagctcactgcaacctccacctcctgggttcaagcgattctcctgcctcagcctcctgagtagctggaattacaggtgcacgccaccacacccagctaatttttgtatttttagtagagaccaggtttcaccctattggtcaggctggtctctaactcctgaccttgtgattgcacccgccttggcctcccaaagtgctgggatgacaggcatgagccaccgcgcccggcccatataaatgatttttaagaggtactgactcacactcatattaccataatccttcatcataattacaaatagcctctagataactcatgaatacgctgcatcaatgcagtggagttttcttgtaggagcattttccatccatgagaccaaatatgttccttctctctttgtaaccaaataaaaactgaaaatcaaagccacttgtactttcttgaaagcatctgactagccataaaaaccttggcaacttctcttctggtgtgtacataaagatggattaggaatatccctgctgctgattcaccttttaaaacaagcactggaaaaacacttcagcccagccaatgataagtggttatatattctgacattaagccccacatgaaagtcactggtagacattttctacagctaccataatcctcaagaggtgtttagaaactagacataacaaaagaataaaaacttgaggggatttcagtcctaaaagacttcatctttctgagaattacatgacatcgaaaggcaagttttcaaacaagtttctaaaatgtcacttttaagctagacaaacacatatctttttagaggttatgagagcaattatttaaacttgataaaatatttaatgtatggctttgaatctttaatgtatggccaaataaatactcatatatgatatatacacatatatattcattaacatatatattttataaaatgatacaaagaagagtactagtacctacactccaaaagacatgcaataagtaataatttggttacagaaagagagaaaaagttttcaaataacaatcctttttcactgatagtttatacaaaattttatcatgaataggatagtaagaaacaagatacaatatgaaatttgcttgaataagtgatatatttagtaaatggaatacagaaaatataggcagaatatctgctgaaaataggaacccaatgatatataacagtccaatatggagttagtgaacttcttaagatttgtttctttaagaattataagtatggcatgccttttttaaattccaaatccagaagataaacaagaatagcaacatgagaaattcctagtttttgcagatttagtcagctgtatattaatgtacttttcatctagatagaatttaagcaacagatgcatgtagcaaaaaaaaaaaatttaactcattttgtgtctttcagagcaaagaatcttttgtagtagaataatcacccatcatttgcctacttagcaagttcagggttccacatatttgctttttcaaatagggacacatttgtgcaaatgtgtccagttatatagtgatagggtggccctgaaagtggggctgaacatgttcatatgaaacttgcctgcctccatgttgcacacctaccttgtatacctgagacaggtataacaaacaactgcacttattctttctgtccccatagcttttcttctacttctttaggactcctaagattcacatgaactgaagcaaaatatccacagagagacattaaactttatttacttacatgaataattttctttaaatcattgaattcacagaaaggaaggggtaaaagtactcctgcttattaaggactatgctagctactagaaattgtgctaggtgatttacatatgttatctcatttcgtgcagttacttatttaatgatcttgaaaaggaatacaattattaactaatacaaactacaacattcagctgtttgaattaatctgatagctcatcatttttaaccaaaaaaatacattaacattttcaagtgtctctatgaactgggcattattattttaaaattaacccaacttattttcccatggttactaggtgaatgggcacagatcaagctaccaatttaatcaataatttctggctttggggcccctgcagcagaatattcatctccacctttatcttcctttcccccacacccttcctccccctgctgatgcttgtggaagctcaagttctactgtgtttccagatcttcctctaccatctggggtgttgactgatatctctctgctatcgttactgatgacaggactttattaatgtcatctcagtgtctatcttgtcactgctcaattcaggcctgcagatgctaaagttgggaaggatacttttcccaccagaatgtaaatagtctactgtacttccatactggatgttctttatttttcacactataggagagccccagactgattaattaaagaatcctaaatttaagttaaagttggtgaatctcaattttcaaagcagcttcttgacctccttgatgctggatcatccaaaatttcctacagaagaaaggctgccaggcgtggtgatgtgtgcctgtaatcccggctactcaggaggctgaggcaggagaattgcttgaacccaggaggcagaggttgcagtgagccgatatcgtgccactgcactccagcctgggcaacagagcaagactccatcaaaaaaaaaaaaaaaggagagagaaagaaagaaaagaagacgaaaggctaattccaggtaattcagacaaagagatcatgtggggaaaaggcagatagctaagctggtgaagccaggtgtgcaggaggatcccagcaaatctggggaaacaaacatgactaaaaaggatacaccaagagaggagctggcttgacacagcatgcaatagggagtcattgccatttataaaagaaggaatggtgtaataaaagcagcactgtagaaggattcaggaggaattggaggaattccaggagtcagggccaccatgacactgcaagcatgaaagctggggttcagctggtgtcaggggacatgggggtgtaagagtccaaccagagatgttttcagcaaaataaatgtcaggacttgtgaacacattgtatataagaaatactgtaggaatggttggtacttttctttatatatctggtagaatttgacagtgaatccatcaggtcctgggctttttttggttggtaggctatttattagattcaattttagagctggcttttggtctgttcagggaatcattttattcctagatcagtcttgggagggtgtaattgtccagaaatttatccactgcttctaggttttgcagtttgtgtgtgtagaggtgttcacagtagtttctgatggttgcttttatatctgtgggggtcagcagtaatattcccttcatcatttccaattatgcttatttggatctcctttcttatcttctttattactctagctagtggcctatctattttattaatttttttcccacaaaaccgactcctgctgggtgtggtggctcacacctgtaatcccagcactttgggaggctgaggcagatggatcacaaagtcaggagatcaagaccatgctggctaacacggtgaaaccccgtttctacaaaaacatacaaaaaattagccagacatggtggcaggcacctgtagtcctggctactcaggaggctgaggcaggagaatggcgtgaacccaggaggcagagcttgcagtgagccgagatcacgccactgcactccagcccggatgacagagtgagactccatcaaaaacaaacaaacaaacaaacaaaaaagcaactcctaagccaggccaggtgccatggctcatgcctgtaatcccagcacttagggaggccaaggtgggcaaatcacttgaggtcaggagtttgagagcagcccagccaacatggtaaaaccctgtctctactaaaaatacaaaaattagccacttgtggtggcaggcacctgtaattccagctacatgggaggctgaggcaataggatcacttcaaccagggaggcggaggttgtagtgagcagagattgcaccactgcactccaacctgggtgacacagtaagactctgtctcaaaaacaaacaaaaagaaaaaataaataaataaactcatggtttctcatgtctccattttcttcagttcagctctgatttttgttatttctcatcttctgctagctttggggtggatttattctttctctaattcttgcagttgtgaaattaagtttttaatttgagatctttttgacatgggcatttagtgctatgaatttccctcttaaaactaccttagctgtgtcccagagattccagtatgttgtttgttctcattattttcaaagaacttcttaatttctgccttaatttcactatttacccaaaagtcattcaggagcatgttgtttaatttccatttaattggatggctttgagtgattttcaaagtcttgactttctatttttattgtgctattgtctgagagtgtgtttggtattatttcagttcctttacatttgttgaggattattttatgtccaattatgtggttgattttagagtatgtgccatttggcaatgagaagaatgtatattctattgttttaggtggaaagttctgtgaaggtctataatatccatttggtccaatgttgagtttaggtcttgaatatctttgttaattttctgccttgatgaactctctaatactgtcagtaaaatgttgaagtttttcactattattgcacagaagtctatgtctctgtgggtctctaagaacttgcttcatgaatctgggtgttcctgtgttgagtgtatatatacttaggttaggtctttttgttgaattgaaccctttaccattttgtaatgcccttctttgcctttttttattcttcgttggtttgaaatctgttttgtttgaaattgggattacaactcctgcttttttctgttttctatttgcttggtagattttcctccatctctttattttgagcctatgagtgtcattacacatgagatgagtttcttgaagacagcataccattggatcttgcttttctatccagcttgccactctgtcccttttaagtggggtatttagctattcaaggttagtgtctgacaaaggtctaatatcccacatctataaggaacttaaacaaatttataagagaaaaccccattgaaaagtgggcaaaggacatgaacagacacttctcaaaagaagacataaatgtggccaacaaggatatgaaaaaaagctcaatatcaccgatcattagagaattactaatcaaaaccacagtgagataccatctcataccggtcagaatggctattaataaaaagtcaaaaaacaacaggctggcaagcttgcagaggaaagggaacacctatacactgttggtgggagtgcaaattagttcaaccattgtgggaagcagtatggcaattcctcaaagagctaaaagcagaactaccattctaaccagcaatcccattactgggtatacacccagaggaatataaatcattctactataaagacacatgcatataataaatttcattgcagcactattcataataccaaagatgtggaatcaatctaaatgtccatcaatgacagattgaataaaggaaatgtagtaccatatataccatggaatattatgcagccataaaaaagaaccagatcatgttttttgcgggaacatgcaatagctggaggccattatccttaggcaaactgatgaaggaatggaaaaccaaataccacatgttctcacttataagtggaagctaaataagaatttatgaacacaaagaagggaacaacacacactagaggctacttgaggtgagagagtgggaggagggacagatgcagaaaatataactactgggtactgggcttaaaacctgggtgatgaaatagtatgtacaacaaaccccatgacacttgtttacctctgtaacaaacattcacatgtacccccaaacctaaaataaattaaatgttttaaaaaaagaaatgcttggaagctaaaaagacaagcacaactccaaataatttgaggatgaaagataagaagagtgttgggctactgacaaaaatgaggatgtcagagggctgtggtggtggagatggaaagtggtttaatttagatgtgagcaagtcaagatcacagcagactgcccaagtggaattctcattcttttgttactgccacagttgcagagcccaccagcgaagtctgggacagagatggtgggggcacctatttcccagcacaaaccttttcaacaactactaaaattcctggtcaaaatgaaccaaacctattcattctttcatttaaaaaaaattaacatgtctttccctgtaaaaaaaagaaatgaatttttctctttcttactcaaaaactgatcttcagaaaatcattgaaatcattcacgattctgaaacttttgctgaaaagctttgatgtattaaaaagaataattacttaaaaaacagatcctttgacactccagattggaatttgatgacttttttcccacagtgattcaattaattggtttttcttaatgtttaatggtagcaaagtcatcacattgaagaaaccttatgtcatttatcagcttcttctccagagccctgagaacacctgatgattatttcaatccaaccaatcactcactgaacacataatcatgaataatttagtagagcaatagatccattacttaatatagtgctaaccttttataatgcttatacctggggagaggactaatatctgtgtcacagaataactgatatcaggccttgggttttgaaggtaacattgtgacttatggaatatctaaacgcatgcaattataaaccacattatgggaaaatagttaacctttgtgtagcatttaagagtttacaaggtactttctcagacattatctcatttgatactcaaatcaaacctgtgagaaaggtattctttatttttttttaatttaactgacacataattgtacatatttatgagttatatagtgatgttgtgatacatagaatgtatagtgatgagatctgggtaattagcatattcatcaactcaaatacttatcatttctttgtattggaaacattcaatatcctgcttctatttgaaactgtatattattaacagtagtcatcctacagtgctagagaacacaaacttattcctcctagctagctgtaattttgtaagctttaacaaatctctccccatgtctcctttccccctacccttcccagcctttgctagcctctgctctacttttttcttcgattagatgaatcatttagcttccacatatgagtgacaacatgtggtgcttaatgttttgttcttggcttatttcacttaacgtaatgaggtattataagtgaggacagcagggctcagagaggccaagtggtttgcctaaaactgcctagctattaagtggcagagctgagattctcccccgacagtctgtgctgtctcttgtaccagtattcactctgatgtgataaaggcccaaatgccaacgggctttctaaagtaggctctctccattccacacagcaccaacagcctacccatgtgagggccctgttgcccttcatctttgttgaccacctccctctggtggccaagagttctcacatgagaaccttcaagaggagcatcataaactaccatttctagagcaaaaaaatgcttgtttctcaggaaccaaatcacacatgagcatttctgcaacatatacccatcatcctgtagcaaaggaagccacacatctggtagtaacaggtgccgtattctttttttaaatgattcctgccatgtgacagttcatgtaaacagcacacagaattctacccaatcaagaattactctttatttaaaattcttaaaggagacttgccttgctgtaagctaattttgtgaaagtttgttttgcctattcaatatttagcttgatttccgaaactatctggaacagtctttactaggtttgtctgtttctctctctgagactgcctataatagataaaagcaatgctttatttccataatctgctcttgagagttcctcattatgcttaaatgtctcccctttgttttaaagggtattatcctgcattcaatgcaagaaattaaaagtgtcattagataaaactgacatttcttttatagcaaaagtaaactcaatccaatttagaatagtatgtcaggttccatctttacttgttagataaatcactgttacaataatcttcattttcatcttattattattatttaaattttttacttacaaataacagcactccaaggatcatgtaaaacttgaatttaaacaaagttctgggaaaggtggctagtgattcagggagaacagcaaagggagatatggtttataattacacctatttaggtaactgtgccaaatccctttagaccagtgaaagcacacaacagagcagatcctttcccactaaataaacaataaataaataatttaccatgatatggtgagccttgagttttcccccattccttccatccctcgtattagtcaaggataatttcctgaaatatctagtattaatgaaactcttttatgaatcaaaattgtaatcatttagaatctgtgctcaaaagatgtgggtggtttgatagtcaaaatcacattatttaggggaacttgtagccagcattccaaattcaatttattaactccctcatcaatagccagagtatttgacaatttattcaaagctttcaaacatagcaagagacaataagaatgccgtgcctagtgctaaggggattccaggcacattatcagaatgggggcttgcagtgtaactaaccatttgtggatgcatgggacagcaacatttcctgagacatgggacttttggtgctaaactcaagacagtcctagacaaaccaggttagtcactctagggtcaggttgagggaaaaccttcaactagaactggggcacacatggagaaggatttcttcctagaaacaggagaaaagctgcctcgctgaagccagagcacaaggtcagagctggactcaagaccttgatgcaagagcaacaggagtattcagttaaagctttttaccaactaccgactgaagacaagattggtcccagagcaggagacaggctgaatcttggagtagagatgattacaccacacagtgaggaggaatatgggaataaaatatccatatttactgaggggataagaagaccttatcctcctggcctgtcttctctttgtgctctcctgttagctgaatccagtcagctgtttttctttcatttatgccaggatgcatcactttatacttaagcatgtgtggacagagaaaagctcccactaaaacactgacataaagagaggaggatcgcaccagaattatagggcttccctgcttttgtgaaggaaaagtctttaacgttattataaacataatatatggtactcagattggggtttctgttatattgaaccattttcattggaagacaaagtttctctcccctctttccacaggcagccagtacacattgttgtctccattgtaaccattattttatttttatttattatttaaagacagcgtctcactctgctgcccaggctggagtgccacggcacgatctcagctcactacaacctccaccctgtgagttcaagcaattttcgtgcctcagcctcccaagtagctgggattacaggcatgcaccaacatgcccagctaattttttgtatttttagtagagatggagttttgccatgttggccaggctggtctctgactcctggcctcaagtaatccacctaccttggcctcccaaagtgctgggattacaggcataagccactgtgcctggccaataacaaatattttaatttaaaaaaaaaagaaatcacccctttgtgggtaggaaattcttttgtaaagacagggattcacgagtatgacttgctgccagggtgaggactgtacacttaggacaaagcagatgagagaaccccaagaggaaagtagagaactgttgacattcacctcttcccaccagaaggtttctctctcagaactaaaagttagtgatattctatatgctgatttattttactaaaggagataaatattcctttacaaatgaagcagaaatatggtgtcatgattaagagcatttgtttattccactggttaaatgtatgatcctagttttgtaacctctctgagacaaactttcctcatttgataaatgggtactataacccacaactggcagggattttctgagaagtcataaaatagcaaacgtagaatgctatgtccaacattagtaggtgttcaacaaatgttaattattttccttcctttttccctgccaatatcctatctgaaaacaaacaaataggtcactatcaaatttgaaaaattattcgtcatcacgatttattaccaatctcagtaacaggatgatgggcacattcagttcattttcttttaaatttaccttagctttcaacatctaacttgtctttaaaaataccattcactaaaataagtggatatctggtagagacaacctgatatttgtacttgaaatattctaaaatgcacttggacaatcaattcatccactcacttatgtgtgtatctgtcgacaagtgtgcttgtttctacataaggatcattatatacaagccccattctgagcgcctctgtgtttgattgttttctaagaaaaatcatgatttccaggtggaacagtgagtactaccctttaaaacctctgaagttgatttttacttatatcacaaacacaggcatcaaatggaagatgagataaagttcaccaccagctttgaacagtaaaaatgacagaaattgggagttctttctgaaataatgcatagaagtcaatacagccaataactcttcctaaaccttgtccaagcaaagacgcttcaagtcaccataaaccatgatgtgtcccagaagctcattgaaaacaatgagctagcacagggattattttcctcaattttgacttttattactagtgaaaattaagagctatcaccatgtgtattctcacaagcacattatatgtataaataaattggtttaactctctcaataattctgaactgaagggactatgattatccccatgttaaagacgatgaaacttggaaaataacccagggttttagaactggtgacagcaaagttaagactggaacgtgtctcttgctgaattcaaagcccataatctctagccattaaactaggtaagagaagaaaggtaattttttctttttggaaatattataatcctgcctaagaaaaattctgaaacaggccatttcatcttcagtttctaacagcattaaataatgtaacagaataggtaccttcgttttaccttccaaatcgtctagctagtccaaatatctgggtctgcaaacggcattttctgagtcccaggttccagatcatccttactatttcacagaaaataacatcactgccaaagaagttatttctccaaagtaacttcttagacttgacgtatgtagtttaagcaaatgtcctttaatgttctcttcatcgtggctggggaaaaaaaatacctaaaaagctctgagttttattcacttcaaaaaacggaatcacaaaagatttgaaaaaatgtcctagtttttcaactcaactttaaaaggttttttcaaatggttaatttgatatcctagagtattcagcaggatcccttaatgaacttaaaactggactttttttctacagacttggtgttcagataatgatttaagaccacctcaccctgccttctttgtgcatggatgtcattagactcaaagtcaagcatgaaggtgaacagacattaatgtaagaccacttagagctacgttctctgcatcactcacaacaagcctcctttattagcccctgacgggggattcattagttggtcggactggatcaaaagctaggtggaaataacccttcctggcaactcagacgtttttcctatttctcttcttatttgtagaggtcagttcatagataataggaaacactgtaactcaaaagataatgtggtctctgaatgcaaatcaaattaatagattaaaaatatggtgacatggttgaggttcatagttgatcttttctatatatacatatttttttttgccagaaataaatccaactggcctcttctccactcaagattttcaaactgaatatcagacccccaactgaaattcagtatggtaaaaatagaaataggtatctttgctttcagtattttccctctctactcccacatgcccagctttgctatgtggaatgccactgataccactgaaattaccccctgaactccagtttctctccattccctttgattgctcagttcttactcaagctgtcttcagtgccgctcttcttcccaccgagacatggtgaggtttatgctgttttcaggcatagacaactagcttccaccattctgtgtaatatatcgtgtttccttgcctgtgcacacctggttcacccaaacatcaccctgtacacccaactaccctgtagtctcagctcagcaagcattctcccttcattttcctcatacttgcatttgagggtgtcagaagctctccctatctgcacaaactctccattcacattttactgagccagttctttcatacccacaaagagttcttatgtgcgcccctcttccaataggatctctgagactgctaacatatttcctaaaagtttcccattatctgtagaataaaatatgatcttcagcctggcctttaaggttctccaaggtctcactgtgtttgtggatttttttttcccaaccactccagattatattgatctctgaaactttttagcatttatatctgcatcatttgttctcaaacttatgctttcttccactgtttcatgagaattttatgtctgtttgttgcccatcctgccagcactaaatgctgaaccctcatattatactttttttttttttgcagcatctggctcaacacacaaatcggggcacttaaaaatattaattcagtaagatggaatgagtgaatgagtgaaaatagagtgctacctagaaacagagaaacacaaaggatgttcaatttggggagagaaagctgtaggtgtttttccaacccacatgatacatcttaaacattatttttagggagttcttgaagatgggcaagataaggtcagacactgttctagttcacttttttttattttgacaaggcaccaggagagacaaagctagcccacctctctttctttttttttttctttcttcaaaaaaggccatcctcgcttccttttcccttttccttcaaaaagtagtattctacaggaaaaactctcagaggaggggagagaaagtgaaggggaaatgagaaggagagtcagtcatcaccgccacagctgtaggaagaacgccttcctctgcccagaaggcaggaacaaacaccacccgattccagcccactgagcagacctttgagagggatcaaacttctaagtactggagggacctagaaaattgcttaaaagccaggaaggatcagccacacaaaaggcatgcagggcagaaggccagtgcctctggatcactctgaacccatgaacagaagagcggagtaatggtccatgactgcaaagggggcagatgagtaagtacagagagatgatctgcgccccatcagtgaaaccctgaagatgatccttcaggatgcttataatggttgcaggttttgagaagacagatacttttagaggggtcagggattactagctgagaagcttccacttactctttcaggaaaatgaaagtacaggctctgttctctgcatcacccacaagactcgtttattaccccccaatggtgtggggacctttattagtcaggggaatgattattattttgtctaactccacaggctgattggcttggctttcccaaagtctatgaaactaaaactgaccccgcaaattaatagaaacagcatgagtcatttgaagttcaagttttaggagccactcaggttctcacgaatcatgaggtgggagcaagccaccagatggagggctcgaagagagacccagccccagaggatcctctagattgcaaccagcttttttcagacatttttatatatataataagactgtgctcctccaactagacagaaagtcctgttgaatatgagtcattggctcttaaatagtttgaagtttttgtaaggagtttttgtccttgaaaatccttctacagacaagactgaaacattaatcaaaccttaggtaaccaaaggagtatcctttcatttaacttgtgttttcagcattatagaagttttagtagtgctgtaatgtttcacatacaaattgctgtaatgtgttttgcttaataagacttggaaatggaagtagttgctactgataagcccagatggcaatacaatagtatcctgaattaatctgatattccaaacaattttaaacttttaaataatagaaggtagcaataaaatagtattctgttgattataatctagaacatgggcaacattattggggtaggggtggctactggggacttcagtgtaaaactcagtctttttgtcattcatgaaaatttaattccacatagtcaatgttttacatttccaattttcattcacccatcacatctgagcaggaaattgtgcaatataggcaaaggacaaggacagcagagggtcacaatatgtgtactggaaaagaatgaggcagggggctgctcctcctctggggacagagcttctgagatgtccccacttgccctgttctaggtgatgagtctcagctttgtatatccagcaactcaattttgctagccaccttggaactggctcacaataacccacgctatcatttgaaatgagaagatgattttcagacatgcctctcgagataacccaaagcatccttccccattatacaagttgctttgcctgtaagaccaaaatatttcatccagtctcctggccctgtctcctaacagtgctggatattaatcaactgccttctatatgctcaccactcccccttttaaaagctagactgataatatctcttgctggcacctcctcttggataagttagtgccttcctcctgccacagctggatagttggattcactgacagagtcaagccctgcctagggctcaccctgatctcttgattgaaaactttggattttaagatgctcctcaggtgttcatgagtgtctcatttacaagcagtctcccaagcagagtattccaacagaagactggcttcatcctttgtgtattcttgaaactaatttcattctcagagttataggtgtgtttccttcctatagacagccacattttatgtaggagtcttactcattttgtataaaggcttattttattttcccagagatttctgtggtaagaaatgctgtccatagttaagttcctagtaaagatctcaggggtaaaggtgggagatgggatggtggcagccaggatcttataggttcaccaggtgaggctttaagctcaatctataggttacccagttaatcacaggtaacaaatagtgttttccacaaaatgtagcattactttaagtcctttataattacatatttcccacaattacttagctaatggaccactacagaaaatttggctatattcatagtttagtaaaatggaagtgattacaaaaaataaaattgatagaaatacactaaaatatttacttgataaatgcattcataaattagttttagttggaattttaaacttttagtcagggcgaagtatatgtggggcagggggtcggggggaggtacatctaacaacagagaaatcaggaataaataaggacacttgtcttattatccatgatataaatctaccttctttggttttgaatgggataatgtggagggagtagtagtggcctacgaagccagccaagaagctgttgaatctaatttatgacatagtccagacctgtttttgagccacctgccaaggggattcttcccattattgggggagggagaggaaggcatgtgaatagccagcactaaccacctggttgggctaatgttcactgggatcctgaaagaaagagggcaaaacagcctgctcacccatacctgtctcccaagctcccaccagtttcactgacaagggtagcattagttaggcgaatgactccctatcttattcacctttataccacccaagagcacccagcagaaggcctgacacagagacagtgctacaatgtttaatgaattgaattgtatgctggccaatattaggctttacaattgttaaaagatggtttgatatgcttagtcttgtcaaaaacattgtatgtaagaagaagaaacttgagaaaggtggtcagtagagagcctcttcgactaatagacagtttgagcatctgacagctgcattagaagcagaaattggtaaacaacttgacatagtatagcaaaacattcatgaaggcagccctgaatcccaaacagggatggataacctgaggacaaggaaagaaaaatgaggcaaatagacttttaatgctgtaatatacattaaacagaagccctctatttctgttccatgttcagatccatcttgagagcacagcaaacactcagagtatctgggggagaaggtcagttttcattcatcattatcagcaatgaatagttactaaaaggagtgaggctttgagcccaggaaagcagaaagaacagagagagtccccaaggctgggatgaggcaggaagctgctcaggaggattagcgcctgacgtggaagtggtttcccattcttctcttttattcctaagtttcctccattcttctcttttattccttaagtttcctccaatgacgacacccagatcttaatgccctttaaggagtccctgaagagcaagacctggtagggaccgcccaggaatctggtggctgactagagccccaagctgttacagggccatttgctctgctcttggccatcgtgtccattccaaaactggctttggcattcattgggctggtctggctcaaactctataaacaaatgcccttctaagtaaggactgcccaagtggagaacagaagtcacgtcagttatgccttatcattctcagggattcacagtattttagagctgtctgtggttaaacagtggacaatttaggccaatcaaagccattaatgaggaagaaactaaagtccagagagatggaatgacttccagggtcacacagagcccaagggtgagccagtccaatccttcgaccactacctgcaccccatatgtatgtgctgttctccctttatagccttcgttactgtgtgtcccatattatttccatattattttcctaagtccaggtcttcaatggagtgtgtgtgcagatgtgtctgtgtgagtatgtgtctgtatctgtgctgagcagggcaactgtgctggaataagagcttcaagaggtcttcagagagcccaggtattcactctagccctctctctggtgttcagccaagcaaatgtcaggagttttcataagtaatatttctctaactggcttgttctttcccatgtaacccagatctcaaccagaatctcttccttccttgaaatttaaactgtattcccctaaaccttaatttgttcttcatgtgcatccatgaacttcccccaaattgctgtgatttccagagcaggttccagccttgtgtgcttctaagctccttttctaacacaagttctagttatagcctagctactggggtgaaggtgacattctctgtcctatatcatatgtgaaaatcaaaccccttccaaagactcctaaccaaaacaaaataaaaaccacccacacagggccactgtgaatacgagagtatgagatatagagtcagtttgcattaaaacaaaccacttcgaactgaccagtagacatgcccattttttaattacgttctctgccaggtaacaacccccttggtaactcaagttttaccatcttcttaacttatttttactcttctttctcattatcttgctccccctttctcctcctttcaagattgcttgagattctgtatccttcttgttctactacttagaagtagcaactctcaactggaggggattttgttcacgggggaacatttaacaatatctcaagacatttttggttgtttcagtgaggaggtaccggaacttgacatgtagtaggtcgaggccagggatgctggtaaacatcctgcaatgcacaggacaggtcctacaacagcaaattatctggcctcaaatgtcacagagttgagaaggctgtaggttgggaaaccctgatctatagtgacttggctatagccatgtctattcaaataccaactacagtcctaggcatatccaaattctttccaccctccttagaacgtggcaatagtttaaaatagcattttcttacttcggttgcactaacaagatccagatggaatgtcacctcccctggcagcctttcctggtccctctttccactcctccatctgtgctttcatgacactttttacacaccaccgtcctaccatccgtctaccttgttagaccatagccgcttagcagcatagatcattcccttttagctcctctagcacagttcctggcatagaattggtgtttaataatccttgtagaatgaaactgaatcttcagagcagctcctccaatcttagtatcaagcctgacagaagagtggcgattatcatgatagctgagggcaatcataactcttgttagagaaggtacaaatgtcatggggatgactatatgatgatgcacggtacagccttggttgaaaagaccacacttagtgtgaagatccaaagatgactcaacatggctcttagagacacccattgtcgacagaggatatcaacctgagaagatggtccccatcccagttttcagtgatggcatcacagctttcaatttgcattgcaatcagggctattttaaaggaagaaatgtaacagcctatctaaatattgctaaagcacacataaatgccaatttttcttgactaaggatacgtggtataattattttagaattaggagtaattttccaaagctttgtaagcacttcattaagtaatagaatttcaaatagtaacttctagataaacaatcggttggtgagaaagaaaaattgacattcatctataaggaaaaggatgtatgaaagaaataggaaatttcaacttaacacttctaatcaataattttgatctcatcttccagatactgttacatcaagccatccaaccatgatatataagcataattgaagtattaggcaatgacatttatttatatatacatgtgggctttgtgtttcttttttctttctttctttttctgagacagagtcttgctctgtctctcaggctggagtgcagtggtatgatctccgcttactgcaacctctctgcctcccaggttcaagtgattctcctgcctcagcctcccgagtagatgggattacaggcacccatcaccacgcctggctaattttgtattttcagtagagttggggtttcaccatatgggtcaggatggtctcgaactcctgaccccagatgatccacccacctcagcctcccaaagtgctgggattacaggcgtgagccaccacgcccagccgtgtattttttaaagttaatgacaatcaaactttgatgccttctaaggatagatatttcatcatttcctttatttaaagataaaaacaaatagaaaatagcagtgaggaaaagctaacagctacagaaaccaactggattttgcatgacatcttccctgccaaagttcatgccagccgattaccctttctctaccctgcctcagcttcaaacaactcccctagagcaaatcctacctactgtagacccagtagctgtttccccttttttcttcctcagggactactggttggcagtggccatttgcctcgggatacattggccctgccagagcccaactggtgaatctcagtttagttagttatacccagtatttatcaaacaaaaaggcccccaatggagacttcgtaggtatttttttttccttaagtactcccaaacctccgtccccatcctgtaaaagtttaattccacagatacaatgtcctttggaggaacataaacgattgtaacacctaagattatttttgtccctgtggtacacagaaaaacagccccataaagacatccacattctaatctctggaacctgtgaatatggtaggttacactgcaaaggaaaattaaggttgcaaatggaactaaggtagctatccagctgaatttgagacaggaagatgatcccagatgattctggtgggcccattgtaaccacaagggtccttaaattgggaagggggaggcagaggagtcataaatgagaaaggtcatcataaaaaaaagactcgcttgatcattgctggctttgaagatagaaggggaccatagccaaggaatgctggcagcttctggaagctggaaaacagagcaaaatagattaagaaaggagcacagctctgctgaataattaacacaccttaattacagcccttaattattgggcttctaacatccagaaatgaaagataataaatctatcttgtttaaagccactagatttgtggtcatctgtaatagcagcataggaaactagcacatcccccatccccaagaaccaattttggtcaccacggtggcaattctgccaccactgagaatgtatagtctaactcagtcattgtaatctcactcctttcccaggtattaatttaaaagtaggcatgtgactgaattctggccaaggagatataagcgtcccctggaagtctctggaggctttttggctcttaaaaaaaaaaatggagagattcattttaagacaaacttccctttgtttttctatagatgtcaccatttacttgtgatccctggacctgctaccaggagacaatgagggctgactgataagaaagaccacatgctaagggtagaagcacagaacagtgggaaggagctggatcctcgctgcctttgtttgcagagggacacaaccagccaacacacttccagacttcttgctatataggaagaaaaatgcactcattatttaagctagttttgggatggctctttcctgcttgccatcaaaagcaacctttcttccctttaccaaaaataaacgcattctataaacaaaacattcatcattcagtatccccttgttagctcaaatttaatatggtcagcagcgatatttaagggagaagatttcggtgtcagagaatatagaaatgagattctaattagagatgtttagcagacacttaatccctagaatagcacgaaaggtcctttctgggctagcctttgcccagaacagcctgttctctcataccccatttcccccacctgcctccaccctgaactccatgtatcctgtgccccagtcacactgaacagcttgccattgcaaacacatgcttgccttctccatccctgtgcagtagagcaggatggtccctagagcccttttacctgactaacaccttctcattattcacaatgcaatgcagatattggcttcatggagccacacctggcatcacccctacccagagagagtgaaacattagtaaccttactttacctgtgttcccacagaaccttaggtacatctttgccctgtatttttcaaattgtcagaagtgctgtaattgggtgagttaatgcctgtctctctcccactaacctggaacccgaagttagaaactgtggccttcatgggtaaacccccacacctagtactgtgcctgggccagaaggggagggaggaggcagagggaaaaagggagagcaaatgaatatgaatgagagagtgtgagtctggagctcagatgagacatcagaactgaagatatcatttggggagtcatcagcatagagacgacaattgaaactgaaagcttgtatgagattgccaagaacagtttctttagaaatattcaccatcacgggtgggaggaggtaaaggtgcagagagagaagcatgggagaaggaattctgagtgctgataaaggagacaatttctgaaggtatcagcagtgctggaggatgcaaaggggtcaagaaggaaggaagccaggaaaaggccttggacttggcctcagaaagaacctctaagaaagtaatagtaatttcaccagagtgagtagagaggaagtctagtggcaggggattcaagggagagtgaacacagagtcagtgggtacacactgagcccacactgctcctgcagatgctcaccagaaaaggaagagaacaaactataccgctctttgccttctttcattccatattcacatgggctgataatcctgaaaacatttttatttaattaaaaaatacaatgcctttatatattttggtctgttcaggaataagctctttagggattttgccaaaggggatataaaatgtagtccattctgccagggctggtgtggcagcctggggattggttatgtggtatggattcaggggtgggcttccttgttccaatagaccaggaacaaggaaacctgagtccctggtgctagtctttccttgtaactcactctatgatctttattaagttattcatgtctctgggcctcagtttctcccttcttaacctgctttagttctcaatcccactcaatgataccaggaaataattcgaccagtcaatgaatatttacctattagttcaatgtgcaaagcattaagctaagaggctaatggaagtttccattcttctaatggaaaactctgatccctattatgacataaatctctcctgggaaagtaacaatcttagctgttattagtcattaacactactgcgtaaatgtttcctcgattataataataatggcaaacatttcttaaaagcttattgcatgctggatcctaagcttaaaactttacatgggttttctcttttaatcattacaaaagccataggaagtcaagaacattgttaaccttgtttacagatgtggcaggtggggcttggagaaatcatttgtctaacatagtcacgcagtgatgtcactaggcaagtgccagagcgggatcggaacccaggcagcatggcctcaaagcctgttgctttagtcagggttctccacagaaacacaaccaagaggaattccctcttgctcagggaaggtcaaacttctgttcagtccttcacctgatgggataagaatcacagaaacatccaaaataatatttgtccacataccttgtgcaacttggcccagataagttgacacataaaatcaaccatcacacttgtgcacttaacagaacaaggtactcaataatattttttaaaatattagttcacctcaaagcatttctttttgttttcctcactttcgttgataatataattattcacctaggtgccaaagccaaaactttgagcaccatccctgcctcttccttctccctcactctgtataccccattgcttgcaattgtttgattctacttcttaaaggtcttcctactagtcacctcatctccatccttgcaaccacagctttatttaggaccttgttattcattgcttggactattgcaacaccctactaactcaacctgctgcctacagatggactgaatctctccattcatctttcagcctaccatcagaaggaactccctcaaacacaaatctggtcacgctgctgccctttatataattcttcaaatgccctacctccttagtttggtttaaaaacaaggtccccccatcatccctttcctaagcccccatactccttgcatcctacctaacaacaacaacaacaacaaaatctgcttccttgaaattgccattacccttccttggttctaaacttttgcaaatgctgcccccctctttcacaaaaggaatgctgctcccttttcccccaaaatcggctcaaacaccattattgtctgaaagtgtttcctgatatctctgggcaaaataaagtaccttcatccctgtccttccagagcttcagtacagaatttaccaaccactgtaagtaacaccccctctagactataaatccctaggagacagtgctatgttctgttcatttggggaacctgaacacctgacaacatactacccggaaatatgagaacaagtacttcatacatgtattggagaccttagcagagatacaaacttctagagaatacatttgtggcttatctgctcccttagtgagggaaaaaagtacttagtatctcataatgtaatacggggcttaaaaatcattgaaggtgcctaaaaatagcaagtaggtctacttttccttgggaagagttttgataagatatttttgatcttttaggagttaaaaagatgtttctcaacctctaaacagagttggtgggcaaggcagaatggattggtagaatattaaaaatagagcgaggctaggctgttccttcaagatatttgcaaacactagaatttttaaacacaaaacagaataggagttggaatattttaagaaaataagtaaaaatgtagtcctcttgctatctccaacagctatgcatttgagtacctgaaatgtgggagtagacgaaggggcattagatacactataaaccatgtttgttattataaataacacataaaaccacagagcaccttcattatagattaatgttacagttctctgtggacacaagaccattgacaacatgggggacatgaggttgtaataagccttagattctataagtcaataaaattaagccatggcacaattgtgtcacatctacagaaaggcagagtagatcatcactgagggagacagtgattctaagcctcactcaccttggccaagcctgaagatcttgagaagtgtttctgtcccatcactaacttacccactcatactggtggtgtcagtgcaggagtcactgctactgaaggctggtggaaggaaagaccacaggttgttttttgtttttaaatactttaagttctagggtacatgtgcacaatgtgcaggttcattacttaggtatacatgtgccatgttggtttgctgcactcatcaactggtcatttacattaggtgtttctcctaatgcaaaccctcgcccaaccctccacctactgacagaccctggtatgtgatgttccctgccctgtgtccaagtattctcattgttcaattcccacctatgagtgagaacatgcagtgtttggttttctgtccttgtgatagtttgcttagagtgatggttccagcttcatccacgtccctgcaaaggacatgaactcatccttttttatggctgcatagtattccatggtgtatatgtgccacattttcttaatccagtctgtcactgatggacatttgggttggttccaagtcttcgctattgggaatagtgccgcaataaacatacgtgtgcatgtgtcttcatagtagcatgatttataatcctttgggtatatacccagtaatgggatcgctgggtcaaatagtatttctagttgtagatccttgaggaatcaccacactgtcttccacaatggttgaactaatttacattcccaccaacagtgtaaaggcattcctatttctccacatcctctccagcatttgtttcctgaccttttaatgatcgccattctaactggcgtgagatggtatctcattgtggttttgatttgcatttctctgatgaccagtgatgatgagcattttttcatatgtctgttggctgcataaatgtgttcttttgagaagtgtcagttcgtatcctttacccacgttttgatggggttgttttttcttgtaaacttgtttaagttctttgtagattctggatattagccctttgtcagatgggtagattgcaaaaattttctcctattcgcaggttgcctgttcattctgatgatagtttcttttgctgtgcagaagctctttagtttaattagatcccatttgtctattttcacttttgttgccattgcttttggtgttttagtcatgaagtctttgcccatgcctatgtcctgaatggtattgcctaggttttcttctagggtttttatggtgttaggtcttacatttaagtctttaatctatcttgagtatgcatatcaagaatattggaaacatacctattgtcaatagagcgggccctctggatcataaaatcgaagtgaggaagaaaacaaaggcattcatgccagaggaagcaaagtttttggtttgtttttgattgttttgttttgttttttgagatggagtctcgctctgtcacccaggctggagtgcagtggcatgatctcggctcactgcaacctccaccttctgggttcaagcgattcttctgcctcagcgtcccaagtagctgggactgcaggcacacgccaccacacccatctaattttttgtatttttagtagaggccaggtttcaccatattagccaggatggtctcgatctcctgacctcgtgatctgcctgcctcggcctccaaaagtgctgagattacaggcgtgagccactgcgcctggcccagtatttttttaaacaattcagaaagctatgtatccaaattccgaagcaatcttgagcagtcatcaatgaaagtctttaactcagtgaagcacacattgtcttaaatgcctttatctctttccctggtctctgtctacatgcacctccccttccttcagtacctagcccaagcttcccctccataaagccctcccataatgtccctggttggaaccagtcacctcaacctctgcacctgcatagtttatgtgtgtatatctagcaattattttctcatcttggctctaaactttgaagggcaactgttgtgtccgtctccagtgcctatcacagcattgtgcccatagccagggtgcagtgcatcttatggaatgtgaccaagggacatctcctgttttagcataaataaaagaaaccagagttctgctcttgttccaccttcattaatcaagtcctccctccagcttgttgtttaccagcaagggagagaaaagctgaactcacaagttcatgctgctgagataaagacctgaagcatatgttggcccacagggagggctcgatgccaaaagctggggagaaaactaaagtttctccaaggaaaaaataaataagggtggaaaggagagcacctccagttaaggacaggtactatgacacctgacaccaggaatgcctttgctgctaggtgcttccttaactgtgacaggacattaacacaggacctgcagctggggcaggagaaaaagagaaaaaggagcagcagagaagaaaccagcctcagtcccaggcccttctccactgcagggttccagcttagagcaacaccaagctgtgggaggggagaaactttcagtttggctgaatttcagttttattacacaggactggacattttaataactgaaatgagacttttcatatatttagaagtgaatagagaacgaagagtatgagaccaatataccttccagatgggggtgggagaatcctagacttcacaggtgtaaaatcagtaggaagaggcaaaattaagaagtttccaaaaacaaaactcaaaccttgaggacattacgctaagtgaaatcagcccattacagaaagacaagtactgcaagactccatttatatgaggtatctaaaatagctaagttcatagaatcaaaatctggaatgatggttgccaggaactatgggaagagaaaaatggggagttatttaatcaatgggcaaacagtttcagtcaagcaagatgaataagctctagatatctgctgtacaacgctgcacccacagtaaacactaatgcagcatgctcttaaaaattagttaagaatagagcttatgtttaagactttttaccataataaaatgaaataaaaaaatgaagaatctaaaaatttaaaattttaaaataaagaagtggtactgtggagtctcacctatcacatataccagttacattgacattttaaaagtcagtgctcaataatagggctcccccagagtgccttgcctgcttcacgattcacagtacaaacaaggcttccatgcttcctgacaatcacacatggaattccattttttaaatgaggaaatgaaaaataatttagaaaccataaaaagaaataaaatattttctttaaaaatagaggactcagccatgtttatgacagtcaaacaaaatgtctatttctctcctttttgccagggctcctctgattgccatccaattagctagtggtcagagtgacccattagtgagaagtcctgttagggaagccctttagctggtatgcaatatgtgctattttcactgactggactcaattggtggtggtggtggtgagtgaagtctgcattctgccacagataactaatgtgtaggtagatgtggttcctctcaataaccatgaaggccctgggttaattcctttggttgccaacacactagggttggtgaaggcagcacagaatggagagcctttacaaagctggggagaatgctctaacagaagctttttcttgtccttgaaactgctttgttgtcatttagatgaaagccaaaactatttctgatgaatattatgatgcatggttacatttagatcctatttttcaggggaattttggctactgtaactgaatttaacatatgttgatagagctctttcatgccctgggcactgatgaataagaccaggttgctaattcccctgagaaagttacagtctacgtagaacgcagtggtgtcaatggactgacaccatacagcatgtgcaatggacatctgtgtggttcacctgccaggcagctcttcttcttgttgtaggagagcatcacactttagctttaagaaatgacacctctctgtggctttgaccatatgtttcaagtggagctcaccccagctttctctccccagctccagaaatgggcatatgtcccatgcatggctaaagtgaatagcaccttccccaggccacagtgattgcttgagtgatgaactgtcacttcttgtacagtgggggccaagccttggacttctgcggacacaattggaagcgaagcacatcctttccactaaaggtgctgtattgggttgaactatatcaccccagaagatatgtccacctggagcctcagaatgtgactttatctggaataaggtgtttgcaaacataactgcagtagggaattcgagatgagatcatcttagaatagagtgagccctaaatccaatgacaagtgtccttataagagacagaaaaggagaaaataacaaatacacagagagaaaggtgatgtgacaatgaagccagagactggagttatgcagctacaaggcagggatgccaagaattgttggcagccaccaaaaccgaggagagaagcatggagcagatcctccctcagagcttctgtaaggagccagccctgcctacaccttgattttggacttctggctccacaattgtgggagaacaaatttctgttgttttgagccacccagtgtgtggtgatttgttaaggcagctctgggaaatgaatacagttactaagctggcagtatgcaagcctacagctgctggtggccatcttcccaccacatgggcaaaacctaagcatatagccagcacaccagaaagcagagcccagagctggagcaagacacattcctgtagacttcattttaaaatgtggagctaaccctgcctgagaagtcagatttactcctatactgttttaagtttttgtaccctaaattgcctcataggcttacatttaagtcctgtctgagacagtaaaacaaatgctttctttactaaaggtacacacacagtgttgcaatcacagaatagagctcatctaacactacttaagggaacccaggaagccttcactaaggaagtatcattgatgctgagtcttgagtggaattttgccaggaaataattcatctgatgtcccatctctgcatcattctctgtgggattctttctggggagccacatagtcattctgcacatgcccatcccaatctaagggctccaggacacaaactgcggttggccaagatgtcttaaatgagttttgtttcaatggcatagatccccacagcatcaagtgattcccatcctccatgcctgggaccttgtgaccacttgtgccaataccaacttgcttctggccctcattcccactccagtccaagccaatcccagctcttgcctggagacacacaatagatttctaactaatcttctgcttccatcttgaccctgcaatccagtttctgcacacgtacctcaactgtaccatatctctccaaatcaaatcccttcaaaggcttttaccagatctgtaaattcccagcacctaacaagttcttggaacttcatttgggtaccaattatgtgttaaatgaatggtgaataagcaagttcatcagggcctggagtcatgactcaatagcagaagctttagaccttaggacatcttgcagtcatgactcacatctcatgttacatacctggaacattccaaaccaattgaaagaggaataatatattcatcagatttatctacttctgattttgcatccactctatttgtctgacatagcagatctctggttcttaatctaagaatggtagatctactatctggttctggttttcagattcaagtttagcaacctgggtgtcaatcctgctatcatgtacttaagctactgcttctgtttcccaactgaaacctgtccctaattctgattcccggctctccttccttcccatgtgccctccggttgcggcactggcatgccccagaacccagatcccatgtctctcaactgttgctaaacagaatgagatgctgagccctgaccctagggcagggtcccatcctctgctacagaacaatttttatgtggactgttagccacgccatctgactttctccaagctacctacttcctgatgtcctgtctccagcatgcactcacctgccatgtccatctattccttcattcaacaagcactctcagattatcttctagacagtgcagctacagtgctaatgaaagatgtctgtggtatgctttccacctctgaagaaaaagaagggaataatttaaaaagtggtaagatgtctgcatgggacctcagaaactgaccaagtgttcacagtggttcacctcttaccctcttactttgccttgacagaactttagtcaggattctctccttcctacaggtccctgaattctacttggccccaagcctgagaaagcactaaacactggaatgtggcccccttattagcttgcactgagaatcagctgaccacagcaggacaattcctgtcataccccactgatcatcctccccatcccactggccatcccccagttccactgatcatccccctgtcccactgatcattcccctcaaccatcccactgatcatcctcccatcccactggtcatccccccaccaccatccccgtctcactgatgactggtcatccccccaccaccatcccactggtcatcccccccaccaccatccccgtctcactgatgactagtcatccccccaccaccatcccactggtcatcccccccaccaccatcccactggtcatccccatcccactcatcatccaccccatcccactcgtcatccccccatcccactcgtcatgctcccctgtcccactcatcatcccccgtcccacttatgacccaccccaccatcccactgatcatcctcccatcccactgatcctctgatgacccccctgccatcccactgatcatcccctcctcccactggtcatccctcccgtcccactgatcatccctccgccgtcccactgatgactccccacccccgcggtcccactggtcatcccgccgtctggctggcgaccccccggccgtcccgccaatgacccccccgccggcccactcatcattccccgccggcccactgatgactccccctccaacccactgatcatccccgccatcccactggtcatccccccatcccactgaccatcccccatcccactgatcattccccgtcccactgatgaccccccccaccatcccactagtcatccccccgtcccactggtcatcacctcgccccactggtcatcaccccatcccactggtcattcccccgttccactggtcatccctccattgcttaatcccttttacaattttaattaagcttttgcttatctctccctaccctatataatggaagcctctttctttttgattttgtgacacttgacaatttctgaggttggagcattctctctgtggcaatggtctttcttttgaataaaatccctccttatctaagtctggatttgttttcatttgacagaatacatagaagagaaatctaacttgggtgggaagaggaggggatgaagattagagaaggcttcctggaaataaactgtgaacagaaagaaaataaaacattggctgggcacggtggcccacgcctataatcccagcacttcaggaggccaaggcaggtggatctcttgaggccaggagtttgagatgagcctgggtaacgtggtgaaatcttgtctctactaaaaaatagtaataatacaaaaagctagctgggtgtggtggtgcatgactgtaatcttagctacttgggaggctaaggcatgagaatcacttgaacccaggaagcggatattgcagtgagccaaggttgtgccactgcactacagcctgggtgacagagtgagactctgtctcagggggaaaagaaaaaagaaggaaaagaaaatgttaaccaaactaacacagaggacatgcacggattccaggctgtgaggtggcatgcgtgactctcttgccatgtggcagtatgttcaggtcctcaccaacaccaccatctctgatctgtgctccataagcctgaatggaattcttcatgccacctgcacctggcaatgctcccaaacaactgcacctggcaagctggcctagctccttcctcggtccaggcctagccttctgtgtgtgcccacaaaaacacatgcacacatgttctttcttattcaaatgtgtgacccctaccctcagcatgccacagacacctcaagtgaactctagcatctccagaacacccaaggggtcaagtagttattatgatagatgtaggccatctctaccttttcatggactctctgttcatggcatctcactctgtaggcttaggcaaaattcctgtagcctagagagatctgagactacaaggacatgaaaaatgcaaagagggtaagcttgactggaaactgcacaaggactggaagcaggtctgactcattcagcatcatatccctaccacctagaacaaggccccaacacacagtaggggctcaaatatttgttaaataaaatgtcatatcagctcacgtgaataattccatctatcgcagagtttcctctgacactatcatcaagcaacattttaaaggggaaaacagtggttgtcctccatgatatgaaacacacaaggctagcaatgcattctgaacaaccctatttcccttaatagcccgttatgcacatgccagccatgattcatgatgtaaatgtaactctagagtcgtatgaccataagtaccaatgccttggaagtgtatctgagctgctacaagagagattatttttttcctcactgctacaactgccagaaaatatgtttaaatcattacttgaaattcctttcccaaccaaatctcttcccagagctgttaacaagaaacaaaatatgctgacttgagtttcactttctttccattcctctgccttcctcttgtgggacccccaatgaatcatgaaatggttttggtcaggtaagagtgaaaaaagcacagaacaaagcccagtctgtcaaacatgcagatcctagaggacagagactctgcagcccagttctaccaacggacgtaacccctgaaataatttgcacctatttcaatcaactattcatctgctagccttctgattttattatattatgaagccatttattttcaaggaaactatatttgttgcttagttgatacatgatgaagtaaactgagaaaatacactcctaattctcaggccaactcttttaaggcctataaaaaatgacataaatagattctgatgttgcttcatttctgcagaagggtgtttttatattatgttcttctatcaacacagtaagtacagattgcatcttaaagctctcatctagtgctggagtttccaaacacaatggctttaacaaggaaatgactttggaaaggaaaataaaagaatgtgatttctttggggctgagcatgggagagaagcacacttcctgtcatgacttgggaggcatgcagagaccagctggcaaggctctgatcacagaagctaatccctcaggagaaaatgggtaatcccagggccaaaattcacccaaagaaccagaacaaatatgggcttgggtcagacagaacttcattaatcagggctcaatccggcagccatgactggggagatgccatgtaaagaggaaagcagagattgaagtgatgcttctacttgccaaggaatgccaaatatcaccagcaaaccacaagaagcaaggacagaggctggaagagattcctcctcacagcctcaagaggatccaagcctgctgacaccttgatctcaggtttctggctcccaaactgtggaggccaattctgttattcaagccacccagtttatgggactttgttacagcagccctagcaaactaatacagttggcaataggagttaggtagcaggaaaataataaataactgaaaacagggaccacacagttcatgtgaagctcctggcccttttcaagcatttgtacgggaatctctgggaaagagattcaaactatcacttgaggctaaattcctttatacttgggaattcacatttattcatttgtatgacactaaaagaacatgagaaatataaagacaacaagctagagggggtcagggccccatacaatagccaggattctgctcaatggcttcatgcatagtcaaaccttaccagctgtgtgagaataaaggcagaagaggagacccttcaacccagtcaggtaaagttgacaaggaataggtagtatgtcatggtccaaaaccaggaggccagaatacagggatgggtccatctccaaggatctgaagtgtaagtcaaatgtctggtgggacatcactgtgagtttgcagtgacagagaggggctcagggttcaccccaggacaaccatacacagggtccatcatgacaaaaccattccaaaccctggcaacttgtgggttgatgctgggtggaagctgttggccctggctaagacccaggaactgaacaaaattaaaattgctgccaagggcatgggtgatgctgggtaggggtgatcatggaaagcagggactaatagtgtcaggtaaagccacacactgattgcatgtaagagaatacatgacagtaatcatcaatagaggaagaaataagaaccgtcaaacactagatattttacacatattaaacatttctcatatattacattacaaagttggcataatattctacattcaactttttgcattctttatttccttaggaaactgtgtttctactcaagttgtctgaattaatttaactcatatgccactgtgtacttcctttgagtttggggtccatagctgtcctgctccactgtctcatgccaggtcttttcattacatgaactgcaggatgctctctctcaggcacagtgttttgggggcaatgcctctaaatgatgcctccattgaggcaaagatcacatgaatttgtaattgtttgcatctccacctcctctgaaacacagtgacctgctggaaagcaaagaccatgatttgtctctgtatcctcaaagcccagcacaagtatcacctgacacatgcactataaatgctcactgaattgattcattcttaagaagattcaaaatgaaaaaggaagcaagcagatttggtgagccatttctgactggtatttcatgaattcatgtatttaactatgggccagcactatgtcaggtaatacattagtcatgtgaagaaacaataagattgatcactgctaaggtatagagcaagtttcaggaatgcaagaatgggctgcccttaattgagcacttagcctctctgctgccttttgctcattgagcaaattggatatatattcaggccagtaagaacactcataggctacctgctggtgtagatgggctccttacaagatacaaattgaggctgggtgtggtggttcatgcctgcaatgccagcactttgggaggccaaggcagatgaatcacttgaggtcaggagttcaagaccagtctggccaacatggtgaaaccctatctctactaaaaatacaaaaaccagccaggcatgggagcatgcacctgtaattccagctactcgggagactgaggtaggagaatcgcttgaacccaggaggcagagggtgcaatgagccaagatcatgccactgcacttcagcctgagtgacagagtgagactgggtctaaaaaaaaaaaaaaatacaaattgaccattgttgaacactagccatgagccacacattgttatgtatgatctcacccaattcttatacaattgttatccccactctacacatgaataaattggggcacaacatgattaagtaagttacccagatccctttgctacaatatgacaaatctggaacataaacccagccagtgagaagttcttaaccactccccagtgctgcctaagagattagggttggatgaacctacagattataggttttggtatttgctagcaataaaaacttgaactctaagtgacttaacattacagtaacccccgaaggttcccatgcgttatcaaagataatgcataaggcatggttggaagcagctctgccctttggttcccagaggctgagcaaaccttacccccagactcacattactaacacaactaggaatctggtgacaatggtcattcaacagaaattcatgaagagcctgttacatgccaggtactatactggatattgggggatctttccactaagaaaaaacacatgctgatagaaaagattgacagagaaatcagcactacaatcagagtggcaagtggtaccacagagttaagcgcagggaccctggaagcacattgctaaggatgaggcaagataccccaaacttgtcctcaaatctcaacccttttaaagtggcaactgaatggtcacattcaagtagaagcaactgttaggtgacatggcaaataatattcaataaccaaggatgacaaaaacaggacagggtagaatacttagcccagaagtgggtggatggcattgagaactggaaaagagaggggaggtggtcaggagtcattcgaaagcttcctctctggtcttccatgtagaatcttagccacatatagttaagattgaaggtaattaacaaatcaagcaaaaaccctctgctatttcaaatatcctgcacaccaggcaacatacctaccatctttatgataatatacagctttgttatgccttttgggggaaaatctgtattatccccattcctttcactagtaatacctgatattaagtagcacttttgagtttataaagaacattcacaagaattatatcattgaattattactgagcagacagggcatccattttacagacaaggaaattaattctcagagaagcttgttaacaaaatctcataattgaaaaagagggatttaaagaagtgcttttgactccaaggttggttctactgcatcaaactgccattgtttactaaaaacttaactacagcattagaatcataggttttaaagcacttatttgaatgctgtttgctgtttcatattaacagcagctgttgctacttggcagttactaagccctaaatattaggaatggctggggtgaagaacagctttgaaatgacactatatttgatcagcttctgcaataactgttaaaatcatatgcatgtcctttggatccctataaagcttctacagtatcactgtacctgcagttccaatttgcaatttcctcagccctcctttgaagttattcttgccaattacctggtgttaatattaattaaatatgatttgtaactcaaaatgtggtgttatcaatggaactcagctgtacaaatataaagtaaaattttcaattgaattaaattgtttcctttcattcatagtattttacaacattaatacttttctcaaattgacttttgcctgctggaagtcattttcccaaagcaatgaacatctgaggggaaacactgctgtttatgtattctttcctttctgtcattgaaaatacttcgttttaatcttaaagtgaatccatttcagttaccagaaacttgcttcttgtttataacccaagaggggaaaatgctttattttaaaactgtactaagatacattaaaaatatgatcagtgaacacgtttcaattgtacactagggatgaaactttccttaccttattgcttgaccctcacaaaaaaaaaactatcaaactttttggcaactgtcattttatatacacaaaaaatgaattaattaaattggtttcttacattaacatttcaaacagaatctgccatcccaacaactctctggtcccttccaactctaagatgttaatattcggaacatgtcaaacaatagtcagaagcttccagcatttgcaaatttagggggagaaagacacacatagaatatttgacagaatcaggtctattctgccccctgtaatgtatgcaatgatgacttgaaggcctgtcatcttcaataagccattcataaacatgatgactgattaaagaaggtgtgctgccatactgtgcaaatctacaatgaaaagatatgttctctcatattccttttatcttcaaagataaagctttagcttccttgccccttataatgatagcagtagcattaacatttattatcctgtcttcttttaaaaataatataataatgtaagacaaagaagggaaggaacctgtctaaagactaaaggaagtcatttattgagtcatgagccaccaggcccagagcttatgatggaaaagcatgagtgaatattattaactcctttattataatgtcaatgaaacattatatcaaggaattaaaacaagacagaaatagaggactgtggatctaatagctgagtgttgtgtaacacgtaggtcttaaccagcagcaactaagctattcccttccctcaggccaaaagaccaaaaggggaaataaaaataaattaggccagaaaaaaatctctggatgtctgtcatattccaggtgtcatcaaagagaagcttcttggaattacaaagtggggcaggtgaacagcaggtacacacctatgttggcagtgtctattgtgatcctactgggagctctacctaggaaagccagacagacactgggatcccatcacttaccccagtctggaaccctgaattatccattaggttacctcatttacccaagaatcaggattgggagagtagaattccataacattccaaaaggaatttgtgaactcgctatattacaggcttctccattaaccaaattctgtctgcttaagcccttctcattcttattactaacctgttgtcctcctagcccaaatcccatccctaccactggaagctaaccttctgagtatacccttcttcaccctctgttaagaactgaattatctcccaagaaaaatacattgaaatcctaaacccagtacctcagaatgtgaccttatttggaaagagggtcattgcaaatgtagttagttaagatgaggtcatactggggtagagtgggcctttattccaatatatcttcatttttataagaagagaagacacagagataaacacaagaagatggtcatgtgatggtagaggcagagactggagtgatgcatctacaagccaaggaataccagggattgtcagcaaacaccagaagctaatagaggcaaggagggattctctcctacaaatttcagaagcaaccaccttaattttttatttctagtctccagaactgtgagatgataaatttctattattttaagccactagtatactatattttactataaaatgcctcctttcaaggacctctcttcatgtaggaaccctagccctaaccccaaccctactgtgcacgttcagctatgcattctggcaaaagttcctgttttcttatgaaacactgctcatcatccttaaatttttttctgaggatctccttttatcatctcccataattgaagtcttcttcaaaggagactgagagccctcccatgaccataaacccatgaaaagagaacactctaccatactgttacctcccattgcaatgtctaggccattattcccacactgtattcatctgttctcacaatgctaacaaagatatacccaagactgagtaatttgtaaaggaaacaggtttaactgattcacagttccacatggctgggggtggcctcaaatcatagtggaaggcaaatgagggacaaagtcacgtcttacatggtggcaggcaagaatgcttgtgcaggggaactcccatttattaaaccatcagacctcatgagtcttattcattaccatgagaacagtatgagggaaaccactcccatgattcaatgatctccaccttgccctacacttgacacacggggattattataatttaaggtgaggtttgagtggggacacagaaaaaccatatcacatacctttatatgaaagcttctccccatgagtccatcctcattcccctatacttctcaccttagcaaccacctttccatactcaaccatcaattgtatgagaatgagctttgatctatatctcagttcctgcttggctctagatcaatgttccttgctattcttctccacaaagctatgtactggtacctaaagtttactgtgttcattttactgtctcttttctgtttatggtacctgccttttcctagttgcccaggtatgcaatttcaagttcaactttaatttctttcataccctcaagctctgtgtcccgttactaaattccatagacttcacctcacaaatgacccccaagtctatctcctcttccatttatattatcactgccctatatcaggccaagattgttattgcaatggacgctgaactggtctccttgtcttctacttcttatagtacaaccttaaatatacattctgatagatccccctctcctcagcagtttcctcctgatataatatgagtatttgtccctgccaaaatctcatgtgcaattgtaatccccaatgctgaaggtggggcctggtgagaggtattgggtcatgggggcaaagccctcatggcttggtgctatcttcaggatggtgagttcccacaagatctggttgcttaaatatgtgttgcatctcccccattcccaactctctcttgctcttgctttcactatgtggtgtgcttgctcctgctttaccttctgtgatgattgtaagcctcaaaaggcctccccaggagcagatgttgctatgcttcctgtacagcctgcagaaccataagccaattaaacctcttttctcataaattacccagtcttgggtatttctttatagaaatgcaagaacagcctaacacagaagattggtgctgaggggtggggcattgctataaagatacctgaaaatgtggaagtgactttggaactgggtaacaggcagaggctagaagagtttggagggctcagaagaagacaggaagatgagggaaactttgtaccttcttagagaccagttaaatgcttttcaccaaaatgttaatagtgatatggacagtgaaatcctggctgctgaggtctcagatggaaatgagggacttactggaatctggagcaaaggttacctgtgttatgccttagcaaataacttggatgcactatgtccatgccttaggactctgtggaagtttgaacttgaaagtaatgacctagggtatacagcagaagaaatttctatgcagcaaagcattcaaaatgtggcctggctgcttttaataacctatatcagatgtgggagcaaaggaatgacttaaagctgcaacttatatttaaaagggaagcagggtataaaagtttggaaaatttatatcctagccatggggcagagaaagaaaaagctttttcaggagaagaatttaagcaggctgtggagcaaccacttgctagagatatttgcataactaaaaagagccaagtcctaatatctaagacaatgggggaaagtcctccatggcatttcaaagacctccatagctgtccctcctatcacagccataggagggaagagtcctttcatgggccaggtccagggccccactgccctgtgcagcctcaggacactgttacccacatcccagccactctagctctagccttggctcagagggccccagatattgctcatgccactgctctggagagtatgagctactataagccttgacagcctccatatggcattaagcctgcaagtgcacagagtgaaagagtgatgaggcttggcaccctctccctacatttcagaggatgtatggaaaagcctgggcacccaggaagaagcctgctgatggggcagagccatcacagaaaacctctacaagggcagtgtcagggggaaatgtggggttggagcccccacacagagtccccagtgggggcactgccaaatggagctgttagaaagaggccaccatcctccagactccagaatagtagatccaccagcagcttgaacccaggttgaagtgcattggtggaatctcggctcactgcaacctccacctcccaggttcaagcaattctcctgcctcagcctcccaagtagctgggacagcaggcacatgccaccatgcccagctaatttttgcatttttagtagaaactgggtttcaccatgttggccaggctggtctcaaactccacctcagccccccaaagtgctgggattacaggcatgagccatcacaccaagtctggacttttgagttaatgctacaatgagttaacatttggggagactattgcaatggaaaaggacatgagatttgagaggagccaaggtggaatgatatagtttggatatttatccccacccaaatctcatgtcgaaatgtcatccccagtgatggaggcagggcctggtggaaggtgtttgggtcatgggggcagatctctcattgcttggtgctgtcttcaagatagtgagttctcacaaaatctgttcatttaaaagtgtgttgcacctcctccccttgctcctgcttcaccttctgccatgattgtaggcctcctgaggcctccccagtagtggatgccactttgcttcctgtacagcccatagaaccatgagccaataaataaacctcttttctcataaattactcactttcagggatttctttatagcaaagcaggaatggtctaacacacctccattgtctagaaaactaaggataaaataaacaccctatgatttgaaataatcatgtgtctatgtcaaaccttccaattttgtctcccataattcactaaacaaactatgctccagtcagaaaaactgtgctatttgctgataccaaatatgtttttttccttctccagcaataatcctatagtcaagagatgccttgggatgacactataacagctgggatatcaaggggctatttgtctttaccaagtgtctcctggccctctcccactcagaaagatctcaactagggaagagccatcactgaggtctgatcaatgaccaccatacactcataaacttcattctcccagattcgcaaaggacactttcccaagtctgatttttttaaaatgaaaaacattctaatcaaactgtacaagcaatttatcactaacccaattttcatttcaccatcattccattatgatctgcttgagttaatcagaggtaagacagaggaagcctcaatttacactgaaacttcttagcaatcgatgttgctaaagagaaattcagaacaaagtacagaaaacattatgagttggggaaatatacaattttattaatgggcagacactccaaaaaaattgaatgtatacatctctttctcactcaagctactgaggtttttttttaaaaacacactactaacatggtgacagatgtcatcaatgttgtagtaagagctgcaaatgttacagaactaatgaattttcattagagacatcagataatttcagaatgggttaagttgctaccatttgccattcccattaacatcattgtcatgtaaaaggtttaattttcagctatttttgttctagataaaatctttgtcattaaaatgagggatgattttgatatttaatatattccatggcatactccagtgtggtactaatttggccttttcagtattctgcatattaattaacaatccatccctcctccattccccagataagtgagaactgaaatagaatggacaaccaatcaagtcacagaatactgaaaagatcaacacagaagaaatgtgttgctctaatcaagagcatatacaaggcaccaaaattattttctcccatgctaatgactatgatagaaacaggagtaatgaatggcaccatctaaatccttttatgtgacagtattaccaaagcacagcaatgctccctaaaaaataaaaactaagtatttcttattttagtcaaaagaataaaactgtggtttcacttaacttttagaacaatccattttgttggattctgcaacaaatggcagattatgtcctgttttgaattttttatagtaatctatctcatgcacacaaaatgtgtcctcaagttgcagaatgtccaggatcactgtggaaaacttatttcaatacatactctattagttttctcctcttgctaaattatcactctggtaagaactgacatcagctgcttaaataatacattaaccctgtttccagaagctattgttttcatttgagtgggcatttcctctaaggataaactttagatttttacccaagaagataatataatttgtcataatttaaagaccaattgaatgttttgaatcagttttatagcagtaatgatataaattcccagagagcaaagattatggcataatgcacacttacagcaggtgtgaacagttgtccaattaaatcaattagcccaatctgtccaacaagaccaggcctttcatacattttctgcaatagcacaaatgtagaacaaatgttaaagatactaaatattgtgtattataatttttctatgtcctactatgtacagaaaagcttgcagtcatctgcaagtctctcaagtgaacatcctacttcaataacatcagactttttgtccttggtaattatggttaagcccaaatcattcccatgatctttctctgagtcgaggcctctaagaaaaacaataaatttatcaacataatgtcttccttcaggctcaaaattactgaaaaaaatcaatggacactttaatttttccacaaaatattactcttatagaaaaattcattcattcttaataagaataatagtacttaagtaacaacaacatacttaattcacaaagatatgttgttgacaaatcagcagttaagatttgtgctctaagttgttcctttgttttgctctgtgttttcaaagtagtggaatggatttacaacctcatcgtacacatacaagatggtaaaatgcctagacacttggataagcaccttgaaaaaaatgcccaggacagacatcagcagcaccttgttgtaaacaagtttttacatcttgtccttcatcacaccctaagcttcagagttttaagaataaaaacgcaaaaagtcaaatatgacaataagaatattgcttaagtatagccttgagggctacttcagcattgttttaagatgattactagacttagtccctctagtgttggatgttaaattccactgactttttttaaatttaatgacttgctaatgtaaacttccatctagaacaatcaaatagtatgtcatttattcaaatttacagtggctctaatgtgccagcaaactcccttgtcaaaacagacaactttaaaaaatgttcatttgagtcaggagtcctacttcctaaattagcaccaaagtgtcaccttgatagacctatgaacaacaaaatcatttataataaacccagcttccctctagagtggacagcctagttcatgcatctgtaggagttccaattattccctacagataagagagcacttggagatgctcaggcatcagcaatctgtcacctccaaatacaatcatctgataaatatatgcttaccaatctccctcgagatctgggtgaaggcctccacaccgctctcaccatagttcccctcagaagccagtgtcgaaacataattccatcccagtgctgtcacgatgtccaccatggcttgggcttggtaggagtcaggcggaaccactcgagagaaaaagtcatacctggtgttatcacttagctctggggctgtggatgcatagctgatttgaggtatctgcaaaacaaatgatgggtcatttcaacccatgacgaatcttgaagaatgatggattgtcatatgagctaaacagccaaggctataccagaaacctagacatatcaacctgaagccaaaatacagttttatgactaccaatttaattggaaagtatttttgaatggcccataggcttactttctctcaatgcacaatatttctaaacagtgagaaagaatttcattttgctttagtttccattgtttctggagccaaagcaaaacatttgtgctttttgttgatgttgctttttgttgatgttgcttttttagtctgtacatgataagctctggtgcagaaaggagagaaaaatgaaggcatatacatcagaaaaggtcacctctgaaactggctttggctttataggacataaatgctatacaatgactaacagggaatttaatataagatttttttatacttgataccatttcagtcttaagactatatttttagtaaattattgtaaatatatagttttgcaagtctattgactgtttattgatataatcagagtgccacaaaaagatttgagaattgccagcagccacatatcctctcatagaaacatcattctaacccccttcaaaacatcacagaaaagggaatccagaccataaattctttagaagagactatttttcttttaatggggtgaattgccagaaattctttgaaatgaggaatcctatgtcatttctcaataatgtgggagagtgagctatgtgattgtgtatagtaactcctctgctgccatgctgtggtatgagtgaaagttcagagatcaaagtgactccaagatgccctaattcaggtaacttgaagatgcaggtttgacttgtacatgaaaaaattaactttatgctacatcacatgttgcagctaatgtcagtgctcaaagaggatgtcggagttgcagttccatctttccccacagggctgcacactctgggatccaatagtccccactacagtgtagacagatgattcccaatctatataaacatttcaactccacccttgacatacttgtaaagctctcaacatctaaataaccttcctaagtctagagagtcctgttccctactagtggccagtgaaatgacagtgaagttcctaaaacgtaaaagtcatcccgggagcagcagcagagcaatgtgcttggagctgtccatggtgctgactattcattcagcttccatgtaacttggatccacctgcattggccgtaacagagagtacccagaatagcgtggcccatttaaccccaaattctttctggttctgttctcctagtggggactgtgttaacttatttgttaacactgtgggaccatgaaaaccatctgacccacctcctcctgccctttgccttctctgccagatatactgaccttaccttgacaaatttttcccctggttagattttgtgactgcatagtacatgactactcgcaaggacacccctccaaatctcaaaccacacaccaaatcttgccctttctcaccttttcttgtttgttttcagaggacctgggaaggaaaccatggataacttagtgagatctacctcttactaggtaaaaatttcccaaatatcaaaagtatgtgcattcctatatcctaacgaaaataagtcagccatctgactttcactttagaagaaattatatgtatgtgcgagtaggggttgtgtggggggaagggaataggggagcattctatagcaaaatatatagccctacaccatttctttgtcctatttggataccgatactcccacttcctgagctactaagagtccagcagtaaaatgacttacacaactcccaccctgcctataataatgagccaccctttctaaaaatgagcagaaagtgtgaaaattgagtgtttgaaaccaaaactaattatctcaaattactaccttcagtcagtcacttccaggctgtttaattagcagtcagcctcatgtttaggattaattaaacaggtgtaaagggtatataaaataaaagtgcagatagaagatggttgtttgattaattcagtaatggactttctccccaaagtcttgaagagttttctctttgcagatcaatgtgtgggaaagcaatgcaagagtatgcatttgtatttttattttttcactctacaataatacacatcagggtatatgaatagtatttcaagacaagttttcaagttttcatgaagtcacatctcatttttattttattgtggtagacccctaagcattggttcattaagcattttaatttctgtcccagcatccccagtatttctaccacccgcaaattaaaccctactggcaactgaagtaaaaattttttaaagacctggaatgttccttttattttccctacatcaaattcactgcaactacccacttaaccttggaggtttcatctaccagaaacacagcaatggaaaaaaaggtggtgaatggtgaagagaagcggaggaaaaaaatgaaaggaaaaagaagaaaagcatcccaagaaaagaagttgctaggaaaagcacccattatcagttcccccatcctttaaaaaaaaaagtagtgtcttttataagcctctgttaactcccatggccaatgtaaaggataaaatacaaactcttcggtctggttcacaaagatcatcagattctgtctcatcttcctcccctgacctgtaccttctctccatattctcacagcatctgcacccttctccataccagggagatttaatgctctcctctatctaatgatcctctatacaaattcaatatccagctcaaaagtcacctccatctggggacagttcactaactccatcaggcagagctgtcttttgctattcctgtcttccaaagcctccgccatctaacattagaatcatgactctgctggcttatgatcctctcaagaccaagcagggtctctgtttctttatttggcatccccaacaccaggcagaccaagtgctcaatgaatgtttgagggcaattaattaattaaactgctgcaggaaatttaatacagcttcttccccaccacctcctcccttgcattccaccaaaatattgtgcaggctattctccattcgaccctcctgatccttccctatcctgccaaagaccctaggaggctgctctctatgaccatactgcctgggcttccttgcctctggcttctagttgagtttgtcccggaggcactagcagaacatgggagggcgaggggcgacagaaagaagttagagtatttatcccacagtttctttttccactggctctgtttctccacctaacccctcacccacagctaaagcttttgccagattccagtgaccactctgtaccattgcccctgtaaggtctccccactgctgttggctccgaagcacttcatcatcccttgttttttctaactgtgcccacacttacaaataatctttttgtgaactgccctttcattacccctgggtgtgccagaagcctgatgaacactcccctatgacaagtctctgtagaagacaacactgctgtggctccccaatctcagccctgccctaacttcttagcccttctctagccacctgcccttccagccttctctaccactgtccctaggtgactttctcatttcctttcttcttcatttccctaaggcatcctactgcatatttgaaaacacctgtcattttgctttccttcatttcttattttctttgtgctgagacttcataaaaatatcatatgtgcttaaataaggccatatttctattactcaaatgaagcgtatttgagtcaattaattatacaactcaggacactcatcatcctctttttttaaaaaaaaattgttttggattccacttttctaacaattattttggttaggaaaaacgctttttcttctctcactatattctcacttcagcccacagaagaggagattcctacctcccaactccattctctttgggagctccagaacaaacatttcctctctcactctccgttcctttactgactttccccaacatggagggggaaagaaatcaaagccagagttctacgtttattgggcaaaaggggatagcaggctctctctttattctctgacctgtccacatacatctcaggcttcttttctctataatgtcatgagaccatgctgggcctcaattcttggaaaggaagcccaccctcttctctccatattccactggcaaccagacatttgagaaatacttgaagtccatgctactcactgcaagtgaactttaagtcttccgtgcaggcagaagtgggtcccaaggttgagatatggtgcaagagtaggaggcacaggttcaagctgaattatctcgaacgcagttcttagcagatagtcatgtgcctggggagttatttggtgcttgcccagatgttaataaagctaattacttaatctacatttaactagctattctgtgaatattggacttgcaaactctgagaaattccaaaaatttaacttagagctcaagattaaaattatatttcaaaagaaattcatttacatatattattaataggagttagcagagattattgtcttctagtgtctgttctccttctagatgaaacctccagtttttacctaaccacccagaacgtgactacatttcctggccttccttgaaatggtaagtgaagcttctgaaaaggatccttaaagggagaaggcatgcctttttcatgatcctccctctttcttgctggctagaatttggacataatgcctggaactccattagccatcttaggctatgacctagcaatggtggagcaaaaagccacaccctagtccaagccactgtgatatctggattcctaaagccacttgacttttcttcatgcttccattcatgctcttctcaaatctatgccacaccagcaagaaaactggtattttacaaaaacagatcttaaaggctgggtgcggtgtctcacgcctgtaatcccagcagtttgggaggctgaggtgggcagatcacctgaggtcaggagttcgagaccagcctggtcaacacggtgaagccccatcactactaaaaataccaaaacttagccaggcatagtggtgggcacctgtaatcccagctactcaggaggctgagacaagagaatcacttgaacccgagaggcagaggttgcagggagccgaaatcacaccattgcaatcctgggcaccaagagcaaaactctgtctcaaaaaaaaaaaacacaaaatagatcttagaaaaatcttgtttagagtccttcaatcatttccccattgcccttagaatatagcccagacctcctgtcacaggatcctttgaactggcaactgaccacctatccctctcactcacctgatccaactacactggcttcctttttgtttcacctgcagcactcatacatatcaccacaaacattttcccaagtaagtccttcctggcctttctcatccttcagcctcagctcaacagaccttccctgaccaccccatctagtgttgtctcctcaccttccattatgacctcatcactctacttatttccttcctctttcaccacctgcattaatttgtgtattctgtttcccctactaacatgtagattccacagggttattttctgcattgttcacagatgtaacatgagctcccatgagatagtaggtgttcaataaatattcattgaaagtaaaatgagcccatccatccattaatcaagaaccccttttgttattttcttccatgtatcctaactttgaaatatttttctataaaactatttaagttaaaacaccacccatttccaatattctcttttaatcaaagatctgttcagctgcaaaacttctgatcagcacaaggcatctgtttttaccaagctgaagtgatggaattccagttcaaatcaccgaagtgccgcttcagttgtagcctgtgcagtcttctcgtagggaagcttacaactgccactttgctttttgaaatgccaaaaatggccatgaaaacttcataactaccttggcaaacaccttgacagcccacggacttcaatgtgtcattaaagaataaaaattacatttctaatcaaaggtcaacatcatagattatttaatcatttaccccttctttcttatctttatctgtaagatagatattccagacagggaaaaaagtgcttacatctcccccaaaccaactgtgtctctccatgttgccttcactgagccttcctgtacatgactgagtgatgaaataaagggtctctgaggctccaaggggatcagagacttttagataccagaaatactttttgtggcccaaggaagaacaacttcagctgcctcaaggtttcccactgcttgcacatcaaaacattgcaataagcttgaaacttgccttgtctattcagaatgccataagtttttcatctgttcaccacagttactggtttgctaaatatcccaaggaagccaagacacccctgacaaggctagcaaaaagccacctaaagcacagcttagaggaagctcctccaaattctaggaaatttcaatctttctgcaagaaacttgcatacatctgagtacagatttgcagacagaagacaatttaagacctgaatcacgtatattttcaccatgaaaaagggtttttttttgtttttttcccccctgccaaaaaaggtttttgttctctgcaaacaaccttgtccattgatcatggaacttaattggtgaagtaggttggcggggtgggttctttgtgctactcaataacatcattggttttttccagtgaaagatcagcttgaagccacattcttcccttagggggtagtgcttgaccaagcacttttccagtgatggtggttagcaacagcggccatcaggatgatagcttcctaccacctggccttggggtagatttgtttttgctgcaaaactcaggtcaaaaaaaagcataattattatagccattaactttgtctttttatatacttgactgctctctagtattaaaactactagttgcttgtggcaaaacatcagtatataatcagaaattagatataaatgaggagttagggctagaagtcaatgtccagcactggcccaactctcccgacactgccctgagctttcatgctcctcccaccttcatgaaaacaggctaaggagagggaaaagaagaaaggaaatgtaaagccagagtgtgaaacaaaaaagaagatggatgactaccccaagtttgcatccaaaaacatgaagtagtagtattccttccccaaatcaggactggctcagaataatcctgtcctcatagtcgacagttattaagattcctgtttgtacaagttggtgtcaaataggaaattcagtctctgaccttttcttctcagttgagttcccatagttgattcagagcaggatgtgagcctttgggttttgatgcacaatggagtttaacaaaagcaaaggagaggaagcctattgaaatggggaaatcatggggtcaaggagagccaggagtacactatattgcaccatatttttatctatctccccaacatgagctcagtaagaccaagcaaagctttacatacacacctgcacaaaaggggcctgtggttagttaacacagctgagtgtaacacagttagtaggtttaaggtcatgagttgaattccattatgggccaggatgaagaccacacccctcaccagaatcttcctctcacaaacacagagcacataacaaagtcaaccagagagaggagagacaagatcaatccattctcactgctagatgaataattcaaagatggtttgctactaatggtgaacctaaaattttagcagcaaatcatgagacacactttcttcaaaacatagtgtttttgtatctatatctgcctgaaagtataaatatatattacacttacaaagtcatatgttgatttcagataattcatttgaatagaccattgaattgtaaaagggtacattttctcacctccttttcatgggtattgtatgagtcatagagggaaagaaaacaaatgactcaaggagactaaataaagggactattttcaaggcaggagcagcatatagagaaggcagtggaaagccacaacctagaaggagtcagaggtcgaggttggcagttgttacccatgagccctaagagagagagcagttacagagtcatgaacggaagccaccttgaggggtgcagtaatctctctaaaaggacacagccagcccctggcaacctcaaaaggaaattgcattctgacctctccctcatacacacctcctgctgggtctccctctgaccaaatctattggaagccagagagcaagagaacttgactttgcctgcacaaaggaaccttccacggcagccagcagacagcaaaagaaagtggttgtggcaggccaagcagaagctatctagcccaggcaccattaatcattgctcactggacatgtgaactaaatgtatggagagctgtgcagattttcagttttctacattatattactctttcataatttgatgctttcaaatatttttgacagaaaatctacactaagacattttgatttggctactgaaaatcccaatcctaagattagactaatgaagtctggatttcttatggaaaataaaataactaatatcatgttttagaaagaaatgtaatgattttaatcaaattggtaatggcattttgacttctaacctgtttacttaaaataaaagagaagcaatctatgaacatgaaataatttacatataagcaaccataattttaccccataagattaataaaccttttttttttacatctgctaattacattttacaataagaaagcacaacagctccttaggaaaagaattgttctaatccatcaagtcactagtagtgtggggatttttaagcctaactaccctaaaagttttactagcaagttggatttaaaaccttcactttcaaagaaagggactttaggctgggcccagtggctttcatctgtaatcacagccttttgagaggctgaggctgtaggatcccttaaggccaggagtttgagaccatcctgggcaacacagtgagacctccatctctataaaacattaaaaaatttgccaggcatggtggtgcacctgtagccccagctacttggcaggccgaggctgcaagatcacttgagcccaggaattctaggtgacaatgagctataattgcaccactgtattccagcctgggtgacagagaaagacactgccactcaaaaaattaaaaagaggactttaatattccaactaattttatagtttctctagtttatagcatctccttatcttcaattttgcctttttaaaaaattgaacagttttatttaaatttccatatatttcagtactctgtgattctaaaaaattataatcagtgcatatgcaaaattacacagaaatttagaaggctaaaccaatacatacacttcttctaatagttaaatgttctttaatggttacttttttattaattcattcaacaaattagctcccactacatgccagacacggtgacaggccctggagacaggactgtaaacaacacatggtcctcccagccccatggaacatatgaccaaatggaaaaagcaggcattcaataaataatcaaccaaataaacatttaacggcaattgtaatggttgttgtgaaagctatgaacctgccgctaagagttacagggccactcacctggtccgcaagggacagggcaagcttccctgatgaagtgacattaagttgacacattgaaaaatgaagaagaaaaaggaatgaacactgaacaccagccacagattgcctctcacttgagatctccttcagatgtgtatactacccaatttgcagaaatgaagaggacaggcagtctactgacaggtacttaattttagaaaacttgccacaggctgaaaaatattaaaccatagaccaccgtctcccatgcatattacaaataatgttttcaaatactatatgcaaaactggggttcttatgccaggactatcaagaaaatgctacgtaatttatcagcagggacttgcattacattctcacagatctctgagtcctgaggcttgtaagggtaaggcatgaataaatgaatggatagatgaaaggtaaacagatgaatgaaaactgaagacactaagaagcaactttaagtcaagagtccagaaaaaaaataaatgtatacttatattacttataagctctaatatttgtttccttccttaggaaagtaaaaaataagtgattgaaaagtaggaggaaactctcttctttgtactcaggcagtgaaggctttgggataggacttcaagctatatgagaagcaggttagaactaattctaaaagaacctggctttgctttgctttgctttggtttgtttctttacaaggtaatatatattttctgcacctctcaagaggaggaaagagaaatacatgcatctgtccacccctggaaactctgctcaatgaggcagcatcccagggagacatggagaactgcattccctgatttcattctttctgtttctgccagtttctttgatatcttcttggaaaagttttcaagcagtttgggatttcaagatgaaatctctgattattcttcaaaagaaaaattaggggaagttttgaaatgagctgcttaagacagtgaaagttttctataaagtgattttcttacatgagtacaaaaaataataaattacattgtgttataatagaaaaaccaaaacgatgccatggcactttattagcatcatttgctaagttacttaaaaatttaactctcccacccactcattcccatcactgctgacttcaaactatcacctagcatttaattttcctcttctgctgatttccttactgtgcaatcactgctgtggttcaatttttcccccaagcatgtcagcactagaacattataaaataaaaagtcagtaattataactaacaaattgaagtcaataaactttaagctggcaaatattcgatttagactggcattctgccagccaatagtacatgatttgactcctgcaaataaagaagaatgttgataaggacgtttatgcaagtaagtttcctggctggcaatttcatggatttttagtgattatccgcattcacaaaatcttagtcttcaagtcattatttatctcccagctagcattcaggtactgattctgaacacctaatagcactggaaattctcatttactttctgttacctaagttagtaaacttagtagattagaagaaggtacgcatgaggttaaacgtcttcattcgagctccatttacacagggggaaaacccactccatttgcaaagaccaaaaagctgatttcataaatggacatcattggtaacaggaaaagttgataaaaggatgtaaatgactcagagtcctttattccactacatactacagaatgcaaggatatgttcctctgagaaggcatcatctcagtatccaaagggcaatacattaagtttcccctaaacaaattgattagccctttcatcctatgaacatttttgggaagcctagcttactgctctctataagccttctttatgtgtcgtattccataatgtgtgcgtatgtgtgtgtgcgtacacatgtgtacatgttcattttgccaacatttatttaacatgttatattggccaagaactgtgcttagtgctctagcttcatttcatgaatgactaaaccataatctggagaagtaacttgcccaagaccaagtaatttgtaaatgacagaataagattcaaatccaggtagtctgaccccggattcatttcttaaactcctctactctccgctactttgggtccatttttaaatctgatattaattcttcagtagctttttttcccacaggtgttcagcttcctccccgtttccacctctgttcacatctacaactcctttatggttgtaagtcatggcttggctggagcttggacatcaccagccattgccatatatggtatcacagtgaataggagatactagcatctaagatcagctaaatattatctgcctccattggttttcatcaatcccaattgctactgttccttctggggaggggggcctcctggcccagttgggtaccaacaaaatggtctgagacaagtttggggcaggttggacagcaatcacataggtcaacaggggaaggtaagtgcaaaaagggctagccaagttcccaagttcagagagagcacatctaaatacaacaggcgatggggagcagaggcaagaaccaagaaatggggccaggcgtggtggctcacacctgtaatcccagcactttgggaggccgagttgggattgcttgaggtcaggagttcaagaccaacctggccaacatggtgaaaccccatctctactaaaaatacaaaaattagccaggcatggtggtgtgtgactgtagtcctagctactcaagaggctgaggtatgagaatcacttgaacccgggagacagagtttgcagtgagccaagattgtgccattgcactccagcctgggtgacagagcgagatcctgtctctctctctctctctctcacacacacacacacatgcacacacacacacatacacaagaaagaaagaaaaaagaaaagaaaaggtagaagatgactgaaaggtgttccaggcataggggacagcatctgacagaaacaaacctatgaaaggctatagattgcttaggaaaagctaacaattcagtagtcttggtgaaaggtgttcatgagcccagttcagtctgctttctgtttgtttgttctcgtttttcatttcaacaagtatttgttaagcacttacgatatgtcaacactctcttacttggcctaaatgagaactcactctccaattttcctcttaaatctctatctcctttgttggctattcttcccttgtttcatcctttaagtgttagcattccttaggatgtggcctagactcttttgtgttcacttcatacccactccaaacctataaatgcagtctaaatctctccagtgagttccagacccatgtcttacttatttgacctctctcttaagtgtccaacaggtatctcaaaatgacatgcccaaaacttgtcacgcacaccaatcccagcataaactgaagatcatctggtgcaccaggggtcctcaagtcatagctggccaattggctgggttccagaattatgtgagtgccacacactttccaattatgaagtttccaactatgcagctatcatctatgcatggctttggtctgccttgtttagccctcccttttttatacctctcagtggccagttggccaccagaaatgaagactctttaaaaattaaatttaaggtccaaatttcctctagaggaaaacaaatgcttatatgttttggtataaaagatatgttcatgttgcaaaagataaattcaacagtattgactacagtaactgtggtactaagttttctctacaatcttgctactcagtgctatcagcaaacccacagcatcagcatcacctgggagcttcttagaaatgtagaatttcaggccccaccccagacctactgaatgagactttgaattttaacaagatctccaggtgattcgtgttcacaataaaattggaaaagctctgctatagtatgaaacattgaatgtgtactcaagagccctgtttccttttgaaatttttccatatcatgctcaaagggatttaaacacattcattgcaaagattatttttgtagctctggatgttgtcatcatgaggagatataaaagctccctctaattcactttatgaagaagttgatgccttgaacattatgttcacttatcctaggatgaacatctcctgatcattagaaatttcttttcaaaaatattctgcatccaaatttctgtttttaagagtattatgtttcagttcttgcatcaaatgctagcatggagtttatttttagtgtcatgataaatctatagaccagtgaatatatcatatcaagagttgagtcagtaaaagctttttaaatatatttcttacttatttgaaaataacagatgagtttttgaaaaataaaaatttggcaaagcctgcatgatgaaatgccaaataaaagatgcaatgtaccttgtcatcgatacattttccatagcatttatatgcagcaggataatttagtaagatattcatttctgtctgattgttactgctttaggagacggatgaaaagatttattttcctttgcgccctctacatgagcaatcaagcctgcatgtcttggcgaattagctcattttcaggagacttggcctatagaggttatagagctgaattactagagcaggggcatctcccaaggtttgaggaggaggaatttgaaatggaaatagagggagagaatagtacttcaccagagacttgggaatgagtcttctctggtagtgcctgagaacccaggaaccctcaaagaagctcatttcccatgcttgccatagaaggaatggaatccccctccttttaacagcccacaggggctacagtgagcatctccgtggttatctcctctgtacctatattagtccactctcacactgctctaaagaactatctaagactgagtaatttatgaaaaaaagtcgtttaattgattcacagttctgcaggctgtacaggaaggatggctgggaggcctcaggaaacttataatcatagcagaaggcaaagggaaagcaagcacagcaggggtgagggagagagagtgcacgcaaagggggaagtgccacacacttttaaaccaccacatcttgtgagaattctatcacgagacagcactaggcggatggtcctaaaccattagaaaccacccccatgatccactcacctcctaccagtccccaccttcaacacctggggactacaattccacatgggatttgggtggggacacagagccaaaccatattagtagccttggcaactgaaggctaggtctccaaactgaatatgattgaattgttgacaccctagtgaatgtggctcagtgtcagaattatttgatatcaaagaaaaaaagttcatttcacttcagttttgaagagcaaattcatttcatacacctactttaccttagagagtaggcttatgagctgaggcactgggatacactgctattcttcagcagatcctaggaaagcactttgtacatagcagataacacatggacattgttgattaactgcttactagcgacagtaaaacaactcaggattcctggcttttaatatcaacagtctacctagtaaaactgcttctcaaaagcttcccacattttcggtgcttaaatgaaaatatacttttctttttttatgagtagctgaatccttttgcatagaccgtaacttagatatatgaagacatttattgtctttccaattctaaatttctaaataatctaaatatgtaaatgtctccataatgctttgctagagactgtatgtaaatatcattaggctttctatttaaaaaaaaaaatggaaaaagaaaaaacaggaaaacctcttaggcacgtctgtcttttaaaaaaataccatttcaacctcaaatttgatgagacatacacattgctttttggatgccctttaatttttttttaattctaagaaaaaaaatggaggagatttaaagtagtttgacatttaagaatataatctaacttaaattaggattgaggtactgcaaatgtagacattttcttttgtaaacaaataaatagaaagtaggacaacaagtagaattcaaggtagctcaaaaaatgcaggatgaaaaacacttgaaaagaaaatggaaatactgagataaaaaaaattcaacacgtcaccaaaagactttttgggagagggactgagaagagtagggggtagattaaatatactggttgagaaaccagcattagagaagactagggactaagggtaaggggatgagtggagaaggcagtgtggcttgagtcaacgttgaacttcaggaacaggagaagaagatgggaaagaggaaaagaaagacttttaatcccctgtagcaggagatggaataagcaaagaagtcactgttttccctccagccttccatccctgctaagtggctactattgaattaatcatctgtaaatcatcattctggactggcatagccttggtttagggtgtctcatttcatccatataatagtcgccagggctactgagtcccttcaaaactagtaatcagccagatgtcacaatcaaacatgtctgtgcctatacaactgctacggtttgaatgtttgtcccctccaaacctcacgttgaaatttcatccccagtgttggaggtggggcataatgggcggtgtttgggtcctggggggaatccttcctgaatacgctaatgcccttacaaggttgggggagtgagttctcactctgttagttccctcaatagctagttatttaaaagagcctggcaccttccctctgtctcacatttcctctctgtgtgtgacctctgcacactctagctccctttctgccttcagccatgagtggaggcagcctcaggccctcatcagatgcagatgcccaatcttaaactttccagccatcagaactgagccaaataaaccttttttcttcataaattattcttagcctcaggtattcctttatagccatacaaaatgaactaagacaactttattattctgcccatggtttctaataaaacattaccaaattttcttcaaaaattcctcagatctgtttcaatatgggtcaaatatttttcaaatattttgtagaatgtatctttttcttccccataagaaatagaagccatcagttaaagatacctcttaatttcacatcatcacatgacaaaccttcccttccttcttcctttccctttccctttcctttcgttacaagaaaaaatgtcacctttgctatctaaagtgaagcctcaactctgctctgaattgcacatgcagcagcctttttgagcttgacactgtagattattgcctctctctttcaagtcattaaccacatactttcaactgggtcctttctactggcatttgtgtatactcaagcctctccaattcaaaaagaaaacattttcaaaaaagaaaataaaccattactcaactcctcatccaactccagctctcaagctaatatttgtctaccttttacaaccaaactttaaaatttcaactaagtaccctctccattgtcttacctcccactcacttttcagcattgagaccggcttttgtcccagggctgtattcaaactgctctaagcaagatcataaaacttttcatgtcacaaaatccaatgctcaatttgctgtcctcatttcacttgaatcagcaactttaaaatctggacaatattttccttggcttctacaacacgctctcttggttttctcctacccctctagatattccttctttgtcatctcctctagttcatctttatttgcttacaatttaaaagtgaggttccctgaggcctgacctgagccccaatatttttgcaccctttcattctcacaagatgacaatgtccaacaagtttatgactttgatcactgtcagtataactacaatgcccaaatttatctctgaaatagtcaactcagacttctctaaaatgcaaacctactaccaattggataatgaacctccatttagaaattttaaatttaccttaaattcaacatgatcagaactgattgcacagacttgcgcttctggccaaaacgaaataactggaaccagatgtagcccctaccctttaacaaaatattgggaaatcaaccttaggagtatataaaaaattaaataaacaatgacaaggaatgtaatcaattcaccatattaacggtataaatacaaaaccataattggtgtagaaaaagcatttgaaaaaatttaacatccattcacaaaatagataaataaacaaataagtaaagtctcagcttattaagactatacagaaataccctcaacgtgataatggacatctgttgaaaaaatacatctaaaatcatacctagtggtgaaaggctcaatgcttttcccctaagagtctgcaagacacaagactgtccatttcactggaaattagcaagctgattctaaaatttgtatggaaatgcaaagaatttacaatagctacaataattttaaagaataagagcaaatttgaagaattcattaaatgttttctaaacaaactataaaactacagtaatcaacaaagcaaagattggcataaagctagatatagagattaatggaaaaaagtgaagagtttagaaatggctataaagatgccaagaaaattcaaaggggaaaggataacttctcaacaaatggtgctagaactgaataaccatatgaagaaaaaagacacttgattctcataccatgcataaaaattagtcaaagtggacaactgacccaaacacaaataataaaactatacagcagtacacgcaaggatacaaaaatactagaagaaaatctagggaaatctcttcaggacaaaactcttctagacaatgaattcatgactaagacctcagaagcacaagaaaccaaaacaaaactagataaatgagtacttaattaaactaaaaaaccttaacacagcaaaagaaataacagagtgaacagataacctgcataattagagaaaatattggaaaactatgcatccatcaggggaccaatatccagaatttataaggaactcaaacaactaaacacacacacacacacacacacacacacacacacaaataactattaaaaagtgagcaaaagacggttttcaaaagaagatatacaaagggccaacagacatttgaaaaaatactttacatcactaatcatcagagaaatgcacattaaaacctcaataagatatcatcttacactagtcagaaccattactattaaaaagtcaaaaaacaacagatgttggtgaggatgcggagaaaagggaatgctttatactgttggtagaaatgtaaatttttacaatctctatggaaaacagtaaagagatttctcaaagaattaaaagtagaactatcatttgatccaacaatcccactaccgggtatctacccaaaggaaaagaaataactatatcaaaaagatacctgtactcatatgtttatcatagcactattcataatctttgctaaagatatggattcaacttaagtgtccatcagtggatgactggataaaagaaatggggtatatatggacaacagaataccattcagccgtaaaaataatgaagcatgtcttttgcagcaacatgaatggagctgcaggccattgtcttaagtgaaattactcagaaacagaaagtcaagtatccgacgctcccacttataagtgggagttaaataatgtgtacacacagagtatagaatggtaggtctagtaccctcagaagggttgggaagagaaatggggtgggtgatgaaaaattagttaatgggtacaatgaacattattcaggtgatggatacactaaaagccaagacttcaccactatataatatgtccatgtaacaaaattgcacttgtactccttaaatgtatttaaataatactactaataaaactattagaaaaacttaagtgaaaattttcacaaaattgaggtaaagatgtttagaaaagacacaaaaagcacagttcataaagtaaattaacaaattggaattcaccaaaataagaaacctcttcacatatcattattaataaaatataagtcaaatcacagattgaggagaaaatacttgggggctatatctgattaaagacttttaccaagaatttttaaagaactcttacaactcataacaatacaaacagtccaaattttaaaatgggtaaaaaacttgaacagaaattcagaagagaagatatacaaatggataaataaaaagatgctaaatcatattactcttcagggaaattaaaattaaaatcaatgagatataactacatacttactagaattcctaaaggtagaaactgacaataccaagtagggcaatgatgtgaagcaacttaaactctcctacattgcagttgagaatgcaaattgctacaaccacttttgaaataatttggcagatatatatatcccttatgtgtgtggggggtatacacacactcacatatgtacatatgtatgtacacttataaaatataaatatatgcatctaccacataatccagcaattctactactaggtatacttacccaagagatataaaaacatatgttcatacaaagacttgtactcaaatgttcactacaattttattcacagtagcccaaaattgaaaacaacctaaatatccatcaataggtgactgaataaacaaactgtggtgtagcaataaaataaaatacaacttggcaatcaaaataaattactgatgaacacagtaatatgaatgaatctcaaaactattatactgagcaataaaagccaatcccaaaagattacatacaatgtgattctatttattgaaattccagaaaacacaaatctaacctacagtgagaaaatagatcagtgatttcctggggccagagcagggtaagaggactgtaaatggcacaaggaaagtttttaggtgacggaaaaatgctatatcttgattgtgactgtgatatacaggtttatatatttgtcaaaactcatcaaatactcatttacactaggtgcatattattatatgtaagttattatttaataaagatttttttaaataatcaatgcctggtctctccttccaccccagcacacacccttcaaaaacaagtcctccttaagttatttgaaatcttggtataatgttttcttacttccatatccttcaacactcatgttcatgcaatcactatattctgtttaccttcaaaatatctcggcgtcttgacatatcttatctccactggcacctttaggcctatgccccattagctcttactcacatctcttgtgacatctcagcaggcactctcatggccttccaatctattttccattctatttgcatttctcaaaaatataaaagataaagggtcttaaaaataatgtgtagctactcacccaatgatgctcaaagttggtttgaaaaatctgggtttgaatcttaagaagtggtttccaaagctgagtatcagaattacctgggtggctttttaaaaatcagatttattaacctcatatggagattctaattcagtttgaggatgacaccaagcactttctccaactatcctgataatcatctagttttgaggatcatactactctgatgtcagtggagttactggaaggttaagtctcatgccaagaccatcaagctgagtcattttatttataccactgtttccatacagcctggcagctatccactaggaaacctgcccaccaagtaccaggtttaccactcactcttaccaaagtcatctgtctttatctgaaagatcccttcaatggtagtaattattgtaatactaattattgtaaactttccaagcacttttatgtatactataacttttgcaactatcttataaagcagatatcattatctctactttataggtaagaaaactgagacttgaaagttagggtcctttgcttacaaacagctaatgaataacggtaaggtttaagccagaatctgtcagattccaaagaccacattctttctgtgatactatatagtttccctaggaataagcagggaaaaaaatgttccctgtcatattcactgcttcctttatatctaccttctgaatttgttcttctccagtcagcttttggatggcagctgccacagcagaaggcccagcaaacaactgaacaatagctaatatctgattacaacagggaagaaaactgacaggacaaaaaacaaaaccacatgaattaaggtcctatggcaactgcattatcaatattaatcatatgacttcataatgactccttattcaccatatccaacctgataaattggaattatttcttcctacgaataaatgatatgtaggaatgtctataagtatgtcaaaatttcatgcatcgtgaatttcatagcaggaacccggctaaagtcaacattcatatcctaacatttttaataaatctatagaatcaaaggtataaaccagaaaattattagcctttcagttgaggtataaacaagactgaacacttttatttaccattccttgctgaagctattagctaatagccttaatttatgaaaagatatttatttcctttgaactgctttccccaaatcaaggcaaaagtactcagcatctttgagaaactaaactgttggacataaaaccaaacttcttgttagtataattttaatcatcactttattatatactgaaaatatacatgtactcatgtaagttaaatattcaaaatagccaaaatcaaattcccaaacacttgtgcaaaactgctaaaaatttcatttttcatcctcatctagacatgacacagaacagcttgccatgatacgcccttctcaataagtgtaaattacacacagtaggggatttaattcccagaccatggaaagctaaaccaatgagaaaaatcaatccaaaagactgaccttggcagcccaatcgtgaatgtagttattttcccttcagccaaagtcacagtagagattctttactctttctagtttgtcctagaaaactaatacatgggtcaaacaataattttctgaatttggaccgctgttgcagccaatcaagataattttgaagctattcaatctctgagtcatttctcagtaatagaatttgtggcaggtcaggaagaacgatatggtttggctctatgtccccacccaaatctcatctgagattgtaattcccatgtgtgagggaggaacctggtgggaggtgattgaatcatggggtcagtttcccacatgctgttctcatgatagagagttctcatgagatctaatggtttaaaagtggcaggttcccctgctctgtctcctgctgccatgtatgacatgccttccttcccctcccaatcatagaagcatcatgactgtaagtttcctgaggtctcagccatgtggaactgtgagtcaattaaaccttttctttataaattacccagtctcaggtagtatttttatagcagcatgagaacagactaatacggataattggtacagggagtggggtactgctataaaaataacctgaaaatgtggaagtgactttggatctgggtaacaggcagaggttggaacagtttggagggctcaggagacagaagaatgtttagaacttcctatagatttgtttaatggttttgacaaaaatgctgatagtgatatggacaatgaagtccaggctgaggtggtctcagatggaaataaggaacttattgagaactggagtacaggtcactcatgttatgcttttgaaaagagactggcggcattttgcccccgccctagagatatgtggaactttgaacttgagaaacatgatttagtgtatctggcagaagaaatttctgggatgattggttttgaaatgtgaaaaaggcatgagatttgggaggagccaggggtggaattatatggtttagctctgtgtgcccacccaaatttcatctggcattataatccccaagagtgagggagggacctggtggaaggtgatgggatcatgggggcagtttcccacatgctgtttttatgatagtgagagagttctcatgagatctgatggctttctcctgctgccatgtaagacactccttgctttcccttcaccttctgccatgattgtaagtttcctgaggcctttacagccatgcagaactgtgagtcaattaaacctttctttatagattacccagtctcaggtaataattttgtagcagtgtgataacagactaatacaaaaaggtttttgtttgggagcagaattacaagagttcttaattgtctgagcatgtgttgcccaagaaaccttagtgcaggagttgcatggagaagcaagttgtcataaatgaaaatattcactaagccactgacctctgaaacaggctccctcccaaccttcacttttgttccaggcaaaattttttaatcaacttcttgttgattgcttacaatagccaaaagtaaaatgcaaaacaactacaaaatgaaattggagatcttataaaagatccagagttatagaaagtcactggaagcagcattgaaaacttgccagaatcatgtgcaaaatcatggacatatgacctttgggatgattagaccaagggacagacaacaaagttttcagaggaaagtggtttcataattttgttttgatttttgatataaagcctcaatcaattttttaaactatttatctggaaaagtttattcccattctaagtagaatcacatgtaagtgccatattccagggccagggactgtcagataacgagggcttccttgtaccaccttctcaattcttctctgcctgtggggacactggtttaaggtatctcacagtcccaagttcctaattttcttattttattaaaatgataatatgacttacatatttttaggaaatcaattttccataattttcatttctgtgttttttttcaaccaggctttaaagacagaattgactgaacccatctaccataattttgtggtgggagacttgctgcatgtctattatttcttgctatattactcttataatttaacatttcctcttttatcctttgtttcctggaatctgttatttatgcttaattatgttttcttccctaaacctatacagctctgaactcttaaatgcaagagtaatctgaacagcatgaacttaatttataactctaataacatttttcaaaataaagagtagccatttaaaacatgtcatttattttgaattcggcagtcttaaggaaaaaaataataaatagggacaaactataatccattatgcaccacagaccagtcttcattatctatggcaagctacaatcagccttctctgggatacagcaaatctgaggcctggatttggaatcagggtcttgctttgttagaaaaaataaagttaacagggacacagctgtttctcagaagatgaagttgggacacccttgttcactttcaaagttgtcggacaaatttgagattcacacgctaacagaaaatgctttcccctctcgcttgctgctactcatcccaattcctttgcttaggctataatgagaaagttacttttattgcattttgttccttttaattatttcttctccttttccaagctttccaagtcatccggtctttcattcattcatttctcaaatatttactgagtatctgtcacatgccattctgctcagtgctagagacacaataaaacagacatagttcaagaagcttaggatctagtaggtgatacagacaacaaattgacaggagctaatgaaagcggtacactggaaatagtgtgtgggagagatgaaagtgaggaggaatctcactttatttgaagggtcagataggcactttctgagaacatggcatttaagctgagatttgaaggacaggagggagccttgccttcctggcctcgcaagtacctgaggaagaggtttccaagcaggggaagagctgatgtaattatgccaagaaatgaaagggtctgggcactctaggacatgcttctgtggctagagtggatgaacggacaagaggagtcctagatgttcactggcaaaagcagggcacatagcatgatcagtccccagacccacattccccaagtaaagcccttggtagagtaatagctgggatgtttcaagaatttaattagtcccataaatctctaccaacgttttaaaaagcagataacaagctgggcacagtggcacatgcctatagtcccagctactcaggaagcagaaggattgcttgtatccaaaagttcaaagccagtagtgcaaactataattgtgcctgttcagaggcactgcagaccagcctgggcagcataagaccctgtctcgggccaagcgcggtggctcacgcctgtaatcccagcactttggaaggccaaggtgggcagatcatgaggtcaggagtttgagaccagtctgaccaacatggtgaaaccccatctctactaaaaatacaaaaattagccgggcatggtggcgggtgcctgtaatcccagctactcaggaggctgaggcaggagaatcgcttgaacctgggaggcagaggttgcagtgagctgaggtcacgccattgcacaccagcctgggcaacacagtgagagtctgtctcaaaaaaaaccacaaccctgtctctaaaaaagcaaacaaaatcccagcactttgggatgccgaggcaggcgaatcacgaggagatcgagaccatcctggctaacgcagtgaaaccccgtctctactaaacatacaaaaaattagtcaggcatggtggcaggcgcctgtaatctcagctactcgggaggctgaggcaggagaatggcacgaacccgggaggcggagcttgcagtgagccgagatcgcgccactgcactccagcctgggcgacagagcaagactccctctccaaaaaaaaaaaaaaaaaaaaaaattaataaatacaaacaagataaactggcattttttcacccttcttgggtttttttctttcttaattctctataatgtgtatgctactgaatgacaaagtagtcaaaaagtgttatcttcctaaaagttctagctgactaaaggaaaagtgtatttcttggcagttctagctgccaagaaaagtatatttattgagacagatgcactcattaagcacatgaactttggcatccaggcaaattctgggtgtgtacactacttccaccgcattttatctctgtgagttcggtattatctccattcatcctcataggtttatcccttagcttcctctttccaaaaagtaggcctaactatgagactaaataatacatgtaaagcatttgatacagagcctagtacataaaagtactgactaggcattagctgctatgattataatttcatgttattatcatatactctatcaggcactctattaagatttaacttccgggcaaatcaagaacttgttgctaagtacatttgtgctcagaaagtttccttcgttaagaaaaaatggcaaaaattactaaagaaaaggtgagaaaatatctactatgctgcagtaaagttgttcaacacttcaaagatcaatttaaacagtcacatcttgttacagatctcacctccatgaaatatcaccttgacttgttaaatcactgttacatgaattccaatgggcctgatttaccttaaaatctgcaatgattcaacaaagaaagtgtgagaaccaaatgggattatttgaagcatgaactaaaacattttgatatcaattgtaaagatggtcaaaatattaatagaatttgaattgtaggaaaggcaaaacaaattttaaagagaaaaaattaaaattaaaatgcaacattgttcatcttgctaccataatattttaaaacattataaatatcagagcagtgctcacatatttcctggtctgttaactgataggcattttcttatatacaaaaaaagttaagatcttaacataaaatgtaggcaagacatacatcttctggacataaaaaacattttagctaagtgaaaagtctatcaaaatttcacctagcttcctcctgagctctgaacataagtctgcaactttcacaaagacctttaaaacagctaacatttctgcaaacttcataaacaatttttaaaaatgtattaaacacatgaataacagaaatttaacatgatgaaaatataataggcaaaaagatttttatgtttaacacatcattgctaaaaaatgatgtgttaaataattctaatcataaaaatatgactacctgtcttttttttagatcaatgatttagactttactaatttggaattagagaagatttgggctgagtcagggtttatgtttctatcatccattcaaaaaggaagtttactcagtaaattcatatgatgaaaacattttcaggaaaaaaaatatttaacccattcaaaagaaactattttgtgaaatctaagaatgcccatttccatataaataaatctgagctttgtgtaaaactaattataaatctttttttcactattcactaaagcaggtgtacagaaatctaaccaaaaatgttcaaaattttaggtggtgtttgagctattatagatatttgaaaataatagaactacaatttaaaatatttataataaagacattttactaattccaactgatctttccccaccttccctccagatttaacattgttctgtagttaaggatgggaataggtgagaagaggctagttagaaagtcagagttgacagcttaagaattaatgagatcgcgccactgcactccagcctgggcgacagagcgagactccgtctcaaaaaaaaaaaaaaaaaaaaaaaaaaaaaaagaattaatgagtaatttttttcataaaccgggcatgaaactgttacatgcaattgggcagagagattatatttacattcgcctacaatcgtttttcttattcctaagaaaaatttaaatatgataagataggtcattttctccatttggtttgctccaaggaggttgttgatttctggcaaatagatcttaactattattatttcattagatagtaatttctaaaaattgagaattatttttcctcttcaaaccaactacatcttgcacaatgctctggatattgtaggagtcccacagaagttcatcaaattcaattgaaagactgaaattattcagtaatcttagattcttcaataccaaagcattaagataaaatcagacaagagcactgaattctgaactaattcaataaaagtcatcaattatgaagcactttcactaacacatggctacatatgggcacctaatttaaaaatggcttagttattaaaggacaaaaataacatgaatgtcacagaattttcaaaggagctttataatatgtgtaacttgctagaattggggttatcaaatttaatatgaacagctctcatcaaatttgaacttaatgaatgcagttgtgaaacaggcaaatccaatacactgcgaatagtctaactcttaattcattccacagatatgatttacccctaatagccagaagcatcacttctaatagctcacgttatggcagaatggattatgttgtattcattctacctcctggaaggaagctagtatccataatagtaccattcaactgtgtgttataaagcacaagccagcagaacttttataacataaaatgtgaagatatttaaaacataaatttagtaggttgtgacagatcagagacttctctctttccactgaagggatatatttttttattcagatctttcaaatcctggtaccgaagctcagctacaaacttacccagcactggaaaaacatgtcagcatctgtgctgtactttgagactcaactcactatttctataaacatgtatgtacacaggcaatagacgtctctacaaagagtaaatttattgttcacttaacaaggaggatgtgtcagcatttgaggatgttttggacacttacacttctttttctgagaggaatgtgtaccaagcagaagggctccagattgctaagagctcaagctctctttttaaatattccactcctgagaaaattccccatcagatataggcaatttctaaaagactttcaatctaaggatatttacatatatttctgaaaaaaaagaataattgcatattagcttgaaagaatgtatataagaattaaatcacaggataaaagtcacattgtcctgcaaagggcataggttttacggtcattcagacctccaagttcaaatctgaattctgttaaaaaccagctatgtgatcttggatgacttaatctatgtaagccttgattatctcatctataaaatgaagataaaagcaggactgttctaggagttggagtttatacacatacacatgcataaacatacacatacacacacacacacacacattccatatagtcaggtcattagcacaatgccagagagtaggcactttgcaaactggagcaataaatgcctagtaatgtggatacctctaagttgtataggcactatctgctcatgttctcaccacctcactacattatgggccattacagacaggaactatgtcatatccaattctgtaatcccaagatctaacacaacacatagcatataatagaaactaataaactgctacttatatttggtaattgcagttggctcctcctgtatgtgaatagattttatcaagtaaatcaaacataaaatgaagagtgttcattcttaacctattaaattttctccttctttaaacttacgtaggttacttggctatgataatgagctgttgtttttctacttaaaatttaaaattcttccattgttttgccatctttgggtttgtctgggtccctttccaaaatttaatttgctttgctattaaaaaaaaataaaaacagaactatgaatcctgaatactaggtgaatttcttgtttgattcaaaatgcaataatatttctgggtaaaaagttaaataacagttttgcctagaggcaatcttcttcatttactgtcctttgtgaaaaagtaaagaaattaaaatattttttacctgactctaaacccataggaaagtttcaatttagagtttgtactaattgcttaagctcctttccttttaaaaatgagattctaattttttaacaacttgtcaagattacagcagcctgtttgccacaaatcagatatttactttctccctctctcttctctaaactggttctccaatcccaatcaaaagtatacaagcagcacctgcaattccctcttcacaaagaatgttgaaaacagatagcacaagagaggttccacagcccttaacggttcagtgcagagctgcaaagcccttgcttcaatctacctcttccaaacaagaaaatcatgtaatcgaatcctcctccccacccattgcattcttttaaaatttttttttgttaatttcatataattgggccagtatacccagaggctcgaatattccctatacacatcatctcttagataatcaaatcagttagaatctgcagaacctttccattccccacacagggtccagaaacctgtattttcataagcactccaaatgatcctcatacaagaaatactgctccagcccttcacttggagaatatgcagcctaggcaggcagattttcttcatggcttctcatttgggtaaacaagctgagggttcctgtcatctgagtgatcccagggccaggatctgaatgacttgaggtttaatgggatcacaacatttccatttcattataactagtatttgggttaataaagcatttgtctcctggaatttgacctgcatcactataaattttaaaaattgtaacacacacatacacacatatgccaaggcaacttaaggaaaaacccaaagaaaagagataaaacaactctctttagtgacgaaaagcactgaagagtacccaaaagcacaacctacctgaaatccaactttcagctcaccctctctatcttaaacaagacgaaaatcagaacaaagaaaacagagtccaatgcaattaacaacaacagtgataataacaaaaacattttttctgtccttactaacactggcactctgtcaaatgagccacatatattatttaatcctcacaacaatattcctcatttcacagataagaaaccataagcagacagatatatgcgacatgcccaaggtcttctataataataagtggcagaggtggaactccaacttaagtgtgtctgacctctgagcccacaaattctaactactttgtcgtgctgacttccagcccatcagcttagattgggtggacagtggaaagaacaatgtgttctcatagtttcatgactgtaagttatccagaaacttctcccatgaaccaagacactgcactttgtacattaagtgtgacagtatctggaacacctcacatacctattgagggcctcatgttcttcttaccacagaaaagagataacaaaatgtaacctgagcacatccaaccttgaggcaaactatgacagtcacagtacctcatagtagtcacattagtgtggtaccatcttgaaaaatggagccatgaaagcaaaaatctcagaaagaaaagagcagtgagcaaactgcctcataatcaagtctaagtagatctattatttaaaaagtaactggcatatattcttcaagcaatattcacttaccccagagcaaagactttaagtttcagctttggaatcagttgctttttttaaagtcatcaaacctcctcaagataatcatcaatctctcatcagcaccctccactgcaagtacatcattacgattgttttcctttatctgcactaaatctctgtagctcatggaaagcctgtgttagagtagaccaagactgggcagtaggcagaaattcatggaaaaaaagaaatacacaagtccttaactttaagctctttctatcggaagttatacagagtgaaaaagagtagctggaaaggccatgtgatccctagtaaacatagtaaacattacacagaatcccatggaagctaggtcacaactggcgacaatgtgccactcatgctagaagcacaggttccctcacaggcccatggatcaatgttttccagggcagccccactatgcttgctggctgggttgctctgcatctccagggcagcatatgcctaggctatttactctctagtcaagtcatgttttgccaacaacaaagtcaaaactaatttatgtgcacccagaaatatattgcattgctcatataaattcaatattcaatcaagactatggagtggtaatcttaatctatttcagcttttctcaatctcagcactattgacatcttagactggttaattctttgatgtgaagggccatcctgtgcattttaagaggtttagtggcatccctggtctctattcattagacagtagcaaaccctgtccccaatcccacacttgtgacaaccaaaaaatgtctccagacattgccaaatgtccctgagacagcaaatctcttccagttgagaaacactgttctattttctcaattgtcccctatcaatggtcttgaaaggcaaatataatatttctacactacaatgtaactatttaaaagatatttcacaccccaggttactatcagcctcagtgattctgacttattctgtctaacttcaagtgctctgcccttctcattctggtgctgttacctgtacttcaaatgcccttgggtggagtatgaggggcccacttccagggccctgactgatttccatctctccatttccttttctgaacacctggggcccttgaacgccacccagctttagggtcacctccaattttgtctctcaagaactgatcttgatttggcaaggaggaatacgatcctcatattctggtagtcagtgtcaagttactcctgctgtttgtcattaaacccatccttgtgactcacttttgaaagccaggcatgtgccttgagctgcagacaaagtctccatttatcactccatgttgataatgtaagttgtgtttttttccctacactttcatcattggtctcatgctgtatgatcctctaggattaggaccctgaattattcttaccagtcccaactcagaatttgtgactgtctgcatgctgacagcaatgttaactcaatgttattttgtctggcccttggaattccaaatattaccttctttggaggtgaccatcactgagcttccacaatctgtcaacccttgctcattagaccttgctgcacctatatggtgccaatggccatattaggccactaccagctgccttctcaccaaccctgcggctctcatccttagcctgctggtctctttctttaaacctaacccctccctagtgcccatcccacccacacaactgaggggtttccaggtccagatcttggctcatgacattctagataccctggcgaagctatggcactcagacctgagtagatgctagaattcatgttcaattaattcttctagatagtttaccttaattttactcaagacttaagccagaatattgctttatctagtcagataatccaaaaaattgttgaggattagaaaatgtacagaaacaggatccccagtcctacttcacaatgaacctaacatttgaatacattatcctttttactctcacatattttctcaggaaatgaaagactttcacagttgtcacacctatcaaaacacttaattgcatcaatttctctacctcatctccttccttcttcatagctacagtgagcataaaatttaggtacagatacctcaaaaataaaaataaaaagaatgtaaaagtgttaaaatccattaataatttaatttcagcatctgtatggagaagaaatatgctcattgtggagagaactttataacaggttactgtttgcaatcctctgcctttatggagatctacatccaaaccagctcaggcacagaccaagactagactatggcaatacccaataattaaccattagcctggggcttcacaaaaataggacccactggagtgcagcaaatgctttcagagcttcccagaagctggtcaagaactcttaatactagttgacttgtctgtttttgtttttgtttttttttaagagaccgggtcttggtctgtcactcagcctggagtacagtggtgtgatcatagctcactacaacctggacttcccaggctcaagcaatcctcctgcctcagcctcccaagttataggtatgcaccaccatgcacacctaatatttttttaaaaattttgtagagatggggtctcactttgtcatccagcctggtctcaaactcctggcttcaagtgatcctctcacctcagcctcccaaagtcctgggattacaagcgtaagccaccatacccagcttatactaattgacttattttactagcatgcagttggttatggtaatatgagtgcacaagctagtgcatggactggggaaatacacaagctaaatgaggcactgtgacagcaagaaagagaagtcccaacgacacaagccagtttacacacaaagccaatttctcccagtgacaagtagtgcttttcaaattgcagatcataaccctgagtattgcaaagaatgacctattaaggttctctccctcaataaatgtactcaaattaattcagaaatttttttctttttatgaatatttgagaatgcactgtaagcaaatagtaagcataagaatgtttgatgaaatatttttccagataaattgatagatatatgatagatgattaataggcttgatagatgcatggatagatggatggatggattggatggatggatgggatggatggacggacagatggacggatggacagcgagacagattgattcaacaactatttattgagcatttaccatgtgccaagtacttctctagacacttggatacattagcgacaacagataaaaatccctgcatttatgatgtttagtagaacagacagcagagaaaaatatatttattagtgtaagtcatgatttaaaaaaaataaataaccatttgaaagccactgttgagagtaaggagatgccccatgcatctttccaccactccaaggagagaaccaaccaataatcatccttccacagtggaaaaccctagaggggtgaagtgaaagggacagtccaagtcattccccttctccctttcaagctggtctttaagattaagcatggcttcctgaagccaagctctctttgctctgttttgcatcttcccctttaattttgcctttttcctacagttctaataggtaagcctgttggaagggaaggaaaacagcaaacgaatgagctcttggtggatatttcctagtagtgtaacagatggagaggattcattttatccttaataaatagtcacttccaataatgggcaaaccattgaaattgtgatagcctattgtcttaagccagttaaactacacatctacctctgttgttactaaatctcttcagagatatcctaataagtattaactaatatccagtgtgatacctctcaaaataacttgcttatttaatttgtagcagctgtagctcacatttaggggtgtctagtataagcataagcccatcattgcaggctatgtgctttacctttaatcttcatgacgaccctgtgagggagaaatcattatctgcattttgtaaaagaagatactaaagcttacagaggttaaaaaatttgcccatgatcatttggctaagtggcagagctaaaattttaacaaaggccatgtagctccacaaaattactgatggtatccacattaagggcaaaggcttattatatatggaaaaaaattaaaaattattctcagaaaacttattttacaggcctatgcttccccttgtttgcttttaatcattctttaatatttaatggtcattaaaacactataaaccattaagtttagaactgaagagttaacacaagcactttttcttctctttgctgcaataggtataaatgtgtgagtgctaaaaatattttgatatctcttgcacaaaaccttttcaatacccataagtagagtaggagaataagaggacagattctgtccagaatatttcgcctcaactcccagcctcactgcttatttgctatgtggccttgagaagtctgtgcctcatttcctcatctgcaaaatgggaataatgatagcagatacaggattgttttgaggattaaaaggcatatacttggaacagtgtgggcactaaataaaactacatatttgttatgcttattattacttcttaagcagcactggctcatctcattccactagacattaaagtcataaagtttatcaagaagaaaaagaaaagaataagttctttaaacttgaagctcagtaggagcaaagagctatgtctattccatcatctgtcttttcaatcccccacgacttgtgttgctggtagggcacactggatgctattgctaaccagtgctgttttgggaaagcactacccttcataaattatttgaaaaggaaccattttgcttttatactgatctatgagatatcattgcttttcaaaacacaatcagcatatgtttatttactaaaaagaggtcaatgccacaggtttgcatgaaaaagaaaaatcatgaccattgttaaaagaaaatccaaaccaatttttcagcatagttctatatgttgttttaaacaactatttcaaatgttgctcaaatgaaaaggtcaagtatacatcaatataaaagaatataaaggttttcattatcttttagtctgttctcactgtcagtgaggcaagaacatgtttaaagtgcatctccccataatcaatttctttacttagaaatgtcattctgggtggacattttacagctgattaatttctgtccttctttctcatatgcaaatacaagactaaaatgcactctctggtagatttcctttctgcggttaaagtgctaatttcctacagatcggttatctacacagttctagcagaaaaaaatgatctttcaaactatgctcttatgtttctttaatatatgcatcttttccccaaaatatttgcattaagtcgacaaacatttgaacataaaaggtagaagacattgtcatggcttttgtcaaaaagtcaacatattaagtattgtgcacacacaaatgtactcaattaacattttaattaaggataacaaatagtaattaaacagatgacattttaattaatttctcaactgtaaacagcctgatgaaaattgttaaatctgattctagttaaatatctcttcttgcaaacatggtaagcccaaactaatcacgatcagaaacatttcccttttatgtacttacatagtcataatgtcattcgcaaataagtttttcaagttcctcagagttatgaaccacattctctttattatgtaggaagcaagtgatagcataattgtataataattgtttcaaggaacttctatatgtcttgtgaaaaagcacagtatactaaagtatttaatgtctttctacaattaaagattcatgcttcgctgttaaatccaaattaacaattttgtcaagcttagcaacccaattccataacatcaacttttcatattactgaacatctgtaatacctgtctctgattttgtaatacactaggggtagctaattgtgtcaaatggcattattaatttctcaaagcaaaattagatataattcatttatttttgaaaataaatatgggccattcaacactttgaagcagagtggcataataatgctgaaaatgatgcccaggatatttagtcagtgaattaacaagaaaacggaacaaaccctgctctgaggattactggatttagcaaaacagaacaaaaacgcaaataagtttgtcttttgttttctatattgcatgcaacatacttacaataaaagattattcactgtttatctgaaattcaagtttaattggcatcattttatctggcaaccctacttttaaaaaagcagtatctgtaagataaattcaccttgagaaacactttttttggtctctggtgcaaagtgggctatggcaaaatgggagcaatctggtggtagaggatgctctgggcctctctggggccctgagaggatactaagatgagccacagccagtattgagacagcatgtccaggagacaaatactctgtgtatttagtaagtcagatttgaagtttaaaaagttactgatctattttttaatctactctgctttgttttttaagtgtaatatagataggtctcatagggtagccagcctctctgttatattttccccttcagaatcattcagaaaaggcatgcagaccctaaggaaatacagcctacatcaggggcactctgtcgctgaagagagtgtaggagatacttgtggcattctatggtcccttgcatggcaatttctgaaaactgtggttcccagagctatggcttgaagagactcacaactgctctccacggcaaaagtgagcctcagaaaaaacagtgtgggggtctcatggctccaggagatagaggaacagggaaacaagggaaacccagggacaaacccaggaaaactcagagacaacaaattccaagttttggacatgtaagtgttttttcccaactgagaattctgaagaatatgagaaccaggacatatggtcttgaaattcctgttttaatctgcaagatcaaaacagaatattttagttcagttatccagatatttcacaaaagatgagtatcagctctagtaggacacagctaaggctactaatcccctccccttcacaaacatccctctgtttacctccacttactcaaaaatctcattaaaatttggtagtcattcatcttacagtaactctgtacaccacctcacctctgcagtcccatacctcttgagaggatcttccatgacctaaaagatgacccctgtcacctcttcaactcaaagaaaggatctccaacttaaaaagggggttgcttagggaaataaaaggggaacagaaactaatcacctaaaaccactgtctactcacagcgtaggaagctctttggtaggcattaggaaagcatctctccgtaagttagatggtatatttgtgtgtgctattattgctattgctatttaactgcaaatatgcaattatcacacctttagcatgaggttcagtagacatagaggcactagattcaacaatattgaatttacaaaagaatggtccaatgaatgaaagttgggcagccacagaaagcctcagagagctaatcaatgtttcccaagaagtctgaaccccaccaccaaaccaagcaaagctgaaagtaaacatgttccggccaaagtacagaaagtaaaaatgcttcctactgctgtggatgagggtcctctgacaggccccactgatagagagtgggaagctcaagtttaccttaaaggaccttgtttcctaatacatattgttaaaccctttcgtaatgctctctgcaagcttggctgggtacttctctgctaactactaataagctgcagttttctcttggtctctgctttgggcaaattccctcctatccccccactcaccttgcttcagctgtccctaaggcttaattccaccttctgccctgtacaagtatactaacttagtatatttctaatatcctctaatccacatttgccatatctttcaagctgggttcaaaacacctctttttagaagcttttcagaattaaccaatgtaactaatgcaacccaattttgctgttttctcctttcatctataatgcctgaatccttttacacttatatgtcaagactttaccatgtttttatgttgtttacccagagaaagaatattagagctttgtaaaattattgatgcctcaaatgcagctttaaaatgagttaaataaataaaaattagtatagaagagcacggtaagctttgttgtttgaaaagataacctatctactattgcccatcttcgaactcaactcttcaacacattaatgtggcccatccccttgccattgaaccagcatcatctggaaacttgttgaagatacagagtctcaggtcccaccttagacccactgaatcagattctgtattttaacaagatgcctccagtgatttgtagacatgataaagtttgagaagccttgaccttccccatactaggcatgaaatattctacaaggaatatctcttaaatgggtgcaacagagtcgattcaggtatctctacttctgcccaatccaatccaccaattagaaagcaacttttccactaaagaagtttaagggatcaattcatcaagaggacatggctattgtaaatatatatgcaccccacaccagagcacctaaatacataaagcaaataatggacacggggaaatagatagcaatacaatgatcataggggacttcaataccccactttcaacaatagatagatgaagcaaaaaaaaaaaataataaggaaatactggacttgaatagcacttttgaccaaatgggcctaggagacatagacaaaaatttctgtccaacagcagtataatacatgcacatttttcttcaacacacatagaacattctccaggatagaccatatgttaggccacgaaacaatcttaacaaatttaagaatactgtactcatatacagtattgtttcaggccacagtggtatgaaactagaaatcagtaacaggaagaatcttggaaaattcactaatatgtggaaattaaataacatgctcctaaacaaccaatgggtcaaagaagaaagcaaaaggaaaacttaaaaataacttaggacaaatgacaatgcaaacacagcatagtaatttttgtcaagggcaccaagggaaaacaatggagaaaggtgagtcttcaacaaatggtgcagggaaaactggatttccacatggaaaagaatgaaatcagacctttatcttacaccacacacaaaaatcaactctaaataaaagacctaaacataagaccagaaactataaaacttctagaagagaaggagcaacagctcatggacattggccttgatgactttttggatatcacatgaaaaggtcaggccacaaaaacaaaaataaatgagactacatcaaactaaaaagcttctgtacagcaaagaaaacaatcaacaaaatgaaatgacagcctatagattgggaaaaaaaatactgcaaactatatatctgataaggagttaatatctaaaatgtataaagaattcatatattaatagtagaaaacaaataactcaattttaaaaagacctcaatagacattctccaaagaagacataaaaatggccaatagatagatgaaaagatactcaataccattagtcataagagaaatgaaaatcaaaaccaccatgatataccacttcacacccattagaatggttattatcaaaaagtcagaagacaaccaatgtgggcaaaggtatggaaaaagggaactcatacactattgatgggaatgcagactggtatagccattatggaaaagaatatggaggtttctaaagaaatcaaaaatagagctaccatatgacctaacaatccctcttctgggcatatacccaagggaaataaaatcaccactttgtaaagacatctgcactcccatgttcattgcagcattattcccaacagccaagacagggaaacaacctaagtgtcagctaatggacagatggcttaagaaaccgtggtacaaatatacaatggaatattgttcagtcttaaaaagaacaagattctacttgccacgacatggatgggactagagggctaagtgaaataaggcagacacgggggaaaaaaatcacatgacctcacatgtggaatctaaaaaatcagagatagagaacaaaacagtggttatggggtcagggtgggggaatgaagaaatgtatgtcagaggatacaaaatagcaggtatgtagaatgaagaagtctagagatctaatgtacaacatgaaggtcataggtaataaaattgtactctatatgagattcatgctaaatgagtgctctcaccacaaaaacaaagggtaactatgtgagataatggatacattaatttgcttcactatagtaacctttttactatccacatgtatcccttaacatgttttataccttgaatatatacaatacaatttattttataaataaataaaattctatttcccttgcctcaatgaaacaggaaagaagacaggcatagaatggagggctcatatgaaagaaaaattctgcctcctggaaaacaattgctaatgaattggtatttgacagcagaggcattgcaatggcagggacttcaaaaggaggctggtcactgaaaccagtggctgttctcaagacagtggaacaggagcacatggacatgcaggagggctctgtagaagccaggagccaccagaacctgaccagaaaagaagacaaaggcatcaggctgtccaaagtcttaatggggaaaaactggaaatttaaatcaaagccctactggctctcttttgcactcagtgttggtggtgcccagtgctacactaagcactctacctacctcattgacaacgactataatagaccataagtgttattattcccattttgcagacgggacaactgaaaaaaacagaaagactgtaaaagtcacatcccaaacacaccacttaaagtgatggcatgggattcaaaatgaatcccactcccagttctgtcctcaacctctatgctctactgcctccttctgttcaaggagagtagagtctgtatgggtcttattacacagtgtgggcccaccattctcagctgacccttgggttggcttcataaagcccagaattagagaaaccctccagatgttagtacacacctgtatctgaagtaggtaagccctgcctcaaaaacaagattgctatcatggtgagtctatgaaatgctgtcttaagaaggttgttgtttttttgttttttgcagtttgtacccatcaggttttagcagaacaacaggttttagctatacacattgggttttagcagaaatgaagcactttccttccttggggaacaacatatgctggcatcgctaagtgtgtggctgcctggctccttggtacacaaggactctgtaggaggtcaggcctccttaggacagcactggagactctatactccaaaagtctctccacctggcctagagggtatgtttttagtcctcacaggttatgctattccagatccttctccagccttgacctccatagagaaaatcacatgacacacttcaataaactcaaccacctaagggttcttgtggttcttgaccatacagaccaaccacctccagcaaatctcccactagcaaaaagcaacttatctcttccatggatcttcctcggatttctaccatttcttatctaaggacctcttatttcttccaaagatctgtttgtgtcataaaagaaaaaacaccccaaaacccaattatggatggttgtgaaaagccatgtcaaattaaggggatcatcaacaacgttttctacagttcacataggaggcgatcgggatgctgttcagtcacgctgcaacatctgcctttcattatcattatcgtcctcacagagttcttgagcccctgagtttacggctttctactgggattttaagaaatacacagagatgtatcaaaagttgaacctgtgtatttacagagaatctcagagaaaaatctcttccgtatgataaaaggcctagggacttgtactttacagaatacaaatctaaagaagagatattatgtgccttgagagcttgttagaaagctagatgttacacttttcttctcttggaactactgaatgtagattatagtctatattctgaggttttgtaggtttctcttttgcattccaaagcctttaattctgtagattaaaaaaagaagttaatattagatgttcctagtcccctttaaagttacttacgatttctcacttgccaattgttgaattttcatgtttatttttagtgttgaaaatagggaaactgctatctgtccttcacttcctgccaccttagggaaaagtgaacaaagagtagagaaactacagagacagggaagacagcaagacagacagagtgggaaggggccagagcatatgttttaagtcattcaggcctagttcccatgtgagttttatcacttagtgagtaaacttgagcaagttcattaacctctttgaaactcattttcctcatttcaatcaccttgcaggagctggtctaagggtatatagcaatgcaggtaaagcacttggcacaatacagaaatccaaactatgacatacaggatgatggtggtggtggttaacaggcaaaagtggcaagacagggcagagaaggtgaaggtagcaaagtgagaaagaaatactagatatggttttccctaaaatccaaatataagcatgattgagagtatctatggcaaaggaaatattctaccaacctgattaacaacttcattctgctttgaaagacactcaacctggattgcaaattccatgagaatcagcagactagctaatctcatttcagtttatctccacagtaatcaataattgatcccaggggaaggtcagcctagtgtccttaggtgactcttcctttgccaatttgttttgagctctctttatacaagagtgtaggtattatgatacagagattatttctttaaattggagatgcatctgatgacacttggagaaaaccatctaaagatcaccaaaggaatttaccaaaaggtaaaaccatgaataaaaataattttcagacatgtttcataggactacagttcaactgttatatattacttatgttcttaatagtttggaaccacttgtcagtcaaaattaaatcataggcattccatttgtagaacaaattagtcaatcttatttgcatgaatcacaaaattcttacagctcttcattttcttaaagtatttaacaccctccccattttctcaacgtgaatatcagggtacattagtcacaagaccataacccaattacttaaagggcatattacataaatgattacacaacctgctgtgaaatactgtatctttagcatttggaccacttgggacattgagaggaaggattcattaatgaagtgtgaagctcatttttatttatagtccacaggaaaggcatatttcacagccatcagaagcacttctgcaggcaagaagttacagctaatccaagtgctataccaagctagtacaagtccaatcctggtgtccctggcagtcagaaatgttgtaaaggggaaaggaattttataaaaaaattgatagcacaaggagtatgagaatgtagaagatcaaatccagaccacagccgaaaccttgataggagggacacatgatgaattagcctataggctgaaaggtctggaggaagttgtgatggtatgggtcagatatcttccacttcctctgtgaagtagtagaaagtcattttttgagaaagcggaagtggggagagtggtgacttgaaagagtcactttgggatatggtagagcaagttaattgggaaatagcggataattaggcaatttgaagttggtgactatgaactttgagaagcatcaaatctctcaatccatttctgtcaatttaccctactactgaatgatttaattcattttgtgtcaccagcacctagcacagctcctggcacaaggtagatgctcatatttgactcaattagaaatggcaaatatctgaattgtctgaacacaaacagtaaatggtaaataaatactggccttcttttaggtttgcaaaacacaattgatttgatagtgaaggccaacatatacataaagaaaaaccagaggcctcgattttacattcaaggtaggtcactggtacacaggaagccagctgaggagaggtacaagtgaggggacgtgaggagcacgggtggtgagtatgagatggctgcccagtcacctctgctgaaaaccacctttgagagtagcaggattctagaaacaggatcaaaagaatcagtgtagcaccatatatcactgcctctgtaagaaaactgtgcttgtcaacctggagtttggggaaaagctttaaaggaaacctgtcattctgtactccagcttccaactttgcaaaaggcacttttccttggaactcaggcagaaaaataataaatcacgcctagctctcttgctcaggatccagtcccggttccccacctgtagttccctccagctgcttcctgctacttccattcctgcaccttatgctccagctattccaaagtacttcctggcttaaaacaccaagtgatgttgtaagtcccaagctttgtaagtgatgttctctctcactggagtcctttctctccccagccccttccattataaattcccactcctcctcctcagatgtctcttcttctacaaagcctgtcccgcccctttcacagagtaaagaagcccacccctactgtgtccctgaacgtggctttaggcatggaagaaactacatttaacctttgttccccataacttgaaaagcaactggcacatcatagattctcaatgcatgtctgttgaattgagttttactgttcatctaccttgcagacaaatggcatttcttagatatcaattctttttgatttcctttttccaacccatggactataactttttttttttaactaatttcaggaacacatacgatgtatgcactactggagtctgaataaaatttctaaaaagtagaaataatttaaatgaaaactgatttctttattctatcagtttttgaactcaaactgtctagaaacaagaaggttcatattgatttaaagatgtataaaatataacaaaagacatgcgggttatggaaataagactgttcattctccaaattcacaaatattagaattaaaggcacccctgaaagcctgaagaaggtggctgtagaataaataaaaggagtgccactttacacagcaggtggcaaacatgaaacgttttattgtaagaattggtacagacttgaaagtataagtacgttccaaggaggacttagctataatctaggatgatggttccagcatgtcactgggtggaaattagagctatttactttgtcagcagggcatgcccaccccacacttactcacgaagtgccacctgtatctttgccactgtagctggagcaccgagcaagatacatccagttggtctgatctaactcagcacagcatttctggtgcttttatactctctagaatcatagctatgttgtttggagaaatttattttcttgaaataggatgcagttctttctttgattcatccaacgtaactctcatcgatcttttaaaataaaatatcttccaaaatatttacttcattgaacaaatacatgagggaggtcaaagagatatattgcataccccacccatctgcatgctgaatgtctttctaaaccatcaacccttgagaagggaaaggctgagttaccaagtggactgaggtggatatgtggcaattggaaccatattgaaccatgcaggaaacaaaaagaaaagcacagaaagaacttatctggaactaaatagcaagttcggttcacaaaagttttattcacaagtttttccatgtgaagaccttaaaattccactcaataaacatgtttataaaataagcacacaaacagcctggaaacacatgttagcattatataagaagtagagaaagacaatgaaatcagtcctgtcctccttatgctaattttgatttaatgtctctagggacctgtgctcatggaagaaaatcaaggaacatcttaacatggaaaacaacagaaggctaaacttgtggctcagcacaggagagggtagtagaaaacctggaattgacgccctcttgaaggctgccaatgtttaataacccccagagcccattgttgtaagatgtggctaattctagcagtagttactcataaaagacaagggtataaatctggaaacctaagataaagactatgaagaaactctgaggagaaagagattggtcgtaagcaagcgtggaagaaaagtggcagccagtgtggaggaaggaggggcagtatgtgagtggataggctggggctatgcatatgagttgtgttctctttgctctgtacaacttcacttgccctcttaccactggggtggaagaatagcagcaccagcccaccttcgtagcagttatggggtatatttggggcagagctggaatctgggctgcattgggagaagattagcctacccctaaacggttcctccacctcactgtccctctccacagcccaaagcttaggacttgacaaccaagtagcaaactaagttgtaaaaagagagcaggctcagagcagaggcatagacagttttacctaagagcagagtttcttataaagaggcagcaaatgctaacctcaagtacaggctttggtgatatgaactctgtgtcctggggcactccatcaccctcctcttcttaaactcaccaggaatgacaaagactaggatctggctctggctcttcctctatatgactgatacctgaagcagacaaagtgggatagggttcaaggcagcagtcatgatgagaggcaatacactgaacaacttacacccaataaatcagaactaatgaaaacgagaaatcgagaagttaaaataagcaaaataaatgtcatcaaagagggaagagagattattgataacatgaagcaggaacaagaagttataaaaatctgaaaagaaaaacaatatatgaagaatataaagttgaaacaacttcctagatggaataaatagcagaatggatacaaccaaacaatgattgagagcagatgcagaaattatctcataaggtattggaaaagaaaaaagatataaagtgtaatagttaagatctgtggaatatacaagtgtccacatctttttaacaacagtctcagaggagaggataataaagcagttgaggaaataactcctgaaaatttctatgaattaaagaaaggggaaaaactatagattaaaggtctaacaaggaaaagaaggaagagaggaagggagagagggagggaaggaggggaaagaacaaggaaatgagaacaaataagaaagaggagaaagaaaaagaaagaaaagaggatggggagaagaaaggaggagagaagaggacaaaagaggacaggagagaagagagggaaaaaagaagtcaaatgtatagaaaagaatcaaggactaacagactacactgaaggttcttaacttgttttggtgccatgaatcactttggcaatctggtgaattctatggactcattctaaaatgaaaaaattttaaaaattgttattaattgcataacacaaaatacataagattataaataaaaccatttatgttgaaaaatagttaccaaaatattttttaaaaaacaaatttatgatatagtaataggtgttctcccttattaatgagaacacaacaagacttagtggatggtctaatactgtaattttgaagaaccacagccaacccattttatcatggatgaaaaaaatatacattgttgctgacacaaaaatgtaagttggttgtaactgcagcctaaccaagtattaatgataaacatagctacatggataaaagtagaaaacaaagcaagatttatagtacgataccactgataaaaattaaaaacacattcacacgcaaaacaataccacagacttaacaaggttacacacattatgtaaaacaattacatcaaagacaccaaagtgaatgctaagggagaaaagggaattggagcagtgatcagagaagatgaaagagaaagaaaataagacaagaagaaggctttgcaccaatcagtgatggcaatgtgctctaaactaaggataatgattaacataactctcagtacctaagatctaattaaaacaaacaaccccatcaaagatgggtggaggctgaaagtcagacattattggcatttgagagaatagaaaaaaaattacaagatagcaactaaagattttatacaagtaaacccagactttgtcagctctaatagtcctaaaattgctgttttcagagatgtccttaccccacctcaagagagtacaccattgagaccaggtcaggcataaaagcctgtcagcctagagaggacatggaatagctctcagaactgtcctaatctgaaaggccagccacaaattgtcttttccagttcagacaaaggacatcctcaccgtccactctcttgtcagtggagacagaaaaaaactcaggaatccaatggttgtccagacatttgggtgaagacatgacattccatttgtcttcaatcattactgccgctataataaaaataccttagtctgggtaatttataaacaacagaaagttatttctcacagtttcaaaggcagggacgtccaagatcaaggcaccagtacattcagtgtctcgtgagggcttgattgtgcttcaaagatggcaccttgctaatgtgtcaccacatggtggaaaaggagcaagggagcctcttttataagggcactaatcttatccatgacagtggagccctcatgacttaatcacttcccaaaggccccgcctcttaatactatttcatcaggtattaggttctaacatgtgaattcgtagggggacacaaacattcagaccatcacaccatctataccaaaaaaaaaaaaggctgaatatgctctcctggtctttttactgccccctagctgtaggtggtagcaataaacaactggttgttttcattctgtttctctatctgcctcaccacctctagaagggccctaacttaagttggagtgacagcatacaaaactctccaagcaagtcctcttggtcccccaatatgccatgaagcatgctccccaggagaaagcctgtatggaaattacgctgatgcattcctccttgcattcaggtttggtaagagcaggctgtgtgcaagtggttacagctgctcagtggaccaggctgtggaaaacaaaaacgaaggctttgatttcatctctcccgggtattctccacatcacttttgttgtgtgcgaactaataataacagatctgatctacatacagttcttcttgtctaaaattactcatttaaattaagcattttagtcactgtttgataataagatgcaaggtaaagtacttgtgagcacagaaaattaatagaaaggaaacactgagcgtatgttgagtttagccaccagcatctatttttaaagatgacctaattaattgttacatagaatgtcaggagaaaagaaacactggcaaagcttttagacaaggcaactactaactttaaaagtatggcactgctgaaacagctgtataaaagcttgcagcatgatttcaacacagttgtcaagcatgctggaataaatacatggcaataaaaagccatgtaaatttctgggagaaaaaaaaaatgacaggactgaaagttgaactttaaaaaaattgtaatttttaaattgtgtgtatctccttaagataatcctcatttagtaaatcatatttacagtcattttgccacaggcttttcttccctagctatacatgtatacagcaccatgaagctttacactgtttttcataagagttacggttatttaaatggcaaataaaccaaagacaaagacttggtttttattaaattacagcatcctaaaatttaaacaaaataatccaaatgctgaattcctccctgaaaaactgacataaattgcaataaaacatgctcgcaaaactgaagcatcctactttattttcacaaataaaaggtgattctgaaaattgacttcacttctaaagtaggaaagcaaaactaaagaataaatactgtaatggaatgtaaaagaatatgtttaatagagaggttttataaaagcattgcctaagcataagaaaactagaaaatggtattttaaagactattaacatacatctctttcaagaaaacactaatctaataccacataaaaggagaggtagcatatatacacctacttagattaaaccccagccaccaatatacactctgaggtctttataacccctccttgcaaaaaaggagggtgtttgattagtgagtttaccaaattcacattaactgggagtggaaacctgccaacgggacttgcagggttgaaggatagaagaaactcactcatgtcatgtccctctatccaaatttaataagataaacaaaaactagcaaataaaaattaaaacaaaaactcaccaacaaatagcaaacaaagaaaaagccacaagccaaggccattacctcagaaaataatgggtgaggaaaaacaaagaagattccagagcagagcagggcggcctgtgtaagggtgtaaggaggctccatcacgcgcgcgcacacacacacacacacacccctcacaagttacacagcagagctgcaaaatcctgcaccctcacatcaataatggatctggaaagaggcgaacttagtagggtgggcctttttcccttttctggggagctgtggaagggatgctagggagaaaaaagcagttttctggcaaaagagaagcctctaggctacaggatgaattgagggaggatcagaagcaagtggggacgcctccagggatagaggtcacccccctccccccgcccttaggtgaacatttagcattacctctctcagaggtgagaatccagactaactcctgcacccacctcgactgagctctctggctcccagcctattcccaggaaacagaaaagtggatcaaacaccaaaaagcagagcctgagtggtcttttcttagtagaaacaagagttctcagattagaagagaaagacagtcaaggacgatggttatttctggatgatgggattagaggtcattctttttactttcttctctgtactgttccgagttgcttaaacattctttatcatacacttaaaatttttacttacaacaaaaacaattttaattgaaagaagaaacgcgactatacaaatttttaagaaccatgaacctgaggtaggaaaacaacaaactacataatgttcctgtcttcacaagataaatcccacctgtgtggccctttgatctttgagagaagagcaaagaaggaaaagaggagggaaacatcaagatttagaaaaaacaagatgcacaaaagaggaagctgatctgtgagatagggaggtccaggctctactggaacagctggagagatagaatctttcttccagtcctagattttccctcccatttccagcctatactcctacaaattgattcttccatcatccaatcaccaccaaaccctgacactcagtctcagtcagctctagctagggaagcaattgcagggggctgatgtgagaattgcattactttagtgcatgtgtgtccatgcatacacttatgtgtgcgcatgcatgtgtacagtagagctgctgaagcaaaagacttattccaaacatgaacgatgatatctgaaagaaaatataccttctttacttgaatgcactttttctaccaaaaaaactattaaataactaatttctataagacatgaataaagacaactataatgacaaacaagattcaaagggtaccctagaacttaaagtataataaaaatatatgtataaaaaaagatttaaagggtgcatcagcagaaacacacactattctgtcactgtttaccctatttcagtggatttaaggatcactgattatacgatgtacccttattttatgtgctactatgagagaaaaaaaattatcaggtaaattataactcagtacttcctcatcacatcaactgcaagacacatgctgatcacagggatgttagagtgaacacaatggaatattactcattgctcacacacctgtcaagatgtgtgatccttgatgggtcctttaactcttctggttatacaatgttgaactatatagcatttgtaagatcctcttatgttctgaaaattctgtgcttccaggtctgtggttttctcccagaactaagatattttggagccctggggccttccaggccacaaagaacaggagctacaggtgggatctgtggtttggaaagactaagaggctccaagcctttggggcagccccttcctcagctctaacaagaaggcaccagtgaaaagacagctttcctccctcagccaccgcctctctctcacccatacctccgttcagggctttttcccacttattcctatttcttggttcctcttttcccaggccagaagagaaagcagcagaaaggaagatcccaggcctttttcttccatctaatcaagacttcaggatggctttcttgcagtcagggaatggttgcctgggtaaccaagtattaactataaggatctccccttctctctttttgctagactaaccattctggtttctccctcctgtctgagtagggagttaatagtaaaaggatttatttaactaggctctggattttataacccttgctggcttccaacagcgaactccaaactgccttttactggaggcttgtcttaaatgaaccagaactactttttctcatctattattttaaacctaattggaacacagcaaagcgaaacaagtttgaaaggcagtcagagtagcttccctatgccatgatttatcaatgtctgaggctagcatattaaaatatagctcttgttttgtaccatcaagattggatgaaaataagaatgcctttagaagggaaagggctttcttaaccaaaatatctaactctactccttatcactgttcacagagtagattattgtatttagttatgtggatgatgggtggggcccaaagaaatagatccggggtctggggtacagtgtggtaaatgcaagcctgaaaagatatcttcagaagaaggtgtgtaacagagggataggggttgtagtaggctgttcttgtattgctataaagagatatctgagactgggtaatttacaaagaaaagaggtttaattggctctcagttctgcaggctgtacagggagcatagacctggcatctgtttctggtgaggcctcaggaagcttatcaggcaggggccataacagcctgcccttctctctggcttcttgttgagtttaatcagtgcaaaggacttgccagggatgagaaagtaggaaagacaaattgagttacgtataacaccctctttccctgctgggttggcagtgactgtttctctgctgaaggccacagctcctgcctggcagaactctcctacaaatacaacctccatgggtttcagcagcttcttcaagcctaggtggtagggggttccccctgtaactagggcatgggtgcttcaccatcccatgttgaattcccttaattccttttataaataaatccttccataaccactttcttcagaattatttatccatgtataagaatgatactgtgattattttttcaagtgggctttaccttttagagatacatcctgaagtatttagggacaaagtgatatttaaatgaagcgtgtttggtcatgatttgataaccgtcaaagctaagagatcatgatttggtaatcatcaaagtaaaagcgttcagggtctttataattttccctctacttttgcacatgtttaaaatttttccatcataaagaaattttttaatgataaaaaaaatgtttaagcacccctttgggagatgctgtttcccatagggacctggactgacacaggagcagaggaggaatgagcagagaatatcagcaagatgaatgatatagtttggataattgtccctacccaaacctcatgttgaattgtaatccccaatgttggaagtgaggcctggcaggaggtgattagatctggaactgaatttctcatgaacggtttagcaccatccccttggcactgtcctcaggatagtgagtgagttcttgtgagatccgatcatttaaaggggtatagtaactcccccctcactctcttgctcctgctctggccatgcgatgtgcctgctccccctttgccttccacaatgtttgtaagtttcctgaagcctccccagaagctgagcagatgccagcatcatgcttcttgtacagcctgcagaaccatgagccaattaaacctcttttctttataaattacccagagtcaggtatctctttatagcagtgcaagaacgactaatacaataacaatggcctacttcataattttgcctggagttagccctaaaagtaaaggctgcaagtgatgtgtttgtggtcctttctgaactgggactagacagtaaaatctcaataattcactgtaattaggaaaacaattcaatctgactcagcaaagatctgtattataaactatttcttaaattcttttgaaacttgaacaatgtattcattcagtttggactggccttcacacacacagactttggagagttccaatcttatttctcagcacaccttgttggaaatctttataaaaacctctttcatagccatcgtaggcagcttttcctcacactatcatagagtacctggccctctctccacttcaaaacactcatctcaaaatttagcttgtttcacctctcctttaaagtctgtcttaaccatattggcccaaaaggaactcttcttagaaattattatctcacctccaccaatccctaggtgaccttgggcaagttacttaacctctcagacctcagttttatcatctgcaaaatgggactaataacagtacttatttattagaatttatatcagtattgaatgagtctgagattggctaatactaggcattcagtcaacgttaggtactatattaccatttattcagcaaatattccactatatacctggttttttctaagtcctgaggatgtaacggtgaaaaacataaagcccctgccctcatggagcttcctttctagcaggagaggcagataataaacatgtaaacagatatatatatatatatatatatatatatatatatatatatatatatatatattcaggtttcaactagtgctaaatgctatggcaaaactaaaatgagtaaaaatgatggaaaatatgatttttggtacagtggactgggatgccctttctaaaagggtgacattttgatgataaaacacatattgaaattagtttttaagctcattttactgcctaaaaagccctcttaaatatatatcaaaagctttcaaatatttgggaatgatatattttccaactcagtagccatgataatccagaatcccaacctgggttggcagactcatcggtggacaagttcacatcgtaaaccttcagcatgcattccaaacctgccttttcctttcattttaaatgttatcttcctcatgttgtcttcctaatactgacctaatttttcaaacatggtgctttgtcaccgcaacttcttcacactgttgacagagtcttctcttgctgccttttcacaaaggtggccttttactttcttcacctttgtttcctaagaaattgcccacagcctgccttacacctttaaactggtttcatgccactgttcagctgttttccttttatatcagagtcactgtcactgaattattccacctctttactccctcttctttattctctttgctgccatatatagccaaagtgaaaggagatcccaaaagaagctgctaactttggggaggtgtgtttttggtactggtaggagtgggggaatcagagaaatctgggcatgggagagttgaagcaacatgatccaagagctctgacatcagttttctgacaatttcaaaatctgtgaataaaataaggatgtgtgttataaagtatcaggagaatcaggaagataaataggatgctttttcgcaagggaaaagaatttctactaatgaaaatcatcaccaatgactcctttgtaattgggttaatggaatgattttaaaacacacacccacctctagctatataaaataatacaggatactttaatcctgagatcctggacttttcccactgtgaagcaataaatataaataaatatcttggcttaacattcctctttacctcctgcttcttctctctggtgattttttttccttcttctttatgcacaaggccccagatcactcaagattagaaaacataaaaggctcagaaattaaattcttaagattaaggaattcacttaagccacataaatttagagcctttctttgccagccaggaactcagcaactcagattaataaacctcgtttctgaagttgtgataaatgaaggccatacaaaatcagccaggttttcagcttgttgcagggtccacatgagtgctgggatggagccatcaaccaaagattggctcatgcacaaaacattccaggagccaggaaaggcggcgatgggactgaacacaaagctctttagtatgtgcaacaattaatgttttaaatattaaaacaaattaatatgagagagaatgttgctttcttataacaaaaactcaatctcatctcacaagttaaaatattacagagaagaaaagatacctgaaaatgctagctttttgcactctcacatccttatggagtcctcttatgaaaatatcctggattgttctagtttaaatttttttaaaggatctgaatatttgttcttaaataacttgtttaaactagtattggtcaccttcaagtgccctctggtgtaacttattttaatcttccagacaatactttaccctgatcaaaggaaaggattctttttttgctccttttgtgtttggattaaaaattatgatctgcaagcatgagttgaattaaattgaaagtttcttcactaagagtaggaaatcactaactctaaaacatccttttaaaatctgggcatagaaggtttagagtctggcttcccagtgtggctgaaggtggaaagtgggggcaatctgcaggcaaaaaggaggcaccctgtctgtagagaatttacaaacataacaaacactttatacaagtaataaagttttaataatgaaactgaccaaaaaccagtctgctccttatcatcatgtacatgccaacaattctaactaatataagtgataaaatgctgttccctccccaccaaaattttgttgtataagttctaacaattgttgtggttactgttgggttttaataatatatatgcaaactttaaattagcacgtttttactgctcatccttttatacaggcatacgttttattgcactttacagatattccatttttcacaaatttaaggtctgtggcaacctttcatcaaacaagtctatcgctgtcatttttccagcagcatgtactcacttgtgtctctgtgtcgcattttgatcatccttgcaatgtttcaaactttttcattattattatatcctttatcgggatctgtgatcagtgacttttgatggaattattataattgttttggggtaccacgaactgtgcccatataaaatggcaaatttaatcaataagttttgtgtgtgtcatcactgctccactgatcagccattcctccatctccctccttcttctcagacctttccttcctattccctcagacacaagattaaaattaggccaattagtaaccatacaatggcttctaagtgttcaagtgaaaggaagcctctcactataaatcaaaacctagacttcatgaaagacctaaaaccatgaaaaccctagaagaaaacctaggcaacaccatttaggacataggcatgggcaaagacttcatgactaaaacacaaaagcaatggcaacaaaagccaaaattgacaaatgggatctaatgaaactaaagagcttctgcacagcaaaagaaactatcatcagagtgaaaaggcaacctacagaatggcagaaaatttttgcaatctatccatctgacaaatggctaatatccagaatctacaaagaacttaaataaatttacaagaaaaaaacagccccatcaaaaagtgggcaaaggatatgaacagacacttctcaaaagaagacatttatgcagaaaacaaacatattttaaaaagctcttcatcactggtcattagagaaatgcaaatcaaaaccacaatgagataccatctcacgctaggtagaatggtgatcactaaaaagtcaggaaacacatcctagagaggatgtggagaaatacgaatgcttttacactgttggtgggagtgtaaattagttcaacattgtggaagtcagtgtggtcattccttaaggatctagaagtagaaataccatttgacccagcaatcccattactgggtatatactcaaaggattataaatctttctactataaagacacattcacatgcacacatatgtttattgcagcactgttcacaatagcaaagacttggaaccaacccaaatgcccatcaatgatagactggataaagaaaatgtgacacatatacaccatggaatactatagagccataaaaaagtgtgagatcatgtcttttgcagggacatggatgaagctggagaccatcattctcagcaaactaacacaacagaaaaccaaacactgcatgttctcacacataagtgggagttgaaccatgagaacacatggacacaggaaggggaacatcacacacgggggcctgtcgggtgggggctgaggggccaggggagggatagcattaggagaaatacctaatgtagatgacgggttgatgggcgcagcaaaccaccatggcacatgtatacctatgtaacaaacctgcacgttctgcacatgtactgcagaaactataaaaaaaaaaaaaacctctaacttttaataaaatgttttatttatttctatgtggaataaaaatcaaaaataagccaggaaaaaaaaaagctagaaatgaggaagcttaatgaggaaggcaaataaaaagctgagactggccgaaagctaggcctcttgcactaaacagccaagtcgtgaatatgaagaaaaaattcttaaggaaataaaagtgctacccagtgaatatatgaatgataagaaagtgaaacagcattattgctgatatggagaaggttagagtggactggacagaagatcaaaccagccaacacattcccttaagccaaagcctaatctacagcaagatcttaactctcttcaattctatgatggctgagaaaggtgaggagccagcagaactaaagtttgaagcagaggctggttgatgaggtttaaggaaagaaactatctccaaaacataaaagtgcaaggggaagcagcaagggctgatgtagaagctgcagcaagttatccagaagatccaactaagatcattgatgaaggcagctacactaaacagattttcagtgtagctgaaacagccttctattggaagaagattccatccaggattaactagagaggaaagctcaatgcttggcttcaaagtttcaaaaggcaagctgattctcttattaagggctaatgtggctggtaactttaagttgaagccaatgctcattgactgttttgaaaatcctagggcccttaagaatgatgttaaatctacattgcctgtgctttataaatgcaataacaaagtctgaacaacagaacatctgtttacagcatgatttactgaaaattttaagcccactgttgagacctactgctcaggaaaacagattcctttcaaaatattattgttcgtagacaatgtaactggtcacccaggagctctgaaggagatatacaaggagataactgtgattttcatgcctgctaacacaatatccattctgtagcccatggatcaaggaataatttcaattttcaagtcttattgttaagaaatatattttgtaaggctatacctaccatagatagtgacttctctaatgaatctgggcaaaatatgtagaaaaccttctggaaaagatttaccattctagatgacattaaaaacatttgtgattcatggaacagacagttctcaaaagaagatatacaaacggccaacaaacatgaaaaaatgccccacccacatcactaatgatcagggaaatgcaaatcaaaaccataatgtgacaccaacttactcctgcaagaatcgccatactcaaaaaatgaaaaaataatagatgttggcatggatgtggtgaaaagggaacacttttacactgctggtggaaatgtaaactactaaaaccactatggaaaataatgtggaaattccttaaagaactaaatgtagagctaccatttgatccagcaatcccactactgagtacctacccacaggaaaagaagtcattacataaaaaagatgctttcacatgcatgtatacagcagcacaatttgcagttgcaaaaacatggaaccagcccaaatccccatcaatcaatgagtgcataaattgtgatacacacacacataccatggaataccactcagccataaacatgaagaaaataatggcatttggaccaacctgaatgggactggagaccagtagtctaagtgaagttaagtcaggaatggaaaaccaaacattgtatgttctcacttataagtgggagctaagctatgagaacgcaaaggcataagaatgatacaacggactttggggactcaggggaaagggtgggagaagggtgagggataaaaaccacccactgggtacagtgtacactgctcgggtgatgggtgcaccaaaatttcagaaatcaccactaaagaacttattcatgtaaccaaacaccatctattcccccaaaaacatattgaaataaaaaaaatgaattaaaaaaaccattcgtgactcaggagatcaaaatatcaacattaacaggagtttggaagaagttgattccaaccttcatggacaacttggagaggttcaaaactttggtggagtactgcagatgtgatgcaaatagcaagagaactagaattagaggtagagccttaagtatgactgaattgctgcaatctcatgataaaacttgaacagatgagaagtcgcttcttatggatgagcaaagaaagtggtttcttgagatagaatctattcctggtgaaaatactgtgatcattattgaaatgacaacaaaggatttagaaaatgacataaacttaatttataaagcagcagcagggtttgagaggatggactctaatttttgaaggaagttctaacgtggataaaatgttgtcaaacagcaaagcatgctacagagaaatattttatgaaagagttaattgatggggcaaacgtcattgttgccttattttaagaaattgccacagccatcccaaccttaagcaaccacgaccctgattagtcagtagccatcaacatcaagtcaagactcactgaagccttagatgatcattagcattttttagcaataaatttttaattaaggtatgtacattactttttagacataatgccattgcacatttaatagactataatatagtgtaaacataacttttatataaactggaaacaaaaaattttgtgtaattcactttattgcaatattcactgcattgtgatcatctggaaccaaacccacaacatccccaaggtatgcctgtatatattataatctacaagtaagctaattcagagaaatcccagttatacagctgactccagacacatgcagtcttggacacacacatatgtgttccataagcaagtttgtgaaggtttgggaatcattccagctcacttcgaaaaaacttatgatactccatattctgacatttaaacagaagattcaaaataaataattataggatattacttgcaaaaaaaaaagaaacaagtaaattcatcattccacatgattaatggaatttttgtttttaaaaatgtaaagtgacgaaatgaagtacagaatgtgagatgtagtatttttattggtaagtgtaaactttatacatgattttgctaaactttaataatatctttaaaattgatatttcttttgttattcttgtgattatttaataaactttaatattatttattactgtcataaaccaataattggttctttccctttgtgcaaaaatttatactaatgtaattaaaattaccaatccattacttttttccttttatgtacataacattttttatgtttctttactttttaaaagcataattatatatatgaagtccagtaaaaaatttccacaatttggctgggtgtggtggctcacacttgtaatcccaggcctttgggaggccgaggcaggtggatcatttgaggtcaggagttcaagaccagcctgaccaacatgatgaaaccccatctgtactaaaaatacaaaaaaaattagccaggtgtggtggcacatggctgtagtcccagctactcaggaggctgaggcaggagaatcacctgagcccaggaggtggaggttgcagtgagccgagatcatgccattagcactccaggctgggtgacagtgcgagactccgtctcaaaaaaaaaaaaaaatccacaatttgtatttcctttatggccattattatgcatattatatattattcatataaaataatttttaagataattttgtcacctaaaggaaggaggattaaaacgttatgtgctctgagtgcaaacatgctttgtaccaacatgctttctggagttttctcagattctttgactttcttactttttgtctcatacaagcttgcatcaaaattgtgagctggcttaagatggtggattataggaaaactagaagaaaacacttcctagaaaggaatagaagacaagtaactaacatgcatttattcgcccctttattcattcaacaaataactattaaccatctaccaccataccaagcactggtctaggcaccaggaatattatttcatgccgtctggaaggttgccttttaatagaaaaacacagacaaataacaaacataatgaacaagtaaattatgtaatatgttagaatgcagtaagagctatagaaaaaaataatgaattcagcatgataaacgagtgccaggacattggagttttaatagggtagctattggttattgggaaggtatcttttgatcaaagacttgaataagttgagaattagccatgtggacatctagggaaagtgtattctgggcagagaaaaccaaccagagcaaaggtcatggggaaggggcatgcctggatcgttccaggaaaagcaagaaggacacgaagcagagagtgaaagggaaagaaaggagtagtagatgaaattagagaggtcaggaggatcagattgtacagagctttcttaaacctttaaaacgactttgtcttttactctgggtgaaacagggaaccactgcagggctttaagcagaggaatgacatgatacaactcatgatgtttaaaacagtggccttagtataagtgggttgactaccttaaaagccctccaatcttcctggagcgatatggggtggcccacctaagacatctgtccccattcatcaccaagattgatccgtctgatctgactgactaggagtaccattcttccctgccttcttgccttgcatcgtcctaaaggcgcacacctggtcaaccctttcagatttaggagaggcattcttcaggtaagggtctagaggtgctacctgatgctaaaactttgaccatttgagattatttttcacctactatcttcaagactcttctgtaaaactataaattgctcttgaattcttaacctatgaaaactgactttttgatataaattaaattagcccttaaccgacaattaagcagataactgacaggtgggaatgaacaccagaaacattcacagcaacacacacacgcacccctagacctcaatatttagatattcatcatacatacattttctatccacaattgactacaatgctaatagttctcaaacgtacacaagatgtacgtaatgtcctgtccatttgtttccctctttcactgtcataactgaacagggattattggaggatatagtgaaaagaagggcaaactcagatgttgtgcatggcagccatgctaggaagtaggaaaagtagaggcaagaagacccctggagaaagatttgtctgcctaaagtttgaaccaaagccagcttctacctcaggccaacccattctctgaacagaaggaaaggatgcttcctgaggtactgacctggcctatgaactttaccctcaggagagctgaccaaaggatgtctcctggtagcctaattggtcctcttggtcctcaaattctcttttttaaaaactattacattcattctacctatgcgttttttcaataaattgtattaatatttcttagtcacaatagaaggcttttaacttctcaattatttttcagtctcttccaagggtagtactatcagaagcaagatgaaaagcatcaaggtgggtaccaatttttacccacacttagcaccaaaagttgaatttgaagctaggattgggcaaatacaagaatgactatttcctaaccatgtataaaaagctgtttcaaagttttctctgatgttcataaacatcaagtatcttaccagtaatcacagttctaagctggtaattttccagtacgtaggcttccatacttctgaagcctacatgtgaatgcttatattacaggtgcttctttcccttaaggtagtcacttatgggaacagcttatggacaaacagggagcttttgtgttgagtgtaatagatcagcctctctttcataaatgacagcttctacccagattagttttataaggagatggcaactccctatttgatataattttacatgcactagaaagttttccttgactccatcactcatgaagcttacccacctaatgaaaaaaatgtctaatgataaaattagacagcatgcaagaacagatgactaatgtaaccaaaactatgaaaagtcttagaatctaaaggagatgctagagatcaaacactaacagaactgaatatgccttttatggactcctcagtagactgaacatggctataaaaagaatcagtgagcttgaagatatgtcaatataaacttcaagaactaaaatgcaaaaagaaaaaactatagtggaaaaaacagaagaatatattaaagaactgtgggacaatttcaaaaagtgtaacatacataatttgaataccagaaaaagaagaaaaagtggagcagaagaaatacttgaaagtaatgacaaacacaaaaccacagatccatgaggttcagagaaaagcaggataaacacttaaactacttgtaggcatagcatatgcaaactgcagaaaaccaactacaaagagaaaaccttagaagaagccagaaggaacaaacactttacctatagaaaaacaagtttaagaattacagcagacttctcatcagtaccatgcaagcaagaagagaatgaaatgaaatatttaaagtgttgaaagtcaaaaatcaccaacctggaaattctatatctagcaaaattgttcttcaaaagtaaaagagaaggacttccttcatgcaaaaaataataataactaccctgagggaattcattaccagaagacctgtaatgcagaaattttttaaaaaacattatttaaggggaatgaaaatgatataggtcagaaactcaaatctatgtaaaggaaaatcaatacagaaggaataaatggagatacaatcatctgataactgtttacttaaaataataatagtaacaatgtattggttgattatagaatatgaataagtgaaatgaatgacagcaatgtcataacagataggagggagaaatgagggatactgttatgagtaagaacctgaagtgcagatgcaatggtagagtgttattagaagctggatatagacaagttaaaaatttatattgcaaactctagaccactattaaaaaaatttttaagaaatgtaattgctaggaaaggagataaaataaaatcacatgaagtgctcaattaaaaacagacaaggcaggaaaatactggaacaaaaaaagaaacaaatgcaattattataaaacagatatgaacatggtagatatttatacaactataccaataatcactttaaatgttaattgtttaaaaacacaaggtaaacaaaaaggttgtcagagtagattgaaaaaacaaggtccaaatatatgttgcctaccagaaactaaatattaaaaactcaagtgggatcatcatggcagacaggaggcaggactagattacagctccagagacagcaacgtacagaagctcacactgtgaattttagctccagaacgactgcaattacaaaccaaaaatcccaagaggacccacagaccctctgaaggaagtggactgctcctgcaggacctgggagacaccccaaatactgtgagtgccctaactgcagaaatgggaaaaggagactctcctctcacagggctccatgcagacaacccccagtaccagtccagaccctcaatggagaagctgaaggtctgtttgtgggagaagtttccaactttacctggagctgagtcaatttagagaaccaagtgaaatacaggggagaggaagcagcagaaaggccttgggagcttgctgtgtaccctagcagcccattcctgcctggcaccacagggatccattgggagggtgaccagaggagcaggggataaactccacaggaggaagaaaatctctagctgaactttgtaacaatttgaagggtgggaagcctcctgctcagaagtcacgggagggtgcaaatctggtgtgcagactccacaggcaggggaaaaaccaagcccttttctttcgcagctgggaggtgggtagcccagtgcaagttttctagcctgtcacaccctccgccaggaaacagactcggggctactgggggtgggggcacagtgggagtgagaccttcagtttatgtgggatctggatgaggtctgtgactgctggctttcccccatttccctgacaacctgcatgactcaggagaggcagccataatcctcctaggtacacaactccagtgacctggaaatctcaaccccatcctccacatcagctgcagcaagacctgcccaaagtgagtctgagctcagacatgtctagccctgcctgcacttgatggtccttccctatccaccctggaaacagaagacaaagggcatataatcttgggagttctagggcactgcccactgccaggccctctccatactactacagctgatgctttctggaaagtgtcacctcctggcaggaggccaaccagcacaaaaatagagcattaaaccaccaaagctaagaaccctcacagaatccattgaacacccctgccacctccacctgaacaagcactggtatccatggctgagagacccatagatggttcacatcacagggctctgtgcagacaacccccagtaccagtccagagctgggcagtctcacggggtggctagactcagaagagagacaacaatcactgcagtttggctctcaggaagccacatccacaggaaaatagggagggtactacaccaagggaacacctgtgggacaaaagaatctgaacaacagcattcagccctagatcttccctctgacagaggccacccaaatgagaaggaaccagaaaaccaaccctggtaatatgacaatacaacgctcttcaacacccacaaaaaaatcacactagttcaccagcaatggatccaaaccaagaataaatccctgatttacctgaaaaagaactcaggagtttagttattaatctaatcagggaaggaccagagaaaggtgaagcccaatgccaggaaatccaaaaaataatgcaagaactgaagggaaaattattcaaggaagtagatagcttaaagaaaaagcaatcaaaaattcaggaaactttagacacacttttagaaatgtggaatgctctggaaagtctcagcaatataattgagcaagtagaagaaagaaactcagagctcaaagacaaggtcttcaaattaacccaatccaaaaaagacaaagaaaaagaataagaaaatatgaataaagcctccaagaagtctgggattatgttaaacaaccaaacctaagaataattggtgttcctgaggaagaatagaattctaaaaccttggaaaacatatttgggggaataatcgaggaaaatttccttggccttgctagagacctacacatccacacacaagaagtacatagaacacctggaaaattcatcacaaaaagatctttgcctaggcacattgtcatgaggttatccaaagttaagaggaaggaaagaaacttaagagctgtgagacagaagcaccaggtaacctgtaaagaaaaacctatcagattaacagcagatttctctggagaaaccctacaagctagaagggattcagtctcctcaaacaaaacaattatcagccaagaattttgtatccagcaaaactaagcatcatatacgaaggaaagatactgttgttttcagacaaacaaatgctgagagaattcacctattaccaagccaccactacaagaactgctaaagggagctctaaatcttgaaacaaatcctggaaacacatcaaaacagaaactctttaaagcataaatcacacaggacctataaaacaaaaatacatgttaagaagcaaaacaaaaagcaaaaaaatcaaagcatacaggcaataaagagcaagatgaatgcaacagtacctcacatatcaatactacattgaatgtaaatggcctaaatgttccacttaaaagatacagaaccacggaatggataagaactcaccaatcatctgctgccttcaggagactcacctaccacatacagactcacataaacttaaaagggtagaaaaaggcatttcatgcaaatggacaccaaaagcgagcaggatagctactcttatatcagacaaaacaaactttaaagcaacagcagctaaaagagacaaagagggacatcacataatggtaaaaggccttgtcccacagaaaaatatcacaatcctaaacatatatgcacctaacactggagctcccaaatatataaaacaattactaatagacctaagaaatgagatagcaacacaataatagtggagacttcaatactccactgacagcactagacaggttatcaagacagaaagacaacaaagaaacaatggatttaaactataccttggaacaaatagacctaacagatatatagagaacgtttcatccaacaaccgcaaaatacacgttctatttaatagcacatggaactttctccaagatagaccatatgacaggccataaaatgagcctcaataagtttaagaaagttgaaattatatcaagcactctctcagaacacagtggaataaaactggaaatcaactccaaaaggaaccttcagaaccatgcaaatgcatggaaattaaataacctgttcctgaatgagcattgggtcaaaaacaaaatcaagatggaaattaaaaaattattcaaactgaatgacaataatgatacaacctatcaaaacctctgggataaagcaaaggcggtgctaagaggaaagttcataaccctaagcacctatatcaaaaagattgaaagagcacaaactgatattctaaggtcacacctcaaggagcaagagaaacaagcgcaaaccaaacccaaacccagcagaagaaaggaagttatcatgaaagatcagagcagaactaaatgaaattgaaacaaacaaacaaaaaagataaatgaaacaaaaagctggttatttaaaaagataaataaaattgatagaccatcagcaagattaaccaagaaaagaagagagaaaatccaaataacctcactaagaaacaagacaggagatattacaactgacaccactgaaatacaaaagatcattcaaggctactatgacgcatttacgcacatagctagaaaacctagaagagatggataaattattgtaaagatacaacccttctagcttaaatcagtaagaattagataccctgaacagaccaataacaagcagtgagattgaaatggtaatttttaaattaccaacacaaaaagtccgggaccagacggattcacagcagaattctaccagacatccaaaaaagaattgttaccaatccttttgacactattccacaagacagagaaagaaggactcctccttaattcatcttctgaagccagcatcaccctaataccaaaatcagaaaaggacctaaccaaaaaagaaaactacagaccgatatccttgaagaacattgatgctaaaatccttaacaaaatactagctaaccgaatccaacaacataccaaaaagataacccaccatgatcaagtgagtttcataccagggatgcagggatggtttaacatatgcaagtcaataaacacaccacataaacagaattaaaaacaaaaatcacatgttcatctcaatagatgcagaaaaagcattcgacaaaatccagcattgctttatgattaaaactctcagcaaaattagcatacaagggacataccttaatgtaataaaagccatctatgacaaaaccatagccaacataatactaaatggggaaaagttgaaagcattcactctaagaactggaacaagacaaggatgcccactcttaccactcctcttcaacatagtactggaagtcctagtcagagcaattagacaagaaaaagaaataaatggcatccaaatcagtaaagagaaagtcaaactgtcactgtttgctgatgatatgatcatttaccttgaaaaccctaagaactccttcagaaatctcctagaactgataaaagaattcagcaaagtttccacatacaagattaatgtatgaaaatcagtagctcttctatacaccaacagcaagcaagcagagaatcaaatcaagaacccaaccccttttacaatagctgcaaaaaagaaataaaatacttaggaatacacctaaccaaggggtcaaaagacctctacaaggaaaactacaaaacactgttgaaagaaatcatagatgacacaaacaaatggaaacacatccatgctcatgggatgggtagaatcaataatgtgaaaatgaccatactgccaaaagcaatctatacattcaacacattccccatcaaaataccaccatcattcttcacagaattagaaaaacattctaaaattcatatggaaccaaaaaaagagcccaaatagccaaagcaagactaagcaaaaagaatacatctggaggcatcacactacctgatttcaaactatactataaggccatagtcacccaaacagcatggtactggtataaaaataggcacatagaccagtgaaacaggatagagaacccagaaagaaacccaaatacttacagccaactgatcttcaacaaagtaaacaaaaacatcaagtgggaaaggacacccttttcaacaaatgatgctggataattggctagccacatggaggagaatgaaactggatcctcatctctcacgttatacaaaaatcaactcaagacggattaaggactgaaacctaaaacctgaaactataaaaattctagatgataacattggaaaaacccttctagacattggcttaggcaaggatttcatgaccaagaacccaaaagcaaatgcaataaaaacaaagataaatagctaggacctaattaaactaaagagcttttgcatggcaaaagaaactgtcagcagagtaaacagacaacccacaaagggggagaaaatcttcacaatctatacatctgacaaaggactaatatccaaaatctacaatgaactcaaacaaatcaataagaaaaaaacaaacaatcccatcaaaaagtgggctaaggacataaatagacaattctcaaaaaaagatatacaaatggccaacaaacacattaaaaaatgctcaacatcactaatgatcaggaaaatgcaaaccaaaaccacaatgtgatatcatcttacttctgcaggaatggccataatcaaaaaatcaaaaacagtagatgtcagcatggatgcagtgaacagggaacacttctacactgctagtgggaatataaattagtatagccgccatggaaaatagtgtggagattccttaaagaatttaaagtagaactactatttgacccagcaatcccactactgggtatctagccagaagaaaggaagccattattcgaaaaagatacttgcacatgcatgtttataatggcacaatccacaatagcgaaattgtggaaccaacccaaatacccacaaatcaatgagtagataaagaaagtgtggtgtgtgtgtgtgtgtgtgtgtgtgtgtgtgtgtgtgtgtgtgtgtgtgtatagacagatatatgatggaatactatgcagccataaaaatggataaattaacagcacttgcagtcacttagatgagattggagacgattattctaaatgaagtaactcaagaatggaaaaccaaacaccatatgttctaactaatatgtcagagctaagctatgaggacaaaaaggcataagaatgatacaatggactttggggacttggggggaagagtgggagggggactagggataaaagtctacaaatatagtgcagtgtatactgctcgggtgatggatgaaccaaaatctcacaaatcaccactaaagaacttactcatgtaaccaaataccacctgtactccaataacttatggaaaaattaaaataaataaataaaagctcaaatatgttaaaagtaaagggatagagcacatatcattctaatgctgaccaaaaggaagctggaataactatattaattttagacaaattaaacttcaggaaaaatacttaaataaaggcattgcagaaggtagacaagtatccacaaagacataataatccttaacatgtatgcacatcttctaaagctcacatggaatactaaccaagatagaacattatggatcaaaaaacacattaacaaatttaaaagaatagaaatcatactaagtatgttttcagatcacaacagaactaaactatagatcaaaatcagaaagacaactggaaaatagaaaaaaatgaagattaaacaacacacttctaaataacacatggaatcaaagcggaagtctcaagagaaactgaaaatattctgaacaaaaatgaaaacatagcaccaaaatttgtggtattcagtaaagtagatctaaaggaaaattatggcactaaatgcatatgttagaaaagaagaaagacataaaatcaatagtctaaactttctctaaaaaaaaactagagaaaaagaacaatttggaagcctgtaacaaaaagaaacacaataaaagtcagaatataaatcaataaaattttaaacagcaaacaatagacaaaaatcaatgaaatcaaaagcagctctttgaaaagctcaataaaatttataaacctctagttaggctaaccaagaaaaagagaagacacaaattactaatatcagaaatgaaagaaagatcatcactactgatcacatggacattaaaaggataataaagaaatagtacaaacaactctctgcccacaaattagataaagtgaaccaattcttcaaagacacaactaccaaaagtcacaaaaggaaaagtagataatctgaagaggaccatatctaccaatgaaattgaatcaataattaacaaccatcaaaacaaaagcaccaggctcaaatggcttcactggtgaattctaccaaaaatttaaggaaaaaatgatacaatttccactatctcttacaggaaatagaaataattcctaactcattctatgagtccagaattaccctaacaccaggagcaaataagaatattacaagaaaggaaaactatagatcaatatctatcatgaagataaatgtaaaaatcctcaacatattagcaaatcaaatacaacaatatataaaaataattatacatcatgaccaagtgagatttattctagctaggcaaggctgttttaatatttaaaaaccaatgaatgtaattcaccacattaacaggctaagggaaaaaaaagcaatattacattacttggtacagaaaaggcatttgacaaaatcctatatccgtgtataataaaaattatcagcaaactaggaatgcagggaaagttcttcaacttgataaagaacagctacaaaacacttccttacttaatagtgagaaaccagtaactctctaagatcatgaacaaggcaaggatgtcccctctcaacagtcctagttaacatcatactggaagtcctaattaaatacataagacaagaaaaggaaataaaaggtatacagattggggaggacaaaattaaattgtctttattcacaattttctctgtgcaaaatcccaaaggataggggaaaagttcctggaattaatgagtgagtatagcaaggtcactatagaagaatagaaggttaatatacaaaagtcaattgctcttctatataccaaaaatgaccaatttgtatttgaaatgagagaaaatacatttgcaatggcaccccaaaaatgaaatacttaggtataaagtctcagaaaatatgtataagatctataagaggaaaactacaaaactgataaacaaaatctaaataaatggagggatattccattttcaaggataggaagactcaatattgttaagatgtcagttcttcccaacttggtctataaattcaaagcaatccaaatcaaaatcccagcaagctattttataaattacctgattctaaagtttatccatttaagttttaaacctagaataatcaacagaatacagtaaagtaagcttgaacgacacataataggcaatttcaaaacttactataaaggcacaataatcaaggcaatgtcgtattagcaaaagaatagacatatattactagataaatggaacagaatactgagctcagaaatagacccaaacaaatataatcaactgctctttgacacagaagcaatggcaattcaatggaaaaagagagtattttcaacaaatgccatgggaatatttggatgtttatatgcaaaaataagaaaaataacttagacataggccttatacctttaacaaaaattaactccaaacagaccataaactaaaatataaaatgcaaaagtataaaatttctagaagaaaacataggagaaaatttaggtcaccttgagtttgacaacgaatttttagatacaacaccaaagcataatctacgaaaaaaaattggtaagttggattttatgaaaaagttcattccttacccaaatgaccacccatgtactgggctcagccaagttcatcagctcaggtgtcaatattgtttaagagaacttgttgcatttgggagattaagaaggaagagatccaggatccctggcaatgtagtatccaagaaataggtgatcccagcaagaatctatgtatacaatttggtgtgagtaatctttcacttggccacaaaaaattttacccacttaatcatctgaataaatttctatctctcatcctctttctcattaagtatgcattactatctatttcactagggtattttgtgacttaatagtgtgcactgatttgagccttaacaggggaaagagctaaacaaaattctttatgtatgtatttgtactatggagaatacagaatcatgataaatatgcaataacagtataaaacaaaaagagctttaggacagacagatgaaggaggtgatgtggagaacagagacacagacattgtataaaccacggctaaagagataactagggcagatatccaggcaagaaaaaccagttagatcagttgtaaatcaaatatatttaactattaatgtcttggtggggtgaggggaaaatgaccttatattttgattagacatggatacatatgaatgttcaaaccaagacttgtagcaggtattgctagatattatccattgcctcttcagataacactttctaccttgtgtccaatctgccccagcagtctggcctttatggtctacattaagggatcccttcactctggcgtcccaggaaggccaagtggcaggagagcagaaggcaggaagagagtgaagcaagagtatttatcttttgaactccctcccttctgtgctgtggtggatgatggctgggttccttccccaagttcctagcagatagcctctcccagctgccttctgctcttgcaccacccctcattagcttttcttgaccttgcccacatctttgaaactgttccttagtttatttctcttcatctgttacctacctaaactcttactgataaaagcataaaacgtgtacaaagagaatatgaaatgtattaatttgctgatgagagcttttcagttgtaatgcaagagatcttatgggaaaaatagtgtaaataggatgcacctgctctgtggagcctactctgaaccccagaagttggttatgccttctttgttctccttgccctttacacatagcacatcattattgtgggactgtggtggacatgaaagaacttagtcaaagggacctcatgtgggaagtgtttcatgaggtgagggatctgagaaataaaggaatccctaaagttctggcagttggagttatatgaactcagtcacctgaggttggcttccacagttgtgaacaaccaagagacagcaagtgctgcacaattcagtgaggcccctcttaccttcaatgcatccatctcctcagacagtgagagcaagatacacatctgtagatctcctactctagttgagaatacacaataagaacatagtgtttattaatgagcccagaactgccttcttcctagtggtattccctgacaaagacaagtacaagctgtttaaaagaacatcgtttaatatcaaaacatctaggttatgataaccccaacactacacaccctgagacattatatgtatatgtatatgctttttatccccagtgccaaaacaaaactattttgagagaggatttacttttttaaagaattctcatgtcaaagcaagcaggagtggttttttaacatctaaattgaaataagaactgcatgtctgtctgcatagtttaagtgagtctccaatccctgaagtcagaacattaaattcagggtttttcatacaaatagcaaacaggagttcacccagataatctccgaagctaccagctaagaggccataactggcactaactcctttgtcacatacgcgcatttggtgttctcagctctcctcttaatcactaactcctggctctttctctgcatgatttttgggcatgtccctccatcacggcctctgctgtgtcaggtctaccattatagaccttggagcccatggttcctgttctcacttccttgactcctttcatctttccacccaagaataatttttctccaatacaatatctttatatcatcttcctgttcaccaggttcaaatgactgaatgtactcagacctgttttctcatctgtaaaaatgatactacaatggggctgaaagaatcaaaggtctcttttatctctgatctcattattcctccaccgaactcatttgatctcatgtaacaatcttttttgtggttggccccttgctgtcagccactcttcacacattcatctaacaaaatttactgagtgcctgcaatggaagaacacaagtgctaggttctagaaataaaattaaaaattcctttctttgacatgcaatagcagttatcatttctgagcacttctacatggagtatttcaggagggctcattgtatcctcacaataaacttatgacagaagcattattgataactccactttatagatgagaaaactgaaacacaggttaatacatggcccaagtcatataactagtaagtgactgagccaaatgtcattggttctaaatgattatgcctctgaaataattacagtgaaaagttcttaaagacattaataaaatactgaacaggaagatcttagctttgctgcagtttctaggatgaagggctacttgagctccaagaagctttccacccctaccccatgccgatgccatgccccatctggagcactcatcacatagtctcagccaagtcatttccatctcaagcattgtgcaaaagacaaacactcaccttgaaaaaaaccatcttcaatgaatggactgccatctgtgctttattattttgtacataagattgttactttgtacatatactacatttgacataattttttttaacttgttctcatgccatgcttaatctccccaaccaatctatcaagaacacctccagccaagcctggtatagtgcttatcaaatagcaagcaaagcttgttaataaatcaagcaattcactttgtccagggagtcaaatccaaaccctccagacaagtttgatgacattcactaaccttgacctggcagagcctcccccatcaatccaccagggctgagttgacaacaattctcctccaatcagttctccacactcctatccctgtgacttttatcttgtattaaacgatcacataaacactgagcctccaaagcagtgaaaggaacttttattttctcatggtttccatctcccagcttcttctattgtatcgtaaatccaaaactgccataaaagttagaagcttcagaagtgtcttttataggaatttggattgtagtcaaacatctaccctcagtgttctctttccagtgtggcatttcctccctaccacctaatacaagtatacacagtatggtaggaagacctgcagacctaagcaggtttgagctatttttccatcactcatcattacaaatgtgtttgtgttttcactgtggggtattcttaaaccctgctgctggtgatgctttctgtaaacagtaattctcaagtgccttattgtgaatacaatgagtcatctccagtgcagagaagtggctttatttaggactggccagagggggatgggcatcattatattcagtttgatagaggatctgcagaattctctcattgccctgtacagcaggtccagtttctttttcgttctcctgatagaaggactgtacgcctaaatattcagcacatatccccaaattgatgttttacctaaattgtttcttaattggctcaaattaagtgcattttgcaaatcctccctcagtctagtctgtggcctaatgactgtctgacataggaagcactaaatgtttagttaatatttgctgaacaattaaaaaaaggaaaaaatagaaacaaaggaaaggaggtaaaactgataactgtgggtgaaaagaagtcaaggtcaaagcctgcatctctgtctggttcatgaacaactgagccttacagggttaaaactattctgtgacccccaggagccaatcagtcccctcaaatttatactgttaggagaaccttttgaaagaaagcaaccagcttacagcaactcatccccactgctggaaaaatacaagtcaacatattttgacctctgatggtagagccgcaaaactaatgtatcagatatctacttccataatagtactgcataacaaagagccacaaaaacctcagtagcattcagcaataagcatgtattgtttatgcctgggccagctgagggctggctagatggctctgctaatcttggccagacttgttcacgtctgcagtcagctggcagttagctgatatcagctggccttggctggggaaacagggattcctctgccctgttccacgtatctctcatcctctagagcaggctatgcagacatgttgtcatggtgatggaagagaagcttgccactagaaatacacaagggctcttgaggtctaagctcagagctggtataccctcatctctacctcattctagtagccaaagcaagccacacagcagagcccaggaacagagaattgttaatatgtcctgcctttggagttcgagaccagcctgaccaacatggtgaaaccccatctctactaaaaatacaaaagttagccaggtgtggtggcacacacctgtagtcccagctactcaggatgctgagacaggagaattgcttgaaccctggaggcagaggttgcagtgagccgggatcgtgccattgcactccagcctgggcgacagagcgagactcggtcttaaaaaaaaaaaaaaatgtcctgccctcagtggaaatgaactgtaaagttaaatggcaaaggaagtggtacagggagagatggagaattaagaccagtgatgcagtctaccccaggtatatttacataaaaataaaaagcagagtattatgaatttatgaattgcaaagatggaacccatgcatatttatagattctgaagtaaccaaactaaaagacagtgcttattttttctaataaatatctagctcagacattatttttttaactcattcttattgtcattataattagttaaatattagcttgaggtaaaaaaaatcatgctgtgaatgaattgatttctttcttctatgggtattctttagtcaaatggtctggtaaaacacttttatgagctactaaaagctttgaacgtttatgtaagtctatgacaacagtacatttttccaatttttacagaggagaattaaaatatcctatctgatataacaaggattatgaatagattaaaaaattatttcagtattttaaatttaatactctcatttaacaggtttgacaaaatgaaaagtattagattctgattcctagatttgtatttctcatctgattcaattatgtaagcttatattttagaaatgccaactcctttacatcagggccaagactaaataactctgcaatatcagaagaagcgtcacattgaaagaatgctgaaatgaaattacatttcatctctacaaaagtcagagtctctatttctgggttcaatgcatttgacagtttaactacctacattgtttttatcatataaaaaaggagagtgttttaatttcaatcccttaaccttctagcaatgaaatagttccagagaatataatgaatataaaaggggtcagtgttcaaattatattcatttatagctaattggaaagtttcttttgttgctgaagaccaggacctttttcctgtctatctgctagtgactatcactctgatgccttaatcttcaagtggacattctcttcattcagtgcaattatagtaacctgaaaggtaatgtagtctcataagagatatgccatcatcacacagatttatgggcagaaccacatccataaaatttagaaaattgcttgtgtactaccagcctattttgcctgttaatataaataatattttcaacattagctaccaagaggacaaatttctcataactgactttctgcttaattctgtcagataatctctgctgtaatatgatgaagaatatactgtgaagaatttctgacaagcttcgtttttctagggtgttttgctgaagaggcccaatctgttgtttatttggggctggtaccgcattaaattgatttagggacaccattttccatttttctatcttccatgctctgttaacttatgtcatatttattacaactcttggttttgcatgtatgtttcaatttgtggtagcaaactgatgaaacacgtttctccccttttttgtaaaatggtgtttaacaactgctactcctattaatgtattgccaccttataagtaaactcaacatgaagagatctacacaatattctgattaagaaattctacctggggcacagaatatatgtgaaataccttttcaaataaaaacttggaggaagtaaacagagcaaatgcataaaagaagaacatatgttttatgctaccaaattatgcatcattattttgaatagctaaccaaagtttgttacagatactaaagcttcgtttaaattttagtccatttgcagtttgtcattgttgtttaaaattcctcaggcaggggtgtgagtggaggaagttacttctctagggagatgaactctaaaatcttgtttctgggagatactgcaatttgtggtctcagattctagactattccaaagaaagctctctgagctcctgtgtgttaatttatgacatatctgctctcacccgataggtttgtgctttatcacgagtctcagggagcccatcagggctcacaaaggaaagaagtctgagacacataaaaaatatatgactccaagccagggagcactttacgttgtacacagcaaaggaacccctggtaccactgaacatgaaggtcatgttctacgcaagtacaaggactgggctgccatccttacattcttcatgttattaaaacaaaatgtctaatcatgcctgaagctgcccaaagccttgttggcgaagagatatcaagctggaacacagcaagtccacaccttctgctttcacccactcccactttctgtatgcacactctgaccctgctctggccagactgacctatttatccccttcccctaaaggtatctcatgtttcccaccttcaagcctctccacacctatattttactcatcttttaaggtccaatttcttagagtactccaaatccaaagtcagtgcgatctccagagagaaacaatacttttaatttctctactgtccatatagctaccataagacttatgtaagtattcactgtttccctaatagattacacattttctaaggataaaaccatatttgaatgtccagttatgctcctaagtggctaacattgagccttactcaaagtaaatgcataacacaaatttgtttttatgcttttaatacatgttggtatttttaatatttttcttctcgacaaaagaacacaacatcatcatacatacaaccttcaaacataaatgagaatgtaaaagccataacctccatcaatgtccaatcaaagtgctggtcaatggaagagagagtttacaccattgacccaagcatatgtttcaggctgtggtgaagcttgaaattttcatatcatttatttgctggatgacccaattaggtcaaaacctacttttctttattggaatgaatcccctagcaggtaggtcaactccgcaggacaaagcttctaagcaaatgtgaggtcggttaattctcatatcaactctaatttgcagcaagactcccatggcatttcaagaggctttgagtctttctgaggcttaaagagtgaggtagtagcttcttttgagcaattggtaatactttgggtcaagaacggtagctatggaacatatcctaataatcaccttctcaaatgttacagagtcttgcaagtgacagaaaaagatggaaaaaaatactctcacagtttaggaaactgctttcataagctttggcatctctaaaacttagattccagcccatccaaagagctctttctgcagtatctgttttcaggaaacattttcatcattgatccaagcatcagaaaacaaaaacaaacataaaaatacaacataagatcccaaaagcatcagcattcaatcactgtcattacatgaattatacttgaagcatgagcaagacacatgaggccctatctcaaagatgagccacccctactggtgatagagggcacccagagagaagcaagaccctcatttaccaccagctgacccacaggctctgagctcctccaatgactgagtccaaagatgtagcttcccctcactctttcaaaactagtcctatgttttcaataactagcttttctctgcctcagcatcctcgagtatacaacaaaacagtagaggatgatagaaaaatgtgggctttagagttggagtccaacaaaccaaggttatgatcttggataacttcatcaatctctcttagctttagtttcttcatctgtaaaataagaacaatgtttgcaggactgcggcgtaaataagctaatacacaggtgagagtaaatgttagctattatcattatgagtactgttattatcagggtgtcagattaggttatcttctaaatatccattctacttccaaggcttataaaatagagtttgaataaagcccccattcaacctttaataaccctaaagattaatttgctccttctgcataataatgaaaggacaaggtaccttgcggatcctagggcatatctgttcaagcaccaaatactttttaaaattaagaaaataaataatacttggaaaatggccccattccaacaaaacccttaatgtttaatccgtaagaagtcatctgaactctcatttaactagctttcctgatggactgattgtatgggggacatggaaaatgtgaataccaagtaatgagactgattttggcaagacatcagagaaatcagcctaaattactccttagtcacacttacataggaaaatcattttaagagactttatatcaaaaggattaataaataccagtcaagtcatgttttccagggacttccaggtcacatggtgatttacaaacaggtgtctaaatcccccttcccccaccccagattccaggtgaaatatcaagtagaatattaaaacgtgaaaataaagtttcatgttgacttctctagttttgtcgggctatttatagggatcaaatagtgatcttattatagatcactcccacagcaacttggtccttgcccatttctctttgccatccttcccacaatgggtgcttcaactttcattccactcattgtatctgatacatatgtacaaattctgtcagttaaaaataaatttttaaaaattttaaatgtactatctattctttaaaattagtttatcctctattactattttaatgtagatatagagagaaaaacatacctacacatgcttacaccatttaattttatatgtagttttctttatggaacatgggatcagtcattcaaaacaaataattttgtcatcttcaaaaattccagagtctagatattgttatgactacctggacgggggaaaatcttaactaatcattaagttaaaaattagctaataattattagagctcagaatgaacaaaactagttaagccgcataccttacagaattctaccttgtcaagtcaggccttttagattcagcaaccctaattatccatttcagacctgttgaattacttaaagtactcaatgtggccagttctatcccctccggacctatgcactttcacctccctctcctgtcaacttagaagggccttccccaccattttcccaggaacacttcctactcttccttccagacttaactcaggtgattcctctgggcctcctttatgagcctatccagaaaaatgaggtgctcttccctctgctcccaccaaaccctgagcatctctcttcacagcattcctgccactgttttggggctacttgtgtacttgcctatccacccccttccgcaaaatgcctggtttttatctttaaaggtaggtatttgtttttccttatacatctttgtcttccccgacacccaaatacagcctggtgtaaactaccagcatttaataaatattgaataaataaatgaatggatggaaaataaacaaaaagcttaagtctctctctacattattataacctcttagtgaaggatatatgaaatgacatcacctacaagtattaatggcaaaataaaaacatagataatgagcactttaatgtgctttcattaatttatttatgaagaaataatgtgacattcaagtttggggggattcctataccctaatatctaccattattaaataatagttttcagtctctgtctacatagtcattatataacaagaacacatgcccagctgggcacagtggctcatgcctataatcccagtacttggggaggttgaggcagggcagattacttgaggtcaggagttcaagaccagtctggccaacatggtgaaacttcatctctactaaaaatataaaaattagccaggtgtggtttgcatgcctgtagtcccagctacttggaggctaaggtgggagaatcacttgaacccaggaggcagaggttgcagtgagccaagatcacaccactgcactccagcctgggcaacagagcaagactccatctcaaaaacaaacaaacaaacaaaaaaaaaaacaagcaaaaaaccacacatgcccctaccagccaagtatcctttagataacatattattctgcacatgcttccacattgttacacttccctcataattatctctagtcttgccaaataacctgttaatttattcataatttaaaggcaataaagcagagccttgagcaaggctgcctgagtttaaatctggactctctcactttgcaagtgtttgatcttggataagtcacttaacttctctgtgcctcagtttcctcatcctgtaacatagagatgataataagagtgctatcatatggttttggtgaagactaaatgagctaatacatttaaagtgatgataagaggtggttttgttttgagactgggtctcactatgttgcccaggctggtctcaaacctgttggtctcaaacttcgggctcaagcaatcatcccatctcagcctctcaagcagctgggattacagggaggccatcttgaagagttcttgatacatggtacaaacgctctaactattagctatatatttttattgtaattctgaattcactaatattggtctaggttgtttctatattatttgcatcacactagcacatttaagcatatggatttgaggatggtttcttgggtagttggttttgtttcaaattctcaagatttctaactaatttccaaaagggcttctaatctactttttaaatgctcatgtaaaaattacttaattttatatgtgtaaactactttttaagaagatacttcacaaaatctcgacaacctacacagatagacaattgtcaaagaagttggaaggggccaacattttagtttgtacttgaagcttttcatctcagaggagttgctaagttactatctctatgcacatcctagcaagagggagagggttgtgaccaaagaaacaatacttttttcctactgtgcttcacaactcaaaattcattgattcgtatgtatattttgttttgttttgttgtgactaaacaatcctagtttctttcatctctttcaatgaaaggaaacatgtctgtcaaaaaaaaaaagggggaacagcaaagggaaaacatccctcagagaaaggagtgaacaatataaaggtaaacaaaccagggatttctttgatattgcccatttgtttgtgagaacaaagtaacaaacactgaaggagaaccaagtatagattaggcataaggtaaaagggagaacattattcttcattgttcttatctcagaggcatctactactaaatgatgtggggcacagaaagtgggcaaaggaaacactcatactctataaacttacctcctctgggtgataatacatgtacacccagtgccgtttctttagcaaaacgtatttgaaatgcaaaccccaaatcatgttcatactctatgtcttttgctttctagatgtggaatcaaaaaaaaaaggaccttttggtttatctaggcctaatgaggttgtctttgattcttgattatcaaatagttcatttgtttaaccaatattcatacttttgtatttttgatataattgtacaaatttggggaatacatgtgatattttgatacatgtatataatgtataatgatcaaatcatggtaattgggatatccatcacctcatttatctgtgttgggaacattataaattttctcttttagctatttttaaattacattattgtaaactaatttccttactgtgctattgaatactaggcacagatcacaataagatgcacataaactggacaaaagtctttgtcaccacgaacacagatatgtactgaatttgattcccaaatctgctctgtggccttagtcaagttactgaactcacctgagcgagtttcctatgaaatgaaaatgacagtaattgtggtgcatctccttgtacagctgctgggaaggccaaatgggctaattcttataaagcaccctgtgcatagtaagccctcaataaatgctagctactgttgctattgttcctttcattgagagatgttttgtggtgggtttttgttgttttgtttgtccattagccaagtcagaatatgacctctggcttgtattgtccagtgctatttttcatagaaatgaattttttttttttttaaagagacagggttttgctctgtcacccaggatagagtctggagtgcagtgatatgatcatagctcactgtaacctcaaactccagggctcagtgaccctcctgcctcagcttcccaagtagctgagattacaggcaagcaccaccgtgcctaattttttttttttttttttttgagacagagttttgcccttgttgcccaggctggagtgcaatggcgcaatctcggctcactgcaaccttcgcctcccaagttcaagcaattctcctgcctcagccttcctgagtagctgggattacatgcatatgccaccatgcctggctaattttgtatttttagtagagatggggtttctccatattggtcaggctggtcttgaactactgacctcaggtgatccatctgcctcagcctcccaaagtgctgggattacaggcgtgagccaccgcacccggcttttttttttctttaagagagaggggtctcactatgttgcccccaggctgacctcaagtgatcctcctgcctcagcctcccaaagtgcaggtgttacaggcatgggccactggcacctttcctagaatggattttcaactctgtttaaagacgattgctaatgcacagccaattgaatgcttattaagtagaaattaaacttgctttcaaataatgagaacatatgtcacagatgaagagttggtcctagtgcaagtttacaaataaaagacaaagaacctttcagctattgtgactagttagtcccttcttttacagatgtgcccatctgtgtgacaaaagaagcaaggccttttcaaatctttgcagagatggcacatgataaaagtcaggttccactggcttggatgctgattgccccttcaggattacaaccaccccagttccctgcattgtttgtgctatatcatgagagaacaggggcacatgaggacaagatttcttttcatttcacctttcagcagccttgtctgaaaccacactgactgttgttaaaaatgatgcaaattgtgcctcctttcagaaaagcacaaaccattctcccgttttcccccagtccaagaactgtacaggaccttcattagctagaggaacacgatgatggcagtgcctattttaagcagaaagatgctctaaagggaaaaacctaaaaggcttcagacaaaatactattcagtttattatactattgatttttagaatactcttcagctttgctttttttgcggatatatgtcaaataaccagcagtgctttaagttacttgtagaagtatttatcatatatattttttcttagagaagagaaataaagctttggtatggactaacccaaaattgtttgggaggtaaaacaaaactttcagatcagttatgtggcaataatcaagacacccaacatgattttaattttaaaagggagaattccattataaaaatctaccaagtttcctcaggctcatccccacacataccttttctggtctatgtaagttcacctgtttagcaaagggatgggattgactaattggacactcaaagctttcccccagctctgagttcatcccagcttctttagattttttttaagaacaaagaaaaaccaatattttgggaactcttacatgtagataatgtcagaattaatttccacttgtggcaggatttcagtaaagttataagacctcatatactttttgtctaagttaaagcaacatctttacatcactttaaattatacaaacttctaaccaataaaaacaggagaagtatggtgtgtatttgtttccatgggcttccataatgaaggaccttcttgggtggcctaaagcaacagcaatttgttatctcacagtcctggaggctggaagtctgccatcaaggcatcagcaggcccatgttctctgcaggctctagagaggacccttccttgcctcctccagtgtctggtggtcactggcaatccttgcctcctggatgtatcactccaatctctgcttccatcttcacatggctttcgcccctgtgtgtgtgttttctcttcttataaagacatgagtcattggattagggcccatcttaatgtggtatgatctcaccttaacttatttaattaaatatgtaaagaccctatttcaaaataaagtcacattctcagattccaggtggacacaaattttggggaacattatttaaccctgtacatatggagtgcaaaactactcacctttcctttaccaaggaatttctaagggagtcaaattaatttaaaatcttcaccaacttctcaacaagtgcacagctttattatatccaagatcataaaatctgtcatttttcttgcttatgttgatattgtgctttatatttacaaagttttttcatattgcttcatttgatactcacaagcacaaatactcattctcacacaagtaggcagggtgactggtctctttttacagataaagtgagggagaagggaaggaagcttaccttttatcaaataactactctgtgctagatactgttactagtgcttcatgagttgtcttatttgatctatataaaaaactcaaaggttactgtaagtagtattattcccattctgaagtagagtatagcataaaatagcactaaataacttacccaaggtcacacacagctagtaagtaacagatctggggctgccgctcaaatgcacctgtgttctaagtccatcatgtttccattcttccttctcaattaagccttcttcctaacaagtctttaactttgttcatggttagaatttgctaaaatatgtttggtggttgaaagtcatgacaaactcagtgatctcattaaaggatcaaccggagagatctaggccacttaacatgacacatacaggggactatgctttttgtagttatccttcatgttgcaataaaatgcaaaattttcctaactttgaaaatagaggaagaattgtggtggtaagaatcgtcaaaaatttacccacttttggaatagcctcaactagagtaaccctctaggactttcatttattcttctctgtgagtaccaatagggtgaagtcaaaaaatgactccaccattctgtggatggcccaaatcatgagaatgaaggaaaagaagttatcataaccttaagaaagaataagtgggaaaaaccattgttccaaatgtgggcttgaatatgctgtaatgtttcaaagcagcaagtaaagtatacttgttaaggatactctacccacctatgaaccattggagaaaatgaactattttgatgctgcctttaaagagttgtatcttcagagaagccaaaattcactgctgaaagattccttcttgaatctgtctcagaaacaatcttggatttagaatgtacatgtatatacttgtgtatgtgattatacttaacaccatcagttctaccttatattataaatataccatgataacagaactttcttttcagattgtgtcaaaaaagaaaaaaaaaaagggtctcactctgtcacccaggctgcagtatagtgatgccatctctgctcactatgatctgcctctcaggctcaagcaattctcatgcctcaacctcccaagtagctgggattacctgcgtgtgccaccacacctggctaatttctgtatttttagtagaaacagggttttgccatgttggccagggtggtctcgaactcctggactcaagtgatctgcctgcctcggcctcccaaaatgctgggattacaggcatgagccacctcacccagactcttttcagattcttaatgcattctacgtatttacaaataaatattgctaatagctaccatctattgaatacctactgggtgccaggcagctaagcacttactgtacatattcctagttgtcacaataatcctacatggtactttttactgatcctcattttactggtaaaggctctgagactgagaagtttaatgtcattcaaaacctactagatgggtgagccagaatttggactcaagttcacataattccaaagcctgccaccacacaaggaaaatatccatttattcacttatataagattgttgacctctttaaatatgccggtttcatcctaatcctctaaaaaaattagtcattctcatcttttgaagtccctctgacctaagggtgattcacagaggatcaagtaggtaggatcaagaatcctcatcttccgaatacattcatctttttagcttgataaagccagaatgttggggcctaactacgtagacaatttcctcacatttaattagaagacagacctaagacttgtctttgaggccaaatgctacataccaagttttcaccatgaattatgtttcatgagaacatggttgaatccatattaatactggatatctaatagagatcatgttataaatgaaacaaccatttatggataggtaaatattatcaagtacatgtttacattttcatattacatagcaaatcgttaggaaaccaagtgattaaatttggggttttgatggggtacacatggatgtaaaaatggaaacagagactgggggttataaggggtgcaggcatagggctgaaaaactacctattggctgctatgctcactacctggataacagattcaatcacactcaaaactcagcatcacacaatatactcttgtaacaagcttgcacatacaccccctgaatctaaaagttgaggccaggcgtagtggctcaggcctgtaatcccagcaccttgggaggccaaggcgggtgaatcacctgaggtgaagagtttgagactcacctggccaacatggtgaaaccctgtctacactaaaaatacaaaaattagccagggatggtggtacgaccctgtaatcccagctacttgggaggctgagccaggagaatcgcttgaaccagggaagtggaggttgcagtgatccaagattgtgccactgtactccagtctgggcgacacagcaagactccatctcaaaataaaataaaataaaataaaataaattgaaaaaaataagaaccaactgttgaaacctcaaaaaaaaggggggtgaggcggtgggggtgagttttgaaaggtttaactttgcatgcattggtttaccaaaggaagaaaaagggagtgggagagacagaagaaagagaaaaaaaaactccataactagaaaataaatgcctgcattgtagaacttcttaaatgttattttcataaagttatataaacgtatgtcatgcaaataaggacaggtcaaattgaaatgtttataaaatatgctaaatttaagagttgtagtcaaaatgtattatagaatctaactgtggagtttattaatttacattttcatggcataaaaatagcaggactcaagccatgcagttaatgtacacaacattcactgaattgtagacacaaagaggctaaacactagaaagcagcttttaatattctgtaatgttctttatcaagctgtttgtacaagactttatgaaacacagcacacggcttaacaatctccagtgcattattatacatatctaacttttgccttcggatactcccagcaaaggacaacagattctcaactttactgtaccaaagcaatgtggtcaggaaagcagcttccccgttctgcagcagctaaatgtcagagagccaagggttccaccaagatttcccaaagcacagcagttgccattagaaacttcctaaccctccaatgttcactttacagagtgttcagagggtgataaacagatcttttacttgatttgccatctgtgaattttaaagctgttaaggcacttttctgtctttatttccatgatgctcctgatcccatttgctagttagatgcactcactaatatattattcagttctattgagaaaaccatactgaggcatctccgatttgacattactgtccaaatttttttttttttataacatatcaagtaaaataaaccagcttgaaaccctggccttttttagtgcttcaaataattcttttcatttctttgttactgagagctcacattagaaagctattaatacatttgagtacaatttatgttttcaatgcaacccagacaagaaatgaaaaggcatggagaagaaacatggccttcctggacagcctgaatcagtaagtcgttactcttcaccaaatgtagcttatgtacaaatggcttcatttccattccccttcgctgtgggagcctcaagaaccacagttacaggagctagaggatgacgctgacagcggtcacacaggcagtacccactcgtttcaatagccttcgccttttccatttgttggtttgcggaaagacaaaactgtgctgatcctgattgtatgagacaagaaaatccagccaattctattttacgtggtactcttgccttagtttctttttcagtgagaacagacgcgccactgctacagctggccctgtatgttatttttttccagcattagtaatggagtcattgattcaatctatatgaatggagtccctactaagtgccaagcatataacagtgaacaaaacaacctctggcctcatagaactttcattcaaggcggtgagatgggaggagccaccaacatacgaaaacaaatgtagtcacatttacattaatgcctgaattaccaagactcgggctttctttgaagccttccccagccaatttgagggcactatcagatgtcctgtaatatgcacaaaaccaaccactcattttcctccactttggccttcttgctagttgtctccttgtggggcaggtaagagacctgacacactgccacatctacagggctaccaccaggtcactgacataagagtcagcatctccaccactgttcgccactctctaccgctctgcagaggccactggaagggtccagggtaagaaacctcacctggggtctatggcagggtagagagagaaagctggaggctcccccacctgctaatattacagttggttacctcggccctatggttctgtttgtgcccaaactttcacatggtctttcacaaacacgactttttccccttctgaccttcacctttctcttcacccaggctccatgtattcccttgtattctcatctctttccctcatctctctccaggcacctatccacaaaataggttcctcttttttcaccagaagcagaaatgtatatgaccattatctcttacaaccacatccccatagggatgactaacctgatgctcaaagagccacagtccaccttggactccgttaggaagccctgccaggtatagatgggagaactgagctaccagcatcaaggacaccagcaccagaaccagtctttgaactattcaattttatttcctaatgaatgtatttctccacccaaatgctgtgcatcccaggctcttcctcaacctctacctacagagaggatgatcagctcttgtgggtgaggtacagtcacaccagtccagcaatgtgctttgcgattccttgccaggctggattccctaaccattctggtaagcctatcaataagcttgcccaaatgcggtgaagacctctctcagaacagccggagtatattaatccatttaacctgggttttcctaatcaatatggaaatgtttagcctctgaattctgaaggattgattccatactcctgtatggcattccctggctatcaactgccctgagtaggttagcctcaagatatgtgtgggctttgctaaataaactttgataaaataagtaacatttttctgatatatatgaaaatggttttctcatctgtgttggacttttccacagctacatctcctgttctcatgagaagttttacttcctcagaattagtgtgcctccgtaacacaaaacttcagaaaactcccaggcacatgcatgtcaaatgcatgtccaataggcttccacagcaatcttctcatctgtaattcacccagggaagaagcaagcacctccagtgttctgcagactcacagtaatccaagctgcttaaatccttcataaatcctctgtgcaaaaacactaaagagattgtcagcaggaaattcaaccactggttacctcggacattcctagaagacttttccttaattatcagccagagcactatgtcattaatgcagacaagagttgacagcagctggtctaaggcagtaatagcagagacagacacacaaggcaggttcagaagctaaccaggagatgaaatgggacatggcttgtgtgaccacaaacatgaatgcgtgtgaggaatgaaggaaaaataagacccagcaatgattccccaggtttctggcttagatatttgagaggatgcagccactttttattaaacacaggaggaagagcagacttggggagatatatggttaactgcacactaatttatatttgcaaaatgatgaagcacatggagagcaattttttatttttattaaattgctgattatgttcttaagagaaaatatttgtatttactatctatgcatttgaaccatcagaacccttattttcaggacccttattcccaagttttctatgtgtctcggtaattcatcaaataatattaaccagcaagggagggaagtaattaagtgaagatgaaatttttattaaaacactaatcataaatgctcatttacttattcgacaaatgcttactgaatgttggcaatgagccaagtaccaatgtgaacgacagaaacatagataacaatgatactgaacacataaggagtaccagccaccacaataagcacgtcatctgccattgacaatccccatcataatcctgctaggaaggtgttattacaatgactattccatagatgatgagaactaaaactaaaatcctaaacccccaactggctgaacaaatcccctcttggttaaggggaccccagagaaaccttagaaactgagttcctggccacggtgcgatgggaagccagacccgtctcattacatcccctcctttttgtggtttagacgcaacaactgaccagcatcaatgttaacatagagatcctaagactaacaaaatggactctgtggcaataagataccaaattataaagattgcctaaggccatgccaggcaagggttaagtcatgcaccctccacacttaaagagtaaattctgttccaactgccacaagtttttctttttctctagcagttaaaccagcaccggcctcaagataagcactattgaaacaactgcagcactctcaccaccagatgctgacccccggccgattccacaagccatacccacattttttgattggaaaagagacagctgtggttcagtaactttctcctaataagagaccatggaccatggactgatctggctggtttacagaggctgtaaacttgagggccttcgtgtccctgccttacgttttgccatataaggcctaattgtaagacacttaaatgttaagtctccaccccaaagtgaacatgggatgcaggtaatacgcatgtttgcttatcacacgtgtacctctcccacttcatgattattcatagctcctcctgtaacctattgaatatgtatacttggccaacctcagcataaatccctgttccaccccttcctccctcaaagtgtctgttaatagcctctgcaagaggctacacttcccagccttcaaaaatggccagaccacaggctataaccctttataagaaataaagtctccttcacagatttaaagatcttgtgatttttccatgatgaaactgacatagcaacgtgttgagtaacttggctaatgagtaggaaaccaaagtttataccaaaccctgggactctagagccggtctctgccatgcctcttccctcaaggaagtcaggatcctcttgggaggcagaccatacatgtcattagaaagcttttacaatgatcaccttgcttgttcatctcaactctcgcagatctgccactttcttcagtcctctaaccacttgattcggtacacttgatgtgatctagcattaccagtctctcctccaccacatgctgcctgtaattgtagcagtcacttgttttcagtcatatcattacagagcagcattgagttttccagtttataagcagcccaaatttgttttcctgttgagcttttgccttgaatgtctggcttttccttggggatacatagttcccagttccatttcccacaggagctttactctggaatgtctaatagtgtgtgtttgtttcaacatcggggatataaataggtaaaatgaagttctgcttggtgctgctgcacggctgcaagaaccaagggccagccaatcatgagctgagggacttactgtgtttgtttaaatatagttcaggtttctcccttctctctacctcaacaagatttagcacctagaacaagacactacacctttagtttgcactccgaaattgctaggaagtaaatccatctggaaactgcactggataaggagcagggatacacagcagtggctggaaagaaattactcaagtacgaaatcaggaaggaacctcattaacaccccaccaccttttgtaaagtcaataatacactgtccagtatgaaacccagccaagatctcagctgttgactgttcagtgaaagaggaacatgaaagtgacagaaggacattcattccagaaaccctgagaatccagcagcccctacctggtctccagctccatgacttgccaccgccctcactgctccagtctaaattccacaccttcagagctagagtcagagtttccagggtggcaggagtggagtgaaccagggggatcccagcatcctcctcaaatgtagggactaagactggcggggaaaaggggcagggtcctttggggattgtaatgcacccaaggggaaatcccagagatccaggttcagtcctctggccctccccagctagcctgatgtagctccatcttcactgaagttcctctggtgataacacatcatgttgaagaggatatttagggcttcctgagacaaagctgtgctaaacacatgaactctcagcaaatactagcaagtgaattaaaaatgaatgaatatcctataaaacaaagcaacaaatcagacaacccctacccccgaccccatggctcaatgagagcttctggacctgcagcatccccacaacatataattcacccactaccccatactagagaaacctaggaggctctcgtgtcctggggagcaagctgttaagtagaagtgggagaattcctaaccctgttaagagttggaatgttaaactctaaagataagcctgaaaaccagctttaaaaaatgtgagcattcctagttaacctagataggcagaattcttttccctcctatcaagacaaacccacagtagctcaatgcctggattatgaggccacatcacaaagatgttagttttttcagtttgggttgttgctgaaaagaaagtaagaatttaggcattacaattcagactagatccattcattaggtccacaccacaccagtaaacagtgatacagatttgcatagtgtttttttaaattaacatttaataatgttttacttcccaagccccttatgagctgggcattggctaaaaaggttttggctcagtacaaagaagaatgttccacgcctgtgaaacaccaaacaatggagcagtggtgttgtaagggagtagcctctggcccattcaagtcaaaactggataattatttgttgcagatgctttaaagagttctaataatttaggtgttaggtgagaataaataatctctaagatgtcttccaatcctagcatacatgataaattttttctgtggaaaaagcacccaaacagaaagtgaccagtgactttccctagtcacacaaccagaccctccagcttctagcctaacactctttccactggatggtcttcaccaccaccagtactcagccccaagacaccaggggaacactggcactgtccctttggtttcatagaaaataagcacaaataaaagattcaacatctgaccgacatgctttcccatattttataagaagatcaatttagtaccatataggtaccaaggtactataggtaccacataggtaccaagttactataggtaccacataggtacattagacagactgttttgtaaacttctgaaagccaatacaaagaacatctcagagttagtatggtagaaccttctagaacacttgtcatggcctgaatcttcatgtccctccagaatgcatatattggaacttgtattagggttctctggagggacaggactaataggatagatgtatatatgaagggaggtttattaaggagtattgactcattcaaccacaaggcgaggtcctacaacaggccatttgcaagttgaggagcaaggaagcgagtctgagtcccaaaacctcaaaagtagggaagctgacagtgcagccttcagtatgtggtcaaaagcctgagagcccctggcaaaccactagggtaagtccaagagtccaaaagctgaagaagttggagtctgatgtttgagggcaggaagcatccagcatgggagaaagatgaaggcgggaacactcagccagtctagtcattccgcattcttctgcctgctttattctagctgtgctggcagctgattagattatgcccacacagatggagggtgggtctgcctctcccagtccactgactcaaatgttaatctcctttggcaacaccctcacagatacaccaaggaacaatactttacatccttcaatcaagttgacactcagtattaaccatcacagaacttaacccccagggtgatgttattaagaggtgaggactctgggaggccccaccttcatggctgggattactgcccttttaaatgggttgagggaacaagtttacccccgctttggctccttccaccctgtgaagatgcagcaaccagacaccatctgtggagcagagggcaagtctttaccacacaccaaatctgttggcaccttgatcctggacttaccaatctcaaaaactgagaaataattttctatcatttacaaattactcggtctaaggtgttttgttatagcaacgggaacagactaacacaaccctatacttcagtatttgggataattggattaaactaataatttcactattaccccataatcaaacataatggcagcatttatttggctgagtttcatgcttagagtatgggaataagaattgttccattataaaggtcacaaccttacataatgatctcccttacataatagtcacacccctatttttggaccggcagagccagcataaaaagtgttatcattacacaaatacagcactttagaggtgtttttaaggacagaaatatattttcaattctattactatttttcaaacagctgaggctagacagagattccaagtgccctgcttcgctgtttttgagctgtcaaagaaaatgaatcaactgactacagtcacgtatctaagacagacatagaatttcgcaggaagtctgaggttatttgggtcaagttcatacggtatttgatctacagcctgataatacagcttttgtgctatatgagcacactaggacatggtgttatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgtccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacatggtgttattttttaactgagacataaaaaccaaagtaacaatctacttgtattcattgttaagttttcatatccttatagccaaagaaaggaaaaccacttccaaccagcctgcttctattaatacacacagtgatctttgacgtaaatgtcacacatgttcactttaggcttctggtcaaatttgcatgaggccaattaaattctgaggtcctgaatctcctctgtaaattcaacagatagatttctcttcttgtactaagctattgtttggtattgttctgaactactcaacagctgtaattctgcaactcactggatgttgaagggtataataattgtaccgagggatatgaatgtgtgtaaacccaaagcccagtgctgtctctacggtgatacacttatccacattcctcccactgtcatgacacagtcctcttacttcaactggctcacttctccgaatgcctggaacttcactcaatttaccttcccttatacaccttagatgtcaccttagatagtgcaccttaaatgtgcactattatggtagccactagccatatgtggcttctgagcacttgacatgtggctagcctaaactactgagatgtgctgtaagtacaaaattatatactagattttgaagacttagtatgacatatgtaaaatacctcaataattttcataccagcctgctgaaatattttgcatatatcaggttaaataaaaacatacatattatacactagaaaattttaaattatgtgtgtagctcacattattggataatattgagttggctaattttaggctctctttccctgactccattctactgagctctcttcaattacacataaattgggtcttctaattttatcctttatctcttaatctccttttctatccttttgtttttcctgtgctgcattctgggtaatatctcatatttatcttccaaatcactgattctttcttcactaggtctaatctgttgttaatccatccatccattacattaggttttatgtttactttgttttgatgttttgaatatggttttgtttactgaacttccagacaagatttcatctggtttagaaaaatattggaaaccattaggcaatttctactaatgctgaatacatgcatactctgtcaccagcaattctactcctaggaataaacccaacaggaaaaaacgatagcccaaaactgaaaattacccaaatgcccaacagctgtagaatgtggcatattcacacaatagaatactaaattaaataagaaaagtataactatatggaaaaatatgaagttcttttatcctttttcatatgttgagagacaaaggtcatatacaaaagattatatagtatataaatccatgaataaaatctttttaataggcaaaattaaaatggtataagaattcaggatacttgcataatagtcacacccctatttttggatactggttgaccttggagtaatactagttgaccttggagtaaaagattacatgaagggaacagaaagggggtttatgagatgctggtaatgttctgttccttgatctgaatactggttacatagtacattaatttatggaaattcatcatggtatatccttatgatttttaaactttgtatataatttaacagtataacaaactcaaactctaatcagtgattttcagaaaaatatttggatgttgtattagtctgttttcacactgctataaagaacgacctgagagagggtaatttataaagaaaagaggtttaattgactcacagttccaagtggctggggaggcctgaggaaacttacaatcatggcagaaggcgaaagagaagcaagtcacgtcttacatggcggcaggagaaggagcgtgttgaaggaagtgccgcacttttaaacatcagatctcatgagatctcactatcacagaacagcatggggaaaatctgcccccatgatccaattacctcctaccaggtccctcccctgacaggtggggaattacaattcgagatgagatttgggcagggacacagagtcaaaccatatcagatgttaaaaccttttttttcctttttgagttgtcagttttgaatataattatttcaaaaatttcattttgtttccttttcaaattctgcctagacatttttaatagcattttgctcatgttttcaaatccatcttttatttctagaaacattttaggacatttcatttatattctgactgataattcttaaattcaagttcttgggaagtctaattctactgtttgttgtttccactgatggcttgtttactctgtgtaactggaaacttttcattgtgaagtcatatgtggttgattttaatctgtgagaattctaaagagccccagctgtgggaacattcctacaaagctgattctcttccgattctgctggaatcctgagtctctctcaaactggaattatcttaacaattcttttgcttgaggtttcctggacggcatatgtggataatgtgagtttaagccctaaaccttcatgagttcagaattctcagcagagacatttccccacccccagccaaggccagaacaatttctcatagcagtttttctttgccaaatggatttttctagtccatcttttcactgagggtgtagatcttcaagattcctggcttttgcagactcttaatcagttccgttgaccttgtaacagcgcccaagtcctcatctcccattccacaatgcacccctccctactcatccctgttgtatggcaattaaaactgaagctttcagtttctgttatctgcacacactcccaaggcagcccatatcttagatcctcactcaccaccctggtgtcagctctctctccatttttgcctctgtagagacttacattcaatttttgtgagcttagctacatatttaaaaggttgttttttatattacattcagcatttctcagtgtctgtaattgggagagtttctccaaatatctattcttcataatactagaagcagaagttcaacaggccttctctatctgatgcttaaaagctagcgaggcagtcatttcagggctttggagaggtcctactctgttacctcccagcttaattacaactgaattttctagaactaaaaaaaatgtttaacatgagcagaggtgaggtgaggtgtcaatcaatccattttcacaatatgctaccacctactattcagtggacttgctaaaaagtcacctagcagagagagctttgccactttgttatgccaaaggatcaaataatgcagaaaccattcattcatacaataaatattcaccaagaatctgctctttgcaaggtacaaagtgctaggcaaacaaaagtgattaaaacaggaacttggccctcaaagagtttagctagaatgcctaaaaattttcttgccttaagtgcaaattgatcaataagtagagattgcctggagcattgtattaagaatctgaggccaggcatggtggctcacgcctgtaatctcagcactttgggaggccgaggcgggaggatcacgaggtcaggagattcagaccattccagccagcacagtgaaaccctgtctctacgaaaaatacaaaaaattagccgggcatggtggcatgcacctgtaatcccagctacttgggaagctgaggcaggagaatttcttgaacccagcaggcggaggttgcagtgagccaagatcgcgccactgcactccagcctgggcgacagagcgagactccgtctcaaaaaaaaaaaaaaaaacaaaaaaaaaaaaagaagaagctgaggacaagtctaaactagtgagtcatctgttaaaatacaaaccccactatgccatttccctgttgaagcacctctaatagcttcccattactcccaggttgtaatccaaactctgtggcctacaaggaggtcctcccagatgtggccctgcctgtctcccagtcttcctcttgttcactccattctatccatactagcttccttctgctcttcaaaggtgcctagttcattctcactttagctcttttgcacatattcttcctcccacctagaatattcttagttctttacatgggtcccacttctcatcatgagtctcagcttaaatgagacacactttgagagggcccttccctaaagaccctgtaaaaaggatctctcccaccatatcatttatctgtcacatcaccctttttaaattttcttcacagtccatatcagtatcttaaattatcaagttatttgtatattttctcatttattctttacttttctctatattctctaaatgtacctggcatatgtaatgggtgctctgtggtatacatatggatgaatacataaatggataaatggtcagtgatgtctgcaagcatgcaaaataggagggtggctctacttgtactacctaagtgcatcagaggaaaggtgacagtaacaaaaaacatcaactaagtgcaaaaaatgccgttaggttcaggagtgatgaaaggggacataatgaactctgttgggagcaagtgaaggacacaggcagggaaactgtccttgaaaaggcagcttaccaaagaccctaaagaaaagctggaagttactggcaggcatggtggaaaaaagcatccagacagaaaaagcacatgcagcaacaagcagctgtgagattcctccttacttcatgctatcaccctgaattcagggaatcagaacttcccaaagggttccagttttggcctcttgtccagagatgtccaggtggccaaatatcaaagtcctgtttcagactttcccattaactaatcatatggtttctaagagagtcattctacccctgggggcccccaccttcagcagctataaaaccaggatgtggctcgtaggtctctcatatcccttccatctctgcaggtctgttagatactcccgtgtttgctccagcacacattctgaattggccagtactggaactgtaaaacatattgattccttttggtgatttcttttgtgctggtttttgttttttaatgattaagagatagtctacagaatatcagtgttccactctgtcactcagttatagctaaacaaatcaattataaaattaagctctgaattttggtaaattccaaagccttgcacatgccgcctctggccagtctgaagtccaccgctccatatcactgaaagcccttctttagaatgcaggtgactgggtccaaccatttaccatccaaccccccagagccactgaattagcatctctcatgagtggggcccagaaatccacattgtcaacattggtaatgcccagttaattctttcttattcaccctcaaggagagaaccactacctcttagcttcgctctgttccaggataaaaacaaaacaataaccaaaacactaacagtggccagcatgcattgagtgcttcttatgtgtcgtgatttgtcccaggcttctgacttcctttcttgccccaacagtgttgaatcacttgcccaggttcacatagcaaccagctggggaatgaggatttgaatccatgttctttggactccagcatccatgtttccaactgctaactacactacagcagggtacaatgcttaagagcctcattcagctctagcatcggacttgatgagttcaaatcccagctgtaccatttactagctgtgtggccttgggcaagttattttgcctccttcagcctcagtttcctcaatgtaaggtgaggataataagcattgctacttcatagggtgcttggttgtgaaggacaactgagtaaaatgctgagaagggaacctggtgcatagtgagcgtcagccatgatgatccagcctccctttctccaggcttgggctccttggggcgtggtacttgtcccaaaggaaatctctgtcaagcatgagtagacggaactgaagaaaatccatcctctctgctggaaagcaacccacagcccatggtctactgacagtgggtcagtagtgttgtctttggagataaagtatggcacattatttgaacttgaatgttcaaagggcatcaactcctttctagcacacaacactttcagccttgctgcttctttttctttcatgcctcctaatggttctgtctgtcattatgaacctttcagctctgcttccacaaagcacaaagggatcccatcctttaatcctcaaaatagtttgtctttatagtttggcaggtaagagttggttgcagcagtaactcctgaaacctgcctctcattatgccaagaactgcaatgtgtttgccacataaaagcatgagtgataacaaatgctttccgatggtgagaactgctctttatggcctgctttccaagtgccctcttgacatagaagaactttttttttttacaacatcaatcatcattagtagcaaatggtgatatctgtatctgtccaggtgacatctcagccaaggaaggaagccacatcctgagaatgtcagctgttacctcaagactgaaatacagcaatagttacctcaagatagaaatatagtaaagaacttttgtctttcatgacagaaattattccataggtcatatttttactaaatcttctaaggaggtacttaaaattactttttcgttgtaaataaaactagttttagagtaatgcataatattttattcttttatttttgagacagggtctcactctgtcatccaggctggagtacagtggcatgatcctagctcactgtagattcgaaatcctgttccagtggtcctcccacctcaacctcctgatcaactgaactacaggaatgcaccaccaaacccagctaattatttttttgtagaggtgggggtctcacaatgctgcccagactgttctcaaactcctggcctcaagtgatgttcctgcccaggcctaaaattttaagtaagttcctatttatgaccacagatattttgagagtccattgccatgctagccttatgcaaattcagcgatgtacccatgaaccactatacccaccccaaaagctccacccaggggagacaaggcatctgaggggcacaagccccagcagaccaccacggatctgctgacctgggagcaaacagactcctcctcttaaaagatctacccactcagcaatacctgaactttgcaggagccagcaaacaagcacctcactccttggtaagactttccttttgctgcaccaaactggaatcttcctaccgccccaacctactgaatctataccattatttcagcaagagaaactgagcaaaacattgactacttgtgttagagaacaatgaaatattctcatcagaaaccctatcctagagaaggaaactgtctgcagtagagggaggagctccactaacttcgaacagctccaggactgacatcgctaaggtcttcccaactttatcttttctcactagcccccagagctgtccagttccagcacatggacatatatgaaaatacaatatcatatgcctcctccactgaccagggcaaaagctgcagtaaaagaactatcaagtcaaggaattatcttaaaatattactaataacattaccaaattacaaaaaaaggatctttaataagccttccatctaatgaagaatggaatgaaaatcaagaaaaaatgttgacagaatacaaaaagctgaagttcagatgctgaacacattcttttaatgttttatttatttattttgagacagggtcttactctgttgcccaagctggagtgcagtggtgcaatcatggctcactatagcctctacctcccaggcccaaatgatcctcccatctcagtctcccaagtagctgggactataggtgcatgccaccatgtccagctaattttaaaaaaaaaaaattgtagaaacaatgtctcagtatgttgcccaggctggtctcaaactcctgggctcaagtactccccctatcttggcctcccaagtagctgggattacaggtgtcagccactgtgccccagccgctgaacatatttagtcaaacttcttaccagagtaaatcccattgtaaccactgaggcaagcttggctcctcccagaatctgctttctaggctcagtccttcacatggtcttccttcttgtccccttggtcaccaagccatgcagcccttccacccttggcccatgcaggtataattctggtccctagcccccaaggtaaggaagcctcttcacttccaagtccccaaagtcacctgcctgggccactagccatgcagcagtaacttcatacttccctgttttgctcttcttgaaggttcctattgtccaaccataggccaggaagccctgctcttactaaatcaagtgttctcaatcaactcacctgagtcaaacaggccttaaaagtctacctatgccaatcttgtcatttacatgtaaggcagagaggctgaatgacttgctcaaggtcataaagaaaattaaggagtacaagccaagcctcctgttacccaggccagtggttttcacatggtaccaccgatgaagcctggggctgtagaccccgttgagccctgcccagtattccttttccacctgtcaccagtgctactgctaacctcacacctctaatcttctcgagagaaccactcttgggtgatatagccaccttgcccaagtatgcccgggaattatcacttaggaccaggttgcccgtagctcaagactggttgatgcaaagatacaaaattcctactttcctgcctcaaggaagaacacaccctgctatgattgatgcttcagagcatccacaggatcaggctcagaatgggcctcacctgaaagtgcatcctttctcctgagaatgctcgttaataactcattttgctaagattctcttatattcagctctgcttctagggaatctaacctgacactggggttctctctgagcattccaagcaagtatactggtccaggccccacagtgctcaaatggcctccatgacaatctttatccagagcccatcaacattcaatccagtccctcagtcaggaatatcccttgtcccttccagcctagaagtccactcttcctcctgagagaagcaccaagtccctccctcctgccctctcaagctctcacctgacttgtagttaggatctgaaagaaactctgaagtcagtgaatcatcaagctgaggtcatcagcagcataacactccctaaaatatttagtcttcggtgctccttagggagcagagaaatgcccccacagtgtcccttaatttgcttcttaaatggtgaaatctcttaaacagagaatgagggttttcattacagcattaacatcaccaacatgcagtggctcatgccagtaatcccagcactttgggaggccaaggcaggtggatcacttgaggccaggagttcaaggccagcctggccaatgtggcaaaatcccatctttgcaaaaaatatataaaaagtagctgggcgtggtggcacatacctatggccccaactattcaggaggctgaggcatgagaatcccttggaaccgggaggcggagactgtggggagctgagatcacgttactgcactccagcctgggtgacagggtaataccctgtctcaaaacataaatcaccaacaagccacccattgcttttgaagatactctaccctactttctcagaggaatcactgttcttgctacatgttctaactgatgttcttatctggatacaaaattaaaaaggtttgtcactctggagtaattatttaactatgacttgtttacataaaacagcatcctagaaaatgagtttgcactggtttctttcacagcagagatcagattattgacaaaatatccggagaacttataacctgctttgtaacaataatggctattcatgtatagtgcccaatatgttccaggcaccagaaatatgtcccttctaatccttgcaacaggtggggacaatactggtcagagaagttaaataacttgatcaaggttaagcaacaaatacatggtagaaacaggatttgaacccaggtctgtctacccacaaagcaagtgactgggccacttcaccacctctacctcctgttctccagtgcttgagactggttctaccctgcagcagttcctgttccaagctaagcttcgtacaagaattaatggacgttctcaaaagtacaccctgttctctgaccttgagagaggaacaagaagaagagcatctggtgtagacaaatgtaaggatcaagaggggctttgacaggaaggcagagtaaatgttctcttccctgtttctcccataagtctagctaaaaactgagcattagatctaaaacaagcataagaagacaccgaaaggtggggagctgccaagtgggttaaggacctcaggacccagggaatgacatggcaacgagttcctgaattttctttttccctcatgtatttcctcatctatacctgaaaagccagcaacctggaaacaccaatacacatagaccaaaaacaaataagcaaaaaaagctcctctctttgtccaaagaaccaggaaaggggcagcctagcttcttttagattgaagaaaaaaatgaaaacttttagataataaccactctactcgaaacacaccacacacacacacgcacacacacacacacacacacacacacacacacacacacacacaaaactgtggacccacccatacaagcaaagacctagtggggaacctagacagtagtgaggagccccaacacctccaccaggatagtttctgagaggctgagtgtggaggctggcctttcatctctgctaggtggcaatgtggctgcaaaggtgtcagaggaggctggtggagaatcaggtcttacccgccaccactcagcagtaatgaagccattccaaccgtgggagtggaggtcacatggagaaccataacaggactcctcctcctggcagccagatggatatgggtttcaaagagcaactataaatgttcttgaaacaaaaaactacaaagaactagcaaagtaatgagaagtatcagcaaagaaacagaagatagaagaaccaagtagaaactttgggactgaaatatattataaatgaaatgtaaaaaaaaaaaaaaaaactcaatggatgggttcaatagcagaataaagagaacagaggccaaaaaaaatctgtgaacttacagataaaacaattacccataaacaatcaaaataaattaggctggggaaaaaaatgaactaagcctcagagacgtgttgaactacaaaaaaaagatgttaaaggtaggtcatctgactcccagaaggagaggaaaaagagggtagggctagaaaagcatttgaagaaataatggctaaaaactttccaaagttggcaaaagacagaatcaagaatctgagcaccaaatgggataaacccaaagaaatccacaccaagatgcatcacagtcccacaaaaagacaaaggaaaaagccttgacagtagccagagagaaatgatgcatgaagccataggggaagaacaatttgaatgacagaggatttcgcaaaataaaccaaggaggccagtaggaagcagtgcaacattttttaagtgctgaaagaaagaactatcaatccaaaattctatatccagagaaaatattcttcagggatgacattctcagatgaagaaaaactaagaggatttgtcaccaggagacctgccctaaaataatgactaaaggaagttctctaaacaaaaaggaaaagataaaagaaagaatgtctcagaacatcaggaaggaagaaaaaaacatggcaaaaatatatataaatacaatcgagtttgctttgcttctcctcttgagttttctagattcagttgatgattaaaaaatcataacactgtctaatgcagttctcaaggtatgcaaaagaaataagacaatcatataattggaagggtaaagggaggtaattttctttttcttttacttttttgtagcaacaaggtcttgccatgttgcctaggctggtctgaattcctgaactcaagcaatctgcccgccttggcctcctaaagtgctgggattgcaggtgtgagcccctgtgcctggcccatgtctaggtttctatacttcgctggacctaataaaatgacaataatagtaggcaatgataaatcatgtatgtctacatgtttaaaaagccatgtcaaaagatacactctaaagcaatatagataaatcaaaattggattctataaaatgctcaaagaacccacagaacagcaggaaaaggtccaaggagaaactgaagaggaggaatggaggcatctgcccctccttctgccagggtcactttaaaactagacccttttcacaaggtggggagcacagtcatttctgctgttctgggggtacatctagggtgggacagggatgaacccaccaggcttttccacagagctttgccttgcattggtgaatgtgtgccctggtgcttatggaaggctcttctcaaagcccgcaggctgacctgccagcacacccaaagtggctccttgtcaaggctcagggtctcagctcaccttcagcatggtggagtttccctcctgggggagaacagtacatttgcactctgtttacaaaaagccaaaagctatgctttgtgtgcaacctatctgctggaaaaaaaaaaaaaatggaactaaggtgtctttgagaatgatctgatgcagctaggtcagggggaagaaagaaacgcaacaatttggagcagtgccccaaacgcttaaatgagctgggtacaaatcagtcagcgttggtaaactctacctatagatagatataatatctattttataatagatagattatatatttataatatatatactatatattatatagatattttataataggcattttctgacttagaaatactaagacaaaacagatactaagttccagagaacctccctttaattttattagggacaggagtcctgaatccttccaggcaagaagatagccccacagtcttgtagtaaaccgtgtgctgctgtgtttctagacccttaactttgtacctcctagaagaatgcttctaaaaactttcattacacttgttgataatgtttacactttaaaaaatacatatatctgggaaggtatttgtacacgtcattcattattccaaatataagggtatttgtacattacatgtcattcattatttcaaatgtaattttaatcagatcaacataaaagcatcttaatataatcagtagtggcactggtaactttaaatattaaaatctacaataggaaaaaaggagctttgattcattgtctcttttcaaattagcacaatcaacttagcacacacctctaacctttctttccaacctctcatgttctttctgccttttctcttgcttctcactcccccagcccatgatataacaaagagaaggctgtagagggcagagtcagggttgacaaaaaacagattccaattattccttctccttgcacgtattcaaaaacctatagccttttataaaaatatttcgattttttcccaggaaatctactttttatgtttgccctgtctttagccaactctaatagatttttctgttgagttctgatctgtacctgagattcttaagaggtatatttgcagacaaaaccaggaagatttccctgaattttttggaaacaatcttccttacaccaaaaagtaaattgcccaaggaagcctctcccacctaggacttcctaagagcagaactggcacttgtaaaaactcaggaaggttgcaaaaaaattggaaatggggttccatggtttcaatataacgttaaatttgaaaattaacgcctcaagttaatttggctctttctgtcttgagctgattagtgaacactagaattcatgctagagctcccaaaccatttgcctgcaatgcagggctcatgttccaaattctgctttttgcagtaaaaaataatatgctcacatcatttcatgactgtggtgctacagtgtttctaccggcttgcacgcctcctacgggtgggctgatgtttattgtattagtacataatgctgcaactttccactggcacacaaagctagtggttttctaaagcagtcctggaattcattaccatggaaacaaaaggtataaaaagctgtttttatctaataggaaaacttagaggaactctaaaaaagatcaaaagtgttttcaaagtaaaggtagagtcaaatacattaagtttaggttaaaggagcctcggaaaggaatcgcaagggttaacagaggaaggaggcggactctgtagtgatgggagaaaactcagcagcgccactgggaggctctgaaactgggacaaggatggataagtcgggctgccgaccaagtccacccccaaaaaagtggctgaaagaacccaatactcttcctctgccaaggtacaggagacatggttagaactccagtctctccccacagaggtgaaaatgagtagtttgttcttcggacataaataatatcatacacaccctggtcctaatacatccatccaaccattctagactctagattctagacatggaaacgagaagcaaatgaaaagcttaatataaatatgttcattttatcaactcatcatttgatctagagcttgatctcatgtgttcaggaaatgctgtcacaggtcctattttagtttgggaaaggagtaagcgcaaaccacaagtatttattttggtgtttacggtgtttccctaacatccaaataagttcaccacatcctgccatcagcttcaaaatagaattttggatatattcttccttccatggaaaacttcctgatacataaactgctctgaccatctgtaataatacaaactcttatccagtatcctcctcagaaaacatctggaacaataggaagctcccatcaatgctgctaaaggaacacaacgtttctggaagccatgtgatcattccggcagcagggaagatacatggggtcacaggcagtcagactccatccttgtactgaggccactgcccaccatgggtgtgctggccagcccatctgccattctagccagcgatatacggagagtatgaggcttacagagctgaagtcttctgcattaaaaggcttaattttcctgctcaaaggcagtcttttagaatagcaaggaaaaattattttaacttagaatggggttaaactaacagcaggactgtgtttagagaaaggaaaccatacagaaataatttgaaaacataccatctaaaaggcagtaaaaagcaatggttgaaagcatggacttttgagtccatcagacacataggtttgaatatcacatgcccacttactttccatgtaaccttagataagcctcagttcctcatctgaaaaccatacctatctgacagaattgttgtaaggatccaataagatcaggcgtgttacatgtttagcatagtgcctggcatatgggaagctgtcaataaacattacctcttgcactgtttctgttacagggagcaggtgatgtttagcctggagaactgaaggctcaggaagaacggggtcttcaaacacctgaaggactgtctcatgaaaaagagatgcacaagacaggagaattgagcagagagatgtttaactcaaatcgaagaacaaagacagcattgaatcaccacctatcaagggtcttacttgaatagactttggtttggatgagaggctatagaagaaaacctcaaaagtctcttccaattctaaggtttcatgattccaggcatttggagaattaggaaaaataatcacttaaaaaaaaaactatttagtgccaagcttcctaaaacatctttaaaatgtccaatatccatgaatcatagggtattatccattttatttgaaaaccatggaactctactactagaacttcattctaggttgtttaaaacaaagtacaatgcaaaactgtcttctttcataagaaccattttctagatgggcatagattctttgagggaattcttatcatgcagatattttacttcaaaatctaaacttgtaccactttactggaatgaaatattaacgctattaatttaaacatcataacattttttaaaaataaggtgttaaaataatatttattcatcaatcctataccactacaatattttagatcagtgatttaatatctgaaaaaatttatcacatactatgcataccactgatcagcagaggctgaaattttactgtaacttcagtccaaagatacaggttttaatttgagttctccataattcacagaaatatttaagggtaaatataagtcttaattaaaatccctattctcccagcatgtgctaaacccaccctgctccacatgcagacccttggccccaaacaatcccgagaggatgttggctcagagcagcaaggagctgacagatggggcattcggtaaaggagtggtgctgggttttttcatttttgttagagacgaaagctgtgggaaaaacattctccacttaatctattttattttcagcaaggttttacctgtaaatattaatttatacaccagcaaaactcactagatgcctgggctacatgaatataaatgaaataaagctatccaaactaaaaaatgaaatttcctgtatcttcctttctcaggcagaggaaaaatatccaaggatttaaaattctatccagtggtttcaaaggcaacaaaagatctcacattgagctctcatttaaataggtggggttaaccagggtagaaattacaagttaaagtgctgcagcataaagaagaaaaataatcatttatgccattttcaatacagaatttatttccaaatcaaaaccctttacacttggaatattgtcaaatctcaaatttttaccttgctgagatctacgaccaccttttgaaactgagacagtgtaggtatgattactccctgtatactcaagggttaggaaaatggaaaagaaccgtgagcccctcaagaatggtggcttttcttattggaatgaagtaaataaaataaattcattgacaatgcatttaatttctttcttagcaattaattgtgtatctacattgaatgataaccgtgtaaacagtcaagatatgcatgtggcaaatgaaaaataaagcaaaatgttttatcctgagttacatggattcccagagtgcaacggatggggaaagggttggggggagggattctcctaggtttgataacactttccttaaattcaacagcaattcacccctgtttagctgttctacaatgctgattaagagggtacagcattgtgccctctgggtgctctgtgctcactggcttgggtttttactgggacccccagttttgtgtccaatggaagttgggaacacagcactccaaccttccccatttttaatcctcctagagactcctaaaataatcctttgaagttttgtcatagcagagagatgctgtgagagggaaagaggtttccacatacttccacccccacatagctgaacatgagctggcatcaggtaaaagttcacaggattcccagtcttggaagactcttcctcctctcccggcctctcagtttgcacactcctatccattcctttaagcccagcccagcccaatcccatattactgcatgaagccttgtgctatagaatgaatgtgtatcccccaccagaattcatgttgaaatcctaaccctcattgtgatggtatttaaagatggcatctttaagaggtaattaactcataagcgtggagcccttgtaagcgcccttacaaggagagacaggagagagcttttcttatctctttcagcaccatgtgaggatgcaacaaggagacagcatctataaaccagggagagggccttcaccaagaacccaccaagctggtaccctgatctcagaattccagcttccagaaatgtgaggggaaaaaaaggctattgtttaagccacccagtctaaggtattctgttgcagcagcctataacagagctgattgagaaaccttggctgataactgcagcttccttggatgaagtcagcctctcttttaaaccccaggaccacactgtagccctttttacacggttttatattgctcgtggttattttacaggattttggtcatttcccctcaactacagtacaagtaacattgatggcttagagtcttcttttctttcatattatccactacaatgtcgaacatgcggcatatacctatgggatgctgcatagacctgttggtgggttgattgaatatcacctgcctacctgtattactaagttacagaaggagaataggtgggttaaatgctagcatctcttacactattctacttctcttgatgggggaaaaaaaaaagatttagcacttactgggtttagaagctataccaggcactgttcagcactgcctcacaatgctaggataggactagaccacattaaactctgcactgatttctttccctgtgaagtccttttacatttgagcaaattatccatatttgattgaaatgagaatttactagggcataattgatatgtttgactgaattagtcacattttaaacaggtggcacaagataggtcatagtgtgaatcagaatacatttagttccactgtttttctgattgtcctaaaatgaatgtgacttctagaacaagtacttctgaagccttttagtgctttcatttctgacatttgtatcagagatgataggaattagtgtcatgtcagccatctctggcagaaaaaaaaattattccctcaacaaaaggtaacattcttcatctggtgcaggcctgtgtttctgtccttaccacacatggaaaagaaagggaattccaacccaaaggacaggcttgagggctgccacccacccctggggttattcagctgttcatgctcaaccacaactccaccatcaaacctgtggcctctgtaagccagaattggtgatttttttctttttcttttttttttaaacaattgaatcctaagggtatttttcttttggcgctgaaacgatattaaaatttactgcaactttatttaaaaaaatagaaaactaatgtttctctgggtcttccattttttgaataaaactgactcttaccacccaacacatggatttggaaggatagcagtacaccaccttcttagctcacttggctggaacatgagctgatgaagtcctagtctcaagtttggccttcaagaaaactagataggcttgccctatgccagagccaatctagacctgccatcagttctgtttcttctttgtgtgtgtgtgtgtgtgtgtgtgtgtgtgagagagagagagagagagagagagagacagacagacagacagggtctcactctgtttcccaggctggagtgcagtggcatgatcatggctcactgtagcctcaaccacccaggcccaagtaatcctcccacctcagcctccagagtagctggaactacaagggcatgctaccacacccagctaattcttgtattttttatagatacaggatcttgtcatgttgctcaggctggtctcagatgcccaagctggtcttgaactcctgggctcaagtaatccatccaccttggcctcccacagtgctgagattacaagtgtgtgcaaccacacctggcccatcagttctgtttcttgaccaatgactatacctttaatgctaatctgcctttgttcacaaaatagggcaagtcagtctgaatggctgagaaactggaggagaggtaccactcaaaatgaatatcctcttaatagcagatgtaaatatcttcctcctcattatcatcatcataacaaacatttatggtgcctcctatggagcagggattttgcttaggactctgaactatatcttacttgtcttcattaaaaaccttatgaaaaaggtactattattaactggggttttttgtttttgttttgtttttgagacagagtcttgctgttacccaggctggagtgcagtggcgcgatcttggctcactgcaacctctgtctcccaggttcaagtgattctcctgcctcagcctcctgagtagctgggattacaagcacatgccaccatgcccagctaattttgtatttagagacggggtttcaccatgtttgtcaggcttgtcttgaactcctgaccttgtgatccacctgcctcggcctcccaaagtgctgagattacaggtgtgagccaccgcacccagcctgggttgtttaacagataagaaagcttaagaattagagagataaattatcttgcttaaggtaacacagttaacaagcattaggtcaaagtttgaactcgggcagtctgactacagagcccaacctatttcatataattcatattaatctattttactcacgagtatcagcaccactagataaatacgttaaaataatctataatttgaacagacatctcctaataacaaacataatatctataagtcgcaaatatctaagaaatttacatcagtatgacatggtatttgttctagaaataatataagttcaaacactctgagatgagacgataaatcactctgaaaactaacaaataaaattgccacaacataaagaaatagtacaagcactagtcaaagctagaggtcactctcaatccatgtgagaggaagcaagagtaagacactagagcaagaataagtcaccatccacatgtcccaaagaagcctcagtggcactgcaggagatacagagacagatccatggtgtccctgaagctgggactaagccagggctgtattacaccaaggaaaccagcctccctaatcccagagggagccttgaagcgtcttagagggagactaatggccaacattgagaacacatgtctattagcttgctgagcctaatgaagtaatacagcagagactgacctcattctagaaacagataacagtggctgtgcacaatgctatgcctagacccctacaccttgccagcctggtgttccttatgtattcaagatacataaagattagatgtgtagacgcaggttgtgaggacagtgtttggggataggaaaagcccccaattacagctaaaagagatgtctcttttgccagaaagtgtgttatatcaattaaatgggtaaataagcccttttcccactgtggggaagcaagggcctcttgtgaccctctattgattaagactgctgtggaatgttatttgcaatctcattgcataatggaaatcaggaggtagctgtcatggtttctgaagacaaattgctggtagctgagacaaatcatagcctctttcatcttttactgttctcaattcccaattaatgtatatcttacaatctaagtttcttaaatcagtctgctctactgtctcaggtagtaaaaatgtgtaaaatggtaatctgcctgaccctactttaagaaattgtgtttaagtgaccattgcactgatcattattcatgagctatgcattacttaataaggaacacaactcaaaaatgaacacaattaaaaataaatccacacaacagctgctgtgattatgaccaatatgaacagaaatccaaccaggtgtgtgtcaaaagaaaaaagctgctgccagacagaacactgttaaatctcatttttgttttgcacactttgacttgctaagtcagccagcaagcaatttgtatggagcagtgcttccaaagtgtgatgtgcaaaagagcagcatcagcatcacctgggaaccattagaaatggcagttctcagaccccaccccgggcctccccggacccactgaatcagaaactctgcaggtgggctcaggaacgcgtgtttcaacaagcactctgggtgatttctcgcatgctacagtgtgataaccattggactgagcacaggacagccttcagattttaagtcttcctaggaaggcattacctttggttgcaaacagctatgagaagagcccaggaagacacctgtgttaaaaccgctgcagtcttcaattgtgctgtgaacctaaaactgctctgaagtgaagtccataaaatttaaaaacctgcagtctctagggtgaatgggtagaaagagcacagtactttccttatgcagatttatttacatagaccctgacttattctagaaaggttttcagacaattttgtaaaccaaaatatataacatccagtcacaaaccattcttatggaaagacttctcactacttttcaaacaacctcattatttaaaacaccccaaacataggcatttatcactaaaagcacgctcttaagatgtcttcggtattcacttcaggatttcaggccatttaaggctaggggaaagaaaagaaatttaaattcaccaagtttaaaatgtgctccgcccaagagtcatggtgctccctgaactgtctgagcatatgaccaccatgctgattctaagttattgcatgtttcgaagagacatgacttggaatgttgtgtcctgtgaccctgtcttacagcaagatgctttcagcaattcactcatctggcccctttgttggtccaagaaagggccctacaccaccaaaattcattctagagctaatagtattcggatgaggctctagcattgtttcaactgtttttcaaaaaacaaatttgaagagcaaagggaagtaacttgtttatcagagatttgtaaaataaagtatggtccatccatatgattaaaaaccaagcaattattaaaaaaataaagtcctgcagttctcattcttgaccaaacatcagaatcacctggtgatcttttaaaacataccaatgcagggctctacaccaaccaatttaactggtcctggctagggtttgggcatccataatttttaaaagctatgctggcaatgctaacatgcagccaggatcaagaattactgcagtacatctgtattaaccaacatggaaaattttcccaaacatattaagtgaaaaagaaagtcataaatcacatatctgttaataaaatcatgtgtgcatgtgttattaacggatttatgcatttggaagtggactttcctttcatactatgtattgcttaaaccttccaaaatgagaatgtgttcatatattttgcttattttactttatttttgattgacaatttatatgtatttatggggcataatgtgatggtttatgtttacaatatggggtgattaaattggctaattaacaaatccatcatctcacattttttttggtgtatggtgaaaacatttaagatctactctttcaacaattttgaaatatacacgcaatttcttaatgttaaaaatacatttaaatggaaatttgtaggaaaaagagaaagcacatgaaaatagcaactctcaaaatataatcatgtttccttctttctccgcttctccctattagtctgctttcacactgctataaggaactgccagatactgggtaatttataaacgaaagaggtttaattgactcacagttcagcatggctggggaggcctcaggaaactcataattatggcagaaggcaaaggagaagcaagaaaccttcttcacaaggtggcaggaaggagcgtgccaaacaaagtgggaagagccccttataaaaccatcagatctcgtgagaactcactcactatcacgagaacagcatggagaaaaccacccccatgattcaattacctccacctggtctctcctttgacctttggggattatagggattacatttcaagatgagatttgggtggggacacaaagcctaaacatattgccctcctttttctaaaggagtatacaagaaaaataaacaaaattatacttctttcctatctattcaacacatatttccaacattgagattgggatgagggagagagtagagagatatgatttattcattcattcattatttctctgacaggcccatgctaggtgctaggaatacagcaacaaactagatagacatgcccctgcccacatggtgcttacagtctagtgggggatgcagacaagtaggtaaacaactacaacccagtgagagagacattaaggagaggaagcacaagctgcttgttacttgtaacaaagagacaatctagtcaaggaaagtgagaaaaggatccccaaagtggaagtggaccttcatcctgggtaaaaccctagccattaaagagttttaagaaggggaaagagattaccaagtctccattttgaaagatctctgtagctgggagtttaagtgctacttaccagtcctctctcacctaaggagagtgagctcttttcaaagttaaatgaaaccctgctacagtaccaaagagttgactgaagaagtccatctcccaatattccattatctattgccatcaaatgagattgaacatgaaatttacctcctactgagtttactgactgcactcatttatgagttcatctctagatgagcccggatatggcagatttaccttttcaaagttttgaagctaataaaacccattgtatgcaataaataactcaaaaaaatgcttggctttatagaagtggttgctacaattggtggagtctcttggaagaaaatatatcttcataaacatagcagggtaggcgaagactgccagggaaacaagctgcttctcagtatttcattgacttcacatgaagatcaattttagccatttataatcagcacacttccacatagggtgaaattatctagcccacccacaaatggatttctatttaaaagtctcatttgattgctttgggaaggatacactacagactatctaacccctatccttcaagggtagaaaattaacaatccaggtaaagttaactagaaaaacaaaagagagaggaattatatttgacagtgtcctcttacaacccagtgcatctttgtggacattaatgtgagttacctccagcatcaatgtgctatttttaacttagaatattcaatctttgctcaaagtaagacatatgattagtgtttggagtaatcaatttgctttaatttaaaggagagcagaggaaatgttctagaaaggagaaaaaatttgagctctttataaaacacaaatttatgggcttctcaaacatttccaaagaccctctcctttttaaattctttcaaaactacacaatctcttatggggagctggacccctcttttcactgggttgtctgcagtacaaaagcccctgaggtgtcgtttatacctctgtataggatggagctgttctgggtctgctattctaccgttacatgtcacattatcctaattgatacttctgttatctaaagccattagcatgttatatgagtgaagcaatcacctaggtctgctctgccccatgttagctgatatacgatgtgtgtgtgcatgtgtgtgtgtgtgtgtgtgtgtgtgtgtgtgttagggtacactagtgcatctaaaaagttcagatcattaaattcttgttctgtaactctcaaatttgtttccactcccaacacacctgagggatatgagacactcatctcaataaaaatagttcccagagaggggcttgggaggcacacatcattcactggatcctgccattcgaaaagcctcccaggtagttttaataatgcagcccacaccccttgtgggtgaggcaacagcagtatgaaccccaccgtacactcgaggttgagtatcactaatctagtaaagcattcagtatcctatggatctacgccacatggcatcttctgttcccaggttgtgtccagctccaggcccttattcaaccctcttctaaagttaaagaggcccatttttttcatttgcttctgagcttggataagaaaagaaacaaagataggatgacaccacttccctctaggtcagatgagcagggccacctgtattccagcagaggaggtggctatccactaagtgcagtctctgttggggctaaatgaacctccccaactgatgccagcatctcctttgcaaagacaaatcccatttaattccacaattagtgatcctgaaggaaataaaatgctcctctgacttaaacacagacatactaacatagagatagctgacaacacctagatcccttgcatcaggttttgattaggagaacacttaggaatacaaggactggagaggctgacacaggaggagcaagactgaagaaagtggtaaatggggctgcatggaagatgttgtctccttcacattttagttcaggaagatactgcaggtaaaatacatggccttcctaaagttgtccaaaaaaaggaaactgagacatttagggatcacttccaaatttggcccaaatattttccataaaattttaaacacatcgcaatcacattcttaaaaccccaatttatgtttattgttgagtaggacagtgagtaagttcatgaattaagaccctgtttgtattccttatgatcaaggttcattgcatatcttcagtggagatgctctaccttctttaactccattatctgggaataactagcaatacattaatttctgggcatatttttagattctgtgggtcttttgctaccctgaaagggcctaagcttgagaaaactgtcctaaaacttacttttactcaagtcataacctttggaaaattagtatttaagaaaagtattatttttcaaaaaggagctatatgccaatctccaatgcattaactgctaatcattcctctgataactattctaatatttcatgtccatcctagcatatatgtataaacagaagtcatccatacatagagtagacaattttctatcccaattgctttataattaatactacaaatggagtgcttcctgaaagtcacataaaaatcaaactaaagtagcataagttgctattatctaattcacattcttatggttccagaatcacctgtaagatggactaggcactgacatctcactgacggacttttgaattacagacgattttcaagtccaataacttggttaataactagatttgcttctgtaggttaaacgcgcactctggaccagtgaaccgatcatgttagtcatgacatctaccataacagcaccccctcctggcgataagtgacccacccactccctgcacttcagttaagggtagcaagagctgccctttcatgtgttggtgggtgtctcaagagatggcctggggcattggactctgcccagagagtcagtagtaaccctctcacccagtcagatggggtccctccagaattacccaagaaattaagagaactaaccagtcagtgagggaagaatagagaagagagaagccagatccccgctgcataaaaacaaaacaccctcttgccttcaggtggcctggagtttccttcaatagcccaaaaaaccaaaggacatgaccaggtcctgatggaagccttcctgcattttctcattaaatatacccaacaatctaacacaatcttattattcccattttgcagattggctgattctatggcaaaaaaaaaaaaaaaatgcaaacaagcttggaaaacctcatatgaataccttatctcctccaccacactcctcaaatctttgcccacttttggctgggcaccaggctacaggaaacagccaggattcacaggaattacaatggtattgacaggaacccgaattggtttataaggagagggaaaccaaaaggagaagattcttaggaaacttttcctctcctctaaaagtgatgtttttgaaccacagttgctaagttaaaaatagaaaagagatgccttggagcaggtgaggagggagttcaaatcagagagaagagttacagaaatgtctgagctggacaccaacccagagcagaaaatgccatatggcacagaaccggggtagctgggaggaatactagatcccaagatgtgggaggaagcctggagaattctggttccacatcttccctctaagcaaggagtccctcttactaagagaaatggttaacaactgcctagtttcccttgaaggtttccagaaatggagaactagagcaactctggctacatgttttaattgtgtccttctcactgtcaagaggcgcttcttaatgtcctgctcaaatgtctccagcacaccctgaagcctgtttgtgcctcttcagtactccttagacgcagagagcttctgcttagcatcctccttatttgagaaaatttcatctatctgaaaatagccattaagttgcctcataccattttctcttctaaactagggaaatccatacagaggctgcacagccactcaagggggtgttacaaagaggattccagtgccatgagtgggccagactagatgtgcctctgagatatctgccaagccagaaatcctttgattcaattcctttcatcttttgtgtgacatttcccatcactttgttcacatttgtcacaatacctgtcatctgtccaacttctccatattcttttaatatttctaaatctaatgtgcataggaccttttttttttcttttttttttttttgagacagagtcttgctctgttgcccaggctggagtgcagtggcatgatctcggctcatcgcaacctccacctcccaggttcaagcgattctcctccctcagcctcccaagtagctgggactacaagcgtgtgccactatgccgggctaattttttgtatctttttagtagagacggggtttcaccgtgttagccaggatggtctcaatctcctgacctcatgatccgcccgccttggcctcccaaagtgctgggattacaggcgtgagccactgcacccagccaggaaccatttttcacaatataaaacaaaggctcattaattcagattaagttgaaaaattcatgtccccctgagtaagaaaccagagtgaaagtattttcaattaaacaaattatgtctattacaaaagactacatattggttattaataaataaaatgagaaagttaatgaaaatggtgagttaacaataactttatttttactgcactttatacttttcaaagtatttttacatatattattccatatttccaattttattcaatatgtaaatgcaacatatgggtaatagatcaccaaacctaaatcaaaaagtctaatttatcctgctaaatttgaacttttaatgcaataagaattatatataattattccaagtctgtatcagagcagtctgaattaataaggttctgctctattgtagttataataagcctgacaattttatgaccatctcatctcccagagtgtcactcccatctacacattagtaataaatactgtttcttcatgaacaaacttttgtcataacagagcatcccaccttaaagaagtttcactcagtaaattaaatagctcaaataccatagaaatgttttccatgataaatgcgctgagttcattattctcttcaaaaatgcttgtttaatttaaaatgagcctaacaaagaggttatcccaagatgacaaggacccaatatatcacagaacttttcacctttctctttgttcaggaaaaaaaaaaaagagtcaaaattaatccagttaattgtaagtaatggaactaaaccaatacatgtagaatgccccatatagaatgtcccatttgaggaacctggtaacaccaaaagggtctatgagcaccttcaccatcttcactttcttcttaaacctgcagtaggagtcatagcatttcattgttctttcacaatggtcagaaagacaatgcctttacctaccttaaaaagtcttaaaatgttagcaaccatgatggacacggagcttgctgcagcacctatgacgccagaaatcttgtcgggcttggtgaaaatgggtggatctccattagcacacttcacatccgaagcatctttctctattaatgcctgcacgaatgttagagactgctccaaagcataggtgtccctagagcacgtgtcgaggatgcggacacccagagtgatgttggaaaggagatcagggtccttgttaatctggtcaattgcataaagcatggcctccagtctgtgaatccccttttccttcttcagctccccacaaggcacccctctctctccctttgcgtggacagggaagagaccccccaaaataatgtccccatccacccgtatggaatgggcatactcctggctgtgagttctttgcatcattgtgaggatccagtagaacttggcggtcaagaggaagaaacaagggcaagaggctgatcgctttccctcgcataccattttctccacaggtggtattgcaatccaagacccaaagtttattcttgccacagaagaaagggcaccacctgaggctgcaccttctggaggctaccatcagggcccatggggaaaaggctctgtgggcattagcaagttttcttgatttgaatgtcacagtgaatttccatcagacccctaaggttcaattttatttccttataagatcaacttgcctggaatggtgcaaaaattagaacatctgaggttctgatgttgggatgaggtcaacaattcatgtccttgaaatcagccttgtagcagaattattc
